United States Patent 9,328,346 (POLYCOMB-ASSOCIATED NON-CODING RNAS) - sequence listing, part 68

SEQ ID NO: 12874 - RNA, 148440 nt, Homo sapiens
cuggauuuuuuuuuuuccuuugcuuuuucuuaacuuucacuaaggguuacuguagucugauguguccuucccaaggccacgaaauuugacaagcugcacuuuucuuuugcucaaugauuucugcuuuaagccaaagaacugccuauaauuucacuaagaaugucuucuaauucagauacuggggauuuacaagagucuuuaaagcacggacuuacaccuauugguaaguaggaguuucucuauugaucaucuauuuauucugcuacuacauacauauaauuuaaucuuguugauggauuuugcauuuuaagucauggcuuuuccuauuauguuuauuaaaagcacacaauaagccuauguauauauaucacacauuuaucuuucuugcaguucaaaaaaagcaaauggauauuucaacauaugaauauuauucauuauaucuaguguuuacuggugucauucuaauacccuaaucagccagaaaauauaauuuauacuuuaucaauuucaacuuuaauauuuucugauaauuuuuaaucagaaauaauaagcuaaaauuugaacaauuugaaacaaguuaaucauauugagugaucauugaucaaacuuuaacagauagcugucaaguauuuguuacuuuucaacccacacaaaaguauggugucuuauucucugcuuauaccguaaaaaauuuucauuuuauuuuccuggggaaugaaagucaugcccccaccuccaaaaaaaaaaaaaaaaaaccaaaaaaacuagaccaucauuaguaaaggauuugaagagcuacuguuucucgcaacaauuaguauauuuuguuuuuacaaacagaaauaaguaaauaaagcuacuauucauuuaaaaaauagaguuacaaacuuaugaauuuuauagcaagacuacauucaauuaauucuaaaaguaaaggacugaagggaagugauucccagugaucuguaauuauuugucuguuggaagucaggcccuucugccuuuccccaguuuuugaaggaccugugccuuuucuggcagcauuugccuaggcuuucagacuggaauuucccuccgaauuugcaggggccugucaugagcucucugagucucagcuccauuauaacaagaaagaaaaucaaggcuugaguuuuuccucuuuuuuccuuccuagucagcugacuccacagaaugcaguggagucacagauugcuuuuuuuaugggccaacuacacccuaaaguauaucacuugaggaaauguuuaccaaaaauguucuauacuuacgaaaaagaaaacauggggaagguaagcaggguguaacacacaaucaauuguucugcagauaacacagaaaauacaggcacaagaaagaugagagagcagcacacaaccauuucgcaucuuuuucgucgggcagaaccgccgcggugcgcaggcaaggaguccuucccggcagcuccgcgcagcuccgguuccgcguccggggccgcagcuagagcgcgcucgggccggagacgcggacugcgcgcgcacgggggacgcgcgcucgggggcucgcgcccgcgcgggcggucuugggcuccugcugcgcgcagccccagcuggccgcugccaaaauagaguugagcugggucgggagaccacgcacgccgaucccucacagucucccccacaccccaugggugaauuaaagaggguaagguaggggaaagagacgcuguugcacuuuucucugcaacccuggaagaacuguguuuccagcuaccgcacgcgcaacucacaucgcaagggaccgaggcgguacacucugagcguaaacagagaacaccugcagcucuggaaucggucccaccgcagagggcugggaaccggaggacugucgguccagcccauaaggggcugcuggggacuaaaccucaagaaaaguaccgaagaaggcucuccccuggccucagcgagacuaccccaacauccuaaaccugugcaggcacuuccgggcgccggauuccgggauaacaaaauuccagucaauuugccgguaaaagagaccucuuucaggaucuuguucgcagccacccgccccuucccaacccaagcacauccccuccgccuccugguauugcagccccgcaggugguugugagguguccgcaccugcaacaucuuagugacccugaggcggcuguggcaccgggagacaaucuguuuaccucguagccuccacgagggugcuaacggucguucccagggugaauggcuggacggagccauccaaagggcugagggagaggaacagagggcggugaggagccuucggacugaacuauuggauugaagggccugacccgauuccugagggagagaugccccuugaaugggucuuucugauugcccaggguagccccacugggaagaacccacgggugcagcuguagagagugucugagggucucgaggguagcuuucagauggcaaauugcaaguugggcuguguugagugguucacaaaaccgagcccgguguauguagacaucagucaggguuuacaauucuauauuuaauucaguuguguuguacuaggaaaugagccuccuuuuguuuaaaaagcugucuccaugguuuuuaacuaggggcuacaucuuguaugcacacugaugguuacaugaaaguuuuguauagaugucugugcuuguauagaaaagcagaauuaagauaaaguuguuccuucugccuaccugcaagauaaucauucauuguaguguaaaagcagcacacucagguuauaacuagauuguucccuuaaaguuaacuaacucugggacacuggccagacucuugguuucuggucuugguuuacuucuuucucccaagugggaugauucuauugaauaauaugcaguacuaacuuuagaagcuuuuuauacuuaccuauaucaagaaaagagccauaucugugugguaggaaauguuauacauaaaacaaauauuuauugaccacucccacagugcccaauauuaugcuuugauucauauuaaauuuccauaauucuucaaauuaacugcauuugcagaauauuuuaugcacucaguauaauauugcauauuauccacagaagguuaugucugcauacuuagggguacaugauacacagugcaaacacuguauugagucuguaaugugagucuugcuaucugguccccugaacacucugagucugauuuuauuucagugauaaccuccagcaagcucugugcucauaaggaucucugaaaguagacguuucaucagcggaaagugugauagccauuaugucacccuaaccuccagcgagcuuuauuuagaaugccagccacacaagcccauguucugauucucauaguuggggcuuaggcugccaguuucuucuaugaagcuaaacucuagagccucccuucuuuccaugcccgaguccaucuccaaaacagugcuucucagauuccucuuuucuggccuggauccacagguagugaccagaguuaacagaguucuugggccaggcacagugucucaaacugguaaucccaauacuuugggagacugaggauggaggaucacuugggcccaggagauccagaccagccuaggcaacauagugagacccagucucuacaaaaaauaaaaaaauaaauaauuagcugggugugggugugguggcaugugccuguaguccuagugacuagggcuuggggguugagguaggaagaucacuugagccagggagguugaggaugcugugauugugccauugaacuccagccugggcaacaaagugagacccuaucucaaaaaaacaaaacaaaacaaaacaaaacaaaaaaaggauuucuuuuucuuuaacaccuuuuuuuuuuuuuuuuuuuuuuuugaggcagaguuucacucuuguugcccaagcuggagugcaauggcaugaucuuggcucacugcagccucagccuucuggguucaagagauucuccugcuucagccucccaggcagcugggauuacaggugcacgccaccacgccuggcuaauuuuuuguauuuuuaguagaaaugggguuucaccauguuagccaggcuggucccgaaauccugaccucaggugauccacccaccucagccucccaaagugcugggauuacaaaugugagccaccacaccuggcaucuuuaacaccucuucuaacaaaccaagagagauuuauagaggaagggagaacagaggcuuguuaaugcuucucuccuuuacuugaccccucuaccagacacaaugucuaggauuaucuuggauucagccuugagcauaaguugagcuagagaagggcacauugucagacuuccaccuacaggcccaacccaauccccacccccagggaugcacuaggcaggcaagacaacuucacuccgcagcucuagagucuaccuuaggauagaacuaguucuuugaguugcacuuccucacgcuucaccuuauuggaacagacuucuuggaaaaauccaguuggcuucaaggaacuucaggagggcauugugcucuggggaggcccuggggaaguguugaaaugugaccaauaugaucuugagagaucaagcuugagaaaaccaugugaacuggaacugaccaggcaagcugauaaagguugucucuucuuuagucuuuugggaagcuguuauguauguuuuugugugguugauaaguaagaaaagauauuuggaguguaacuuuuaaacaccaaauaaccugaaugcagaugaccaugagcacuuauaugagcaguuuuaucuggugauaauguaauuguccccaaggacuuugucaagcccugcaagacaaucaaguuagcaagcacaucccacuggaaggugauccuagaaugguuagugauucccuuuuuacuuuccuuacagaaugaugaguuugagugaagcuaaggggaaagacaaaggggaacugauauauauauauauauccagcguaauauauuucuuuccuggcacugucucauuuaacuauaaaguuuacuuuguuaacccaauuuuacugauuaaaaaauggaaucagaggucaagcaauuuacucagcuugucaagagaaugaacuguaaauagaacccaagaaauauucugaaauacauacucuuucuccaaagugguaaccacuuguucuuguugauauaaaggaauuaugauuuaauacaauguuggucuaugcagacuuuccuccaauggacauuucgagcuuaagaaacauauuuguaaguggcuuuuuaaucuucauuuccauuccacgguagaaaccauauuuggauccuucuagaauucagaaggguggcacagggagugguguauggaaagcagaguggaaaucacaucugggaggacugaggucugaguggggugggacaaaggcacuucugguccccuacucuggaguuuccuggaaaggaucucuggaguuuggaugaaguuuagcuugugaauuugugguguaugguaacaacucgcaggguuaccaacagauggugagaaggaacugagaggaaauucagagcauguacuuguuauagagucagugaguaugaggagggcagggaaaucacucaaacugagugacugaauuagauagcauaaacaaacauacuguuguaccaugagaggaggggauagggaaagacaauuuaggugucaauuaaaaaaaaaagcacuuuugacaaacccagcugugccucuugcagugagauaugcuagucccacacccaugcuagcauuuuucacgguaagugcuggauuccuugcucaggguuuggaugccugcagccucugcuucccggccuucugcaagcuccaccugcuccagcggccucuacaggaauggaaagaaaauuggucggaauccacugcuggguccuggaaucaacuucccaguuuccagacaagaaacucuggagaaaacaagugaaucucucucaagccuuggcacacacuguacaccaucucguaaucgcgaaaguuaucaccauguuggaaaagcccacgcccuucuaauugugcaaccucuguaacugcccagaccauaacacuuucccuaguuccacgccccaugcuugagugugacgguaccacuguuaagucuugccuuuccaagcucccacuuucuuugcugaccaagugagacccaaauugcuggacuccgcaccucugcggucccggcacucuuugaccuuaagaaucagaagcucaggcaggggcuuuucugaaggaagaaguuugguuggauccauccccucgcugcaaaagccgaggaauucugaagcaaugcaggauguuuccccuuccaucaagaaguuuccaguaucgccggauacauuuaaauggcagccuagaauaaucucgugcuaaggauuuuguuccugacccagguugaagcggaggagaggguguaaaggaugcaacugcaaguguucagcuaguuucacaaggugcuuuguggccuacuagcgccgggaucgucguucuguuggccccgaggcuggacagaauugauuccaauggauggagucccaauaguuuugaacuggaacuggcucaaauuuccauuucaauuacagagaggaagagauagauuagaccaccuacccgagauuauuuccccugccccacuccuuucuuaagaccggaucucccuguuacauucuucuaagggcaccgacuauacccuggcggggcacuccaggaccccuggguugggacaacgugcuguaaagaaaauaagugaaaagguucuucagugaacucuuuuuauacaaagagccguagauuccgauauccaggccaaacucuccaaaaagcccuccuuuccucuggggcaagggugggagguugcccgggggggugggugggggguagguuggauuacccagauaauugcuucggcuuucguuuuccuccgcgauaaaaaccgcgccacgccagaucgagauacucucauagugauugugaaucaaucgccauccugcucuaggggcugauguugaugucuuaaguaguuauucacacgugcagcagaaaggcuuuuuuuuuuuuuuuuuuuuuuuuuuuuuuuaaacaaggcacgacugcucaccuauucagguuugcuuuuuuaaagcuucgaucaacacgacgcucccugguaauuccuauggcuguacugaaauuuaacccgucuguuucuaauacaaagcgcucgggaugagggcggguggagccuacgggcgugggcggguagcccagcccucugagccagggaaugaaacuggaguucuggcuaaacuuuucagagaaaggcaaaagcagcuucugauggguuuuucggcugggaggggcggaaaaauuaggcagacccggagcucccguaggcugaaaaacuugcuccucuucccccucgggcuauccuggccuaguaauggagaucugaaaaaaaucuagacuucuuucggggucuaaaagguagauaugugggacgaaaaaaguaauuguccugguuucuuaaaaagcaccaaaaagugggaauggaagagaagacgggagaaauuguuucgaaggaggaagguauugcaaguuuugugcaaguuugggugggucaucuacccaggcgcgcggggaaagaugugucugccacaccuuuugcgagcccaggaaacuugaaccgcuccugaaaauccugauauuuuuucccgcugcagcccgcacgggucaagcgcgcgggggcugaccaacacuuuccaggucaggucgaguugauugcucccagcucacgcuccgaaaugcggugcugaaccacgggaaggaggggguggggaggaaggcaggcaguugcauccucgcgaguggggagugcgaggccuccucagcuccagccagcugggugaauggggcgcgcacggccccguaacgccgagcguggauaaaauaugcuaggacugcgcuucuccggcucaucaaggcugcgggagccuccccgagccaucauccuucguaauugcaaccgucaaucaacacuuuaagacaaagucagaaccgggaagggcgagcccuggagaccugucucgucggaaagaaggagguggaggggaggugggggaaaaggagagaaguuugccagaaguuggcagagggagugcaaagaaauugagaacgcgcaagguaguugagcagagcugucccccggucucaccacagacucccaggccucccggguucuagucucuggucuccgccaccaguuacaauucccgcagcgguaaguacgggguggguuccuaagugugcuuacacuaagagguacaguggcaguugcuaagauguccccggcggaggaugagaugcgucuguccacccgcgguagguguauuuaugggucagugcagaccaccgcuggcgccggcguuuagaccacacagacccgguuccaccuacuuacaucucaacugcuuucccuucccgcagccacuuggcugucuucauauuguggccucgggaacccagaaccauucucaaauaacccaucuuagacaccgcaaacucggguuccuccucccacagcuuccuuucggagagggcuuucugggggacgcccagacccguccaaggucacugagcuagcggguccccggcuucaacaggggucccuugcccagcagaauugaagggucaaaggaccagagugagugcucagagggaggagggaguucugagggagaagaaagggugcacuuggagggcaguaaugagcuugacgcuggaagccuggugccgccgccccugccucugccucuuggauggagacccagcugcuuccuuaaaucccuugcagagcuaccugaggaagguuugugugcccucgggucucuggcaagaaucaauuccaguggaagauuccuugccuuguccacugcuggcggggaucuugacauccuuccaggggaucugaaauagggcugcccccagggagcguuucccaucgucgaguuaaaggccuggagcgccgagggcuuaggcuucugagcuaggaguucccuugguucuuaggaaaggucguuuucucucgcucgagacuuucugcucuuucagucccccuccauuucgcugcuacgcuuagguuuuggccuggacuagacuuucaaagcaaaggaaagggcuucccuccgugauacaagcuccugcguuaauuuuuuaaagcauggauuuuuaaaacccaguccccagccaccguucccucccgcaccccucccauuuugugaggauuuuucuuuccuggaaaguccaccuguggagagauaaaugagugccagcuggccuuuugccaccaccacucuccaucuuucggggauguggugggaggguagacuggcauggaccaagaagucgcuaguguggccuaagcaagucccuucuggcccuggcagcuggcguuaugagcauggucacaaagcuugucucacuaggucagccucagccucagguucagccucaagccaaggcaggguuucuugauacacuacaauuucaagguccugucagacccucuuucaacuucuuucaacucuccuaacuucccccggcuucaccaagcagaggugaaaucaccaccacacacuagggguuggagguuuccucuuaggaccaagcguuuggaguccugcauccuugccaugcuagggucugggaaaggugcuguaucauaagugcacccauaaauucuucgcauugcugugggaggagguucuucuuaauuaaggcuuugaaauaaacugauuuucaaaguucacgagcaaagcagggcaaccacugcagugagcccugaaacugacucccuuucuuuauuuucuuaguucucagugauacuuaaaacaacuaggaauacugaaauguagugacagugauacuugauacuaucacaaaaauuggagcuuuuggcaacuucagcccacuucuccauacaaacuaauggacaggccuucauaaguuuaaauguuuccacgaaaccugaaguugcuacuaaagcugaagucuaaauaacuuugauccugaauauauauugaagagcaaaaugacaaaucaauuaagagucaguaguaccugaauugccaggugugggugggugaugaacaacccauuuuauguacauuaugcacugcaaagauuggaauaauuuccaagucaccaaauaccggauugggcaguuucaauguguaaucucuauaccauucaaauagaauaaacuuagaucuuuugagauucaaauucacccccuuguggguggacucugauaauuacuucguugcacagcagauucuaaauaugaggcauuucgcaugcagucaggaggcuggaaagaauguuuuucaucuuguugggaggagaucugaaaacuuugaagaugcggcugggcugguggucgaagagcuugcguaacagaugguucuuuaaaacauuuuuuaaaugcugggccucggccucaaguggauggucccaucagacaacagaaugaaaaaguacagccuggacugauccuuguauuccguguggaaacacaggucacuaaaacuggaaagucugucgcuuagaugaucuugggcuccagucgagggucuuuuaaaagugaacgaagggacuagggagcagacuggggaaagaggagucgcugccccuuccucuaauucuaugagugagcucuuggcuuguggcccgccucucauugagcugacccucggccccuucagggcgccggggcccacgugucgccucuucagggucucagugcccuggggaguugaagcuggaggacccuugaccgcagaccaacucugcauguaagaacggucagcuaaauuuucuccuuucaaugguuuaaguggguguuuaacucccuucaucuccucauccgacacacuagcaagggcacacgcccacccgcgcccccaucccuucuucuugcuuccccucagaucgaggaaauugccgcucuggcugcuucuccuucgccgccacgcucagacagaggucgcuucugacuagcuguaagacccggcugcauuuacauccccccgccccgggccaggguggggugggagggggugaggcggggugaagagguuggggcaggccgggggacuggagccugagccucauccuuauuggcuggcggcuaguguccgaccugaguccggaacccgcguccgcauucacugucuucaccccucaauccagccuucccccaaccccuggcccuacuuaccuccuucucccccucgucuuccccccuguccuucccagcaccgucacccucggggcugggaagggccguucucggucccgcgcggggaguggaccaggcaggagagggagguuggaacuucacaacuccacacuugcgauagugagcaagagagaggcagagagagauagggggaaggggcggagaggaggggagagagaagggaggcgagagaaagaggagagagaccccugccgauccugagccagagggcgguggagggaggggaaggagucgcccgagccguccgggagcaguggcagcggcacagccggggcggcaauagcagccccgcggucgccuccgcugcccgccgggagcucggcgguucacggcuccgcgccccgggcagcugcguccucgccaccgccgccgccugcgcccuugcggagccgaaccagagggccgggacgcugucuuccucgccuccuuuuuuaacccugaccuccuccucgcagcuugggggcggcuccggagcugcgagaccggacagggcucagagguccugcccggcagccccgaggaggcggaggcacgcuccggcgaggcgagaggguuggguuagcaggcaucccggucgccccuuccuucuuuucgccggaguugaaucugugcugcccguguccaggugcugggcuuccggaccgacacggaucccccauccccgcccgcggucgccuugucaugcugcccaaaguggagacggaagcccugggacuggcucgaucgcauggggaacagggccagaugccggaaaacaugcaagguaaggaggcgccgcgcggcgcuccggcucccgcugcuuccccacccccgggcucgcccugcaggcuucagccucccgccccgcgcgggcgcgggaguagccccgcugggcgcucgcagccgcgggagucaagcccccuccccaggugcaggcauaaaaguuuauggcucuugaacaaugcggggcagagguuuuuccaagcaacgucuaauuggccgcuucuaauuaaggaaagagaggcuuccagcucuauggcaacccaagcagggcagcuucaggcuaaagguacuuuagaauaauaagaucauucuaagaaauggaaugucucacuggacacccgaacagguucucugucauuggaauugguguguacuguacuucaaccaguacucuuguguggagggaggcgacccagucuaggaaagucaacuacagaaagaggugaccuccgaaaggauugucuuagcgcuauuagaauacaugugaccacaccaaaagcccaggcggacacccgcagccagcucggauuuggacaauucaacauugcuggcagaacugaagggaacaaguuaccccaaccccauccccuguacgcguagugcugagugaguugggggugggaggacagcgguucguuuauugcccccuuuuaaaaucugagaucugaaaauauggaggucccauucguuuucccagcucuugauugccaacaaaaaaacaaaucccgcuggcuacauuuucuccucauuccaaaauagcaacccuauggcuuguauuaagcccuucagaaguuuaucucauuugcucugggccagggagggaacaaugcuaggaaaagucaccggugcucuuccauccucgccccuuccagggugcaggaugugcgggccggcgggccugugaucccggaacgcuuccugccauccccuugcgcgaacuugaaaggacugggagguguugagagcagaguucagggcuggugcacucugcggugcugagugggcggcgcgcccgggcgcucaggccgggggaccuguagucgcccuaccgcggaggggaaaauacguagcuggagggcgugcgccgugcggguugugauccguuaccccaucggucauccuggggucuccccaagccucuagguagggcugugagaguccccuagagcugaagccccggaggcugaccugugggucuggcugcuaugggaacccgguugguccaaagaagccuuucuuccgggcaccuggaauuccaguuuaguguggggcaucggggaaguggcgcuggggggcuggguugggggaccucagccggcagcuccggagagggccuacccuuggggucgcugggugaggccggcacgauucuuggcuccaaaaggaaaguuucugcuucuuguucuggcgcgagaagccaaagacuuauuuugagagcggagagagaaauguuauugguaacguuuucuuuggaaaguucgagaggggucuucuggacacacuaccuagugcccccaaaccagagaaguaguuuuucuuuggugccugggcucagaagucgccacucacucagcccaugguucgaaaucagcaugggaagcgccggggcaaggcuucgucggagacuagaggccugccugucgggaggagccccugggggauggggaccccauucuccugcuugcucugguucccaccugggacgccuccguaggagcccagaaagacgauccacuacauggucccgggacagagcagcgcgcccaacuuugagggaacuuugugcgccucucugaggcccuagcuuuccaaggcaccgccguccguucuucuuucccuagaccgaaacuggggaagagugugggcgcuucuuugccccgaugaguucgccuccccaaacgccuacuucggcugcaccagagcaucugggaaacucugaaaggugcccaggccucacacagcagcgucucccuacucagccucugucuuuggguuuuuucaagagagucucuaccucaugccucggucuuucuucgaugucggguccccgagguaggcacggagucccucugaaagcaguugccuaucugugccccuuugguguaaaguuagaguuuacuuuguugggggaaggggagguagaaaagaucacaguugggaaagugcgcuuuucgccuuguuccuaaaacaugccucaagacugucaucgcgauuguuaggagagcuaucaacgucuaggggcuauaaaggaauuucugaacccucggcccuucccaaacccccagguuccuaaaacccuagugggggucucuuggggcugggauucaggcuggcaccgcugggaggaccucgccuagcaucccuuuauuaauauuucacgaaggcaggcuccugccuucucuggagccucuuuucucggaauguucccaaacucuggcuaacucacuccccugugagccauccuagggcucuguggcccgggaagagacgcgucaacuccgcgggucugcgcgcaguccuuagccgcaaagugcugcaagugaccccccugacggcccuuuccgaccgaagagcucgggaaccaaagagaaaaaaaauaacuuuauuuucaaaagaacaagucaucacugcggcgauacuguggcggaggacuuuggcgauggggugggggcuauuucucuuuccuuuuugguaaacaaaucagaggaaacuucugcccggccguggcuuuccaucccccaccugccccacccccugcaaacgccacugauuaacuuaaaacaaacucggcugcguguuugugcgccguuggguagcaggagguagagccuaggcgagagccuggugcgcccacggguuucgccgaagagugcccgggggagugcgggcagggucccggcugcgcagaccugcgggugcccgcccacccgcgccccgcgcucccauacuugaccuguguggauguggagucuccgggaaauaccggaucaggcacuuccuggggucuccuggucacugcccuuccugugcauaguuugucaucuuuuuagcugcgaagacgccuucgugggucugcguccggagcaaggcgguuacccgaucccggcagugagccgcgccgcgcgucguggcggccugauuucuguuuaacuuuaauagggcgaucucgagguguuuauauuuugcuaugaugaucggaaacaugugagguucauuacagggcuucaauacuuugaaaccaaaacccuucugugugucuuuuacucuucugguauuuuuccccguacgggcguccucuauuuucuuuuuccuucuuuuuauuuucacagauuuucaaacguaaggagaugaaaguauccagaauagaaaaguacugucaauacggaacugaauguuucgauuaucuaacagaucugaaaguugggagccucaggcuguuuaguuaaagugggcugcugcugagaagcggguuucuggggcuucaguuucucugucggacagaguuugcaaauuggugcugcugucccuguaagcaaggugcacuugcagcaaaccacuucaagagggagggaauaaagccugcgcuuguuucucuaccuuaggcgaaggugacauuuuggaauuuaacuucauagggauuuaaaagaaauucuaaacugucaccuuaugcaauucaugucucuauuuguugcuuuguggaguuaugagacuuguguuuaaaagcggucaguuuaaaauguuaacaaaagaaguuggaauuguuuguggcacauggaauuauaugagguccaugcuuauugaugacaaaagauguuuuacuuguaaaaauaguucaguaagaccuugcuaaaaauuguuuuuauuuuauauuuuaccaugugauauuugcccagcaaucaccaaaaugcuuuuuguugcaggauuaacaccuacauguaaauuaauugaauauguguauacauuucucuuuuuguuucagugucucaauuuaaaauggugaauuacuccuaugaugaagaucuggaagagcuuugucccguguguggagauaaagugucuggguaccauuaugggcuccucaccugugaaagcugcaagguuugcucacacauugcuaccugaaaaauauaauguccaacaccaaaauaaaccaguggauuacuucuuuuaagcuaaauuuaggcuccuuuuuuaaagacucaacuaaaaaugagggagaaagagagagucuuagggagaugauucuuagaagugugugucugauuuaguucaaaaggcaaagaaauuuaugcuguuuagaaaacuuugccagucucaugguucuaaaauacuuuauuguaguaaagugauauagcuguagaaagacuuccauuucuaacaguccuaaauauugauuuugcuugacuuauauauauuuaaagcaucguuguucuugaaagggaauaugacaaacuauuucccaaauacauuuuaacuucagaguauuucugugcuauaagucuaaacauucuuuauccacagacauaaaagccuaaauucccaacugugugauuucaucuugauuuauuccaaaauaauuuuaaggauuuuuugaaauuuauaucauaaagaccaagaaaucagauuuuaguuuuuaauauaauaauuuuuauaaauauaugaccuauuuaagugcauggauuuuaauauguaaaauaugcuauauuguuaccaaaaauauaaauuauacuuuaagaauuuaucucaggacuuuuuaauacauucccaguaaauucaauauucacuauuuuucaaaguuuuuuuuguuuguuuguuuuuguuuuuaaguggaaaacucaguacaauuacuuaaaccaccaccaggaaaaucccuccauucucuauaacaaaguaagaauguuucucuuuguggcaaguggguuaaauaugaauacuauccugguaaaucucauauuauaaagcuacacauuuuauuuuugauuaauucuuuuauauaaaauauaaggaaagcucauacccugugugcuacaauucagcuaucugugauacaugcuuuuuccuuccauuaguuuugccuuuuuaagaacaguucccauacuugaauguauuccaguggaauuaugagcauuuucccauuuuacucuuuaaauccuuuugcuuuuaacuauccaguguugacauuuguuaaaaaaaaaaaaaaaucugagguguuuugcuauucaguuuuuuccacuggcauuuugcaaugguuuaucacugaaauuauaucagacuacuuaaaaacaaugccaggacuucaugaguaccucuaucaggaacaugugggauaauaggaaaauagauuaaaaaaaaauuuaucuauauagaguguauuuuuucugacuguugggauaaaaugguggguagccaaaucuccccaggauuugacguaauucuucaagaauaaaacugaugccagaaaaaucuccaccauggccuggcacaguuugggaagguugauguugcugaaauguaaaauaaaccacagaaccacauaagggcucaaauagugcaaugagaggauuuacuggugauuuucuuaaaaugaaacaauggaaaagacggguguuagauuuauaauacgucucacuauuuucucugucuuauagggauuuuuuaagcgaacaguccaaaauaauaaaagguacacauguauagaaaaccagaacugccaaauugacaaaacacagagaaagcguuguccuuacugucguuuucaaaaaugucuaaguguuggaaugaagcuagaagguaagauucuucuaaagacuacugccuauuaaaacucuccaaggacaugaacuguaaaacaacauuguacuuauagcaugguaacauuauuuucccagcauuuuaacacuaccgacaauacuguaagaucuuucuauguuucaucugcagaauagucugagucucauuuaaucauggugaaaucuacuaggaaaaaaauuuaaaauauuaguugucuuuccccugcccacccccuuuuuuuuagucuggggagcagaugcauuagacacaaaaaagggaaaaagaucagguuaugaaaauaagacuaaagcaauccaacugaaaacaagaauaauuuguaaaacuauuaaaaguaaaauauucuuugaguuuuuaaaucaagauacccuuggaaaaguuugauuucaauucuuuuuaaaagaggugugcuugucacaaguguuaacuacuaauuucaugauucuuaagaguuaaagccuuuaauggugaaaaggaguuucucauguaggauauuaucuuugauaguguagaaauguauuuuuuuaaaagauaaugacugaggcugcaaaauaaaaaauugagaaucaggaaacaugaaaaauaacgaacuauuaaaucauuagcaaaggucugaaaagaacaagaaaguggcuccugaaaagccacacuugaacuuuguugaaagagcagacccuauacuacaauguacagauuggcaggcaguaaaguuaauaugugacugcuguaaauaauuuguaguucauggacuacuaugguauguugcugcuuucuagccucugaccugcuugcuuuccauggauuaaauauacugcaaauaaagcaauaacagggauacauaucaccgauggugcuagauacaagagugcauuuuauuugaucaaugaggcacaggcuauuuuuauuuggaacuuuucuguuauauggaacucauacuugauagaaauacuaaaaaaaaaaaucauauaaaucugcugaauagcuaacacgcuucuuccgaacagagguagccacuuugguuauuaugaggacuguuaaugucaguaucauuuuuaagagaucaugaaaggaaauaauugaugcuuauuaauuuucuuauuaccaaucacuauuauuucccaaauagcaaaauauugugguagaugcuuacuacauacaguaagagacucagaagauaaguaaauguugugauuuugcaugaugucauuuaauuccuuuucaacaaaaauaauaaggcugcauuucuuuaccuuaaauaauuaaacuuucuuuuuuuuaaguuaagcuuucacaauuguaaaucacuugugguacaugcucaugcuuccuuaggagugauaugaaacaacugaauauucaauaaauuaucauccagaugaaaaacucuuuauaaucuugugcaauauucuguauacuuagaauuuacaauaaauuuuuaaugugauacuaauccaagauaaaaagcucaaaaacuuaaccuccagcaaguucaauaugucacaagcuaucagaggucucuaguuucugucuaauugccauuggccacuauggacuuagagggaacugcuaacuaacuuauuagucauggccgcagacuccacacaccacugucgcagaagacucucuugacagcuucugaaaugaauuuguuuuaauuauguccaauucuacuuaaauuaaaagcaguaacugguggucaucugaugugggcucaucaaguccaggugaacaugauuuuccaagaacauguccccaccccuuuuguuauugcaacaagguggccaaaauggcuuucagggaggaagguaucuugugggaaaguauucacaauuuaauccaaaauuggguaacucaguuccacaccccugcaaaagaaaaccccaaagcaguuuggguuuccauaaggaacuggcauaauaaaagcauauacucuuaguagaacgacugauacucuuucuuagcaaugugaaauauuucuuuucuuuuuuuugagacagggguuucacucuuguugcccaggcuggagugcaguggugugaucuuggcucacugcaaccuccacuucccggguucaagcgauucuccugucucagccuccugaauagcugggauuacaggcacccaccacuacgccuggcuaauuuuuuguaucuuuaguagagaugggguuucaucauguuggccaggcuggucuugaacuccugaccucaggugauccacccgccuuggccucccaaagugcagggauuacaggugugagccaccgcaccacgccuaugugaaauauuucuaugucuaacaaaaauuaugaacucuccuccauccacaaaaggguuaauaugucccuauguggccaaaguauuuuuuugaugacgacacacacuuggaggaaggaauucauaaauaaagaggacaugguuuuuugggaaaucuuugugggcuauuguaacgaaaacaaccacacacauaccacuucuugucgauuuacauuucuaaauaucugaagaaugcuaauaauuugcaccuuauuuauaccuuuccuuccuuccccccaccccacccccaacagcuguaagggccgaccgaaugcguggaggaaggaauaaguuugggccaauguacaagagagacagggcccugaagcaacagaaaaaagcccucauccgagccaauggacuuaagcuagaagccaugucucaggugauccaagcuaugcccucugaccugaccauuuccucugcaauucaaaacauccacucugccuccaaaggccuaccucugaaccaugcugccuugccuccuacagacuaugacagaagucccuuuguaacaucccccauuagcaugacaaugcccccucacggcagccugcaagguuaccaaacauauggccacuuuccuagccgggccaucaagucugaguacccagaccccuauaccagcucacccgaguccauaaugggcuauucauauauggauaguuaccagacgagcucuccagcaagcaucccacaucugauacuggaacuuuugaagugugagccagaugagccucaaguccaggcuaaaaucauggccuauuugcagcaagagcaggcuaaccgaagcaagcacgaaaagcugagcaccuuugggcuuaugugcaaaauggcagaucaaacucucuucuccauugucgagugggccaggaguaguaucuucuucagagaacuuaagguaugccaccagcuauuacaacuuacagcaccccuuuuaagagagaccuaacuauguuccuaauuaauacauucuuggugcugaaaauauguguuccuuaauuuucuacuuuguaugauuuacagaguagacguaauuuuauuaccuugacuucaggacuguggcagcuuaaauuuauggggcuuugauuuuguguagcucuuaguuugggggggcuggcauuuaacauaaaguauaggaaacucgggcuuuuuuuucuaaauaguagaauaucuguauuccuuuuaauucagaugguuuguggcuuaaaacauuucaagucaaugugaaauagcgccuaguaaacuauuuuucuugaaaauuaccauguaaagagcuauauuauaauggugucaucuugaagguuucuuuugaaggaaaaaaugccaacauuuaguaguguuuagacucuaaggaaugaaaaugauaccacugguuaguaguaucaaguagguauuuacuacuguuugccuugacauuagguugguaaagccuuuguuuucguagcagauuccaauaggauguuuacugucauuggauggggaaugggcaaauggugagugcuaguuuacuugguuuggguuguaguucucauaaucuaugucuuguugauuuuaguggacugguacauuguaaacauaguacuuguuuguauagggaucuauguuuaaauuaauaauuauuuuauuuccugaaacuuaagucugaaugaaugugagaaaguuauuuagaaguuuggaaucuaagaggggcuaccaaaacacauuugguagucagugguuucauuccuauuuuaaaagugagucuugaauuugauuuccaaguauauuuugucacaaaaucaauuucuuccuuuugcuguaacggggagagauguggcugcuaaauaucugugacuugugauuaccuaggacaggagauugauuguaaaauuucugagagaaggaaaaugcaaagccgacuuuuaauuuuaagaguuacuguuaaaaaucgucuguguaaguagauggucuggggaauguggaagccacaugcaaauggaaaauaaugcuuucauagcagucuacauuaagcacuguucuuuguacauggaagcaaaaaaguuaccugaacagaccuaaauaaguugauaaaauuccaucagcacgcuguuaagacuguggacacauccagcucuuuauuuccacguccuuuauugcuacgcuuaaaaauggcugaaggauaucucaggcugcaaagggcaagcagaaugcacugcguuagcacaauuaggccagauauuuuccgaguauguguuaggguuuguaaccacucuaugauaaucagaacauuuuucaugaaaaaacaaaccaugcaaacacuuuccugauauucuuacauucaaaacuguguccuuaaucaaacagguaaaguauuugaaaaugaaaauuaaaaugauaauuuuagauacugucgaaagguuagguaauguaaaaaugaggaaaacacagacuuuuuacaaucaaaugaacugcuuaauaauuaugucuucauaggcagguuguuagauucucugagccuugguuuuucucauguguaacuuguauaugugguguuuguggaggaguauugggagcacagauguaacuacuuauauugaggagguuuucaaaggaaaaugagaauaugcagauaaagcacccaguaccgggagucuggcauauacuacauacucaguaaaguguggugcuguuuuaaauugauauuacuggggccgggugcaguggcucaugccuguaaucccagcacuuugggaggccaaggcgggcggaucaccugaggucaggaguacgagaccagccugaccaauauggagaaaccccgucucuacuaaaaauacaaaaaauuagccgggcuugguggcacaugccuguaaucccagcuucuagggaggcugagacaggagaauugcuugaaccugggaggcggagguugcggugagccgagaucuugccauugcacucgagccugggugacaagagcgaaacuccaucucaaaaauaaauaaauaaauaaauugauguuaucacuguuguuuuaugaaaaaugugcagaaucuacauaauuuuuauauuuaggaucaaaacaaugcaauuauagucucuuaguuuaacauuggcaaaaacuauuacauguguuauagaguaguaugauuuuguuauaauuaacaguuauuaaucaguacuaauuaaggaccuaaaauuggccaagggguaaguuggguauaagguaaaaacaacguugaauaaaacaacauguuuccucucagaguuuauaauaagacaguuucauaaauaauuauuuuaaaaaauaaagacagccgcagagaauaaaaauauauuuuacaaaucaacaaggaaagaaauaaugcauauuauuuucauguaaaaaaggaaacaugaaguaaauacagcuagcggcuguaaggcauuaagaaggcugggaaaacuuuuuccacuauuccucucuuuucccuccucuguggauaaauuuuacagugacuucuuuauauagcaugagguuaaauauuuggcuaaaacauaaauaucuuugagaauggggcauauaaaagcauuuuucaaucaauuacgguguuguuuaaugcauuuaucagucuuucauagaauacgaaaaaaggaaaagggaaaaaaguacaaacgugagggucgucuacaaggggugggagauguucccagaagagaaagauaauuuugacccacuucacaguuugccuugggcuuacuuugaccaggagugauucaaguauuuuuuggugaacaaagaguagaauucagaaaaacuuaaggauaguuucaguagagaguugggaggugacuauugacauuuggaagaauuccuuuuccuuucguuuauaaauuuacuuugucagaaagcaaaccaacucauuugaagccaggauugagacaucucuagggcuguggcuuucaauuuuuuuaaucaugacccacaguaggaaauguauuuuauggcaggacauaguguaccaaacacaucacacgggcgcacacacacagagaugcacaaacauacaaacacauacacacaacuaaaccaaaguuucaccagauaguacauaaccuacaagccacgcacucugauauuuucuaucuauucuacuuuagucuaauuuauuucauguuuuuaaaaaaauucuggucacgacucacuaaauugauuucacggcccauuaaugaggcaugaccugcaauucaggaaaacuugcugcucuagaggagguuuuaucggccauccauuggcguugccuaccugcuacaauuaaggauaauaacuccggaaaaaggucucuuccuccuggcguggccuauaagacaucuuugaaacccacagccugaguccccacccuaucuuucuguaaagguuguaauuuuaaaauaucauuugggaagauaaaugcucuuuuuuauucaauuugauuuuaauuauuuuuguagagacaggggucucacucugcugcccaggcuagucucaaacuccuaggcucaagcaauccuccugccuuggccuccugaagugcugggauuacagacaggagccauugugccuguuuuauucauuaaauaucuguccuuuuccuugguaacuucacagcaaauuaccuaucaagugauauacuuauuggacagauuuuuuauaccucuaaaacccaaagaugaaaaaucacauauuugcuccuaauuaggcaauuuugaaaugaccucuuucucacucucuuuuuuuuuuugagacggagucuugcuuugucgcccagguuggagugcaguggugcgaucuuggcucauugcaagcuccgccucuuggguucacgccauucuccugccucagccuccugaguagcugggacuacaggugccugccaccacgccggcuaauuuuuuguauuuuuaguagagacgguguuucaccguguuagccaggauggucuugaucuccugaccuugcgauccgcccgccuuggccucccaaaguucugggauuauaggcaugagccaccgcacccggccuaccucuugcucacucucucaggacaaauuacacucucuaccacauaggaaaaaaagagaauuucauuuguuuacuaguuaagggaacagaagggccaggaaauuugguagguuguuuuguuuuucuauacaucuacaaggugcaaaaaaagguauucugguuuucauucaaaagauuggaaugaaaaagaagaaguuacaacuccccaacucucauagaaaccguggaauuucagagcuggaagaugaaagggaaaagggcuagaggacacauauaagcgagcugcuuuguuuuuuuaacacacuuguaaaggacaauucuggucuucauccaaaauaauggcuugagaaagaugaaauuaauacucugaaacuuguagcuuuugcaacaacagaugugcaucaaaagauacucauugccuagaaaucacaagguuuuucagagcuagaagagaucacugagaucauuugacccuaccucuuuuuacauaugaagaaacugaggcagaagggaauguaaucugcccaagauuauccagcuacugaauggcagaacugggacugguagauucagguucaaagaagcaguccucuuguacgcauucccucaucccccccagcaugcacacgcacacacacacacacacacacacacacacacacacacaaagaggcaguguaaucuuugacuccaaagaaaacaguccuuugccagugaagcuaaagcaaaucucuagguuaucagaagcccaucacuaccauccaauuaccaaaucacuaauaaucagugagacagauuuucccugaguccagaugaccccgugggagugaaugagucacuuuaaaaagcuacaauaauucuuucaggccacugggguaucauucaguacaguggauucagcacuucugggccuugaguuucugaagcauucucuagugcccuacccucugcggauaguuuacucuccaggugaaucugguucagugacggcauaugggcugugcucugccguuaaagcggccaaacacgauuauauccugugcucuacuagaagcugggcauguucaguauggguuucuuguuacguaugcuugucgagauagcagaaaaagaaugcagggagcucacuuuggcagcauauacaauaaaauuggaaagauacagagauuagcaugacccccugcacaaagaugacacaggcauucaugaaacuguccauaaaaaagagaacacaggaugguaaccgggugauaggugagccacuaauaaaauuuucugaucuuuaaaccaaaucuguugagugaccuaugcucuugacuguuuccuuguguuuuuagaaauuaagagcuaauucgagacuuuuguauucugcugaaagagcuguccuugugagucaagaagauuggcuuuuuuuuucaguuauuuuuuuuuucaccugugucuugaauaucucacaaacacaagagcagugagaaaauaauucccacuuuguuaaacaacuaaugaaucuggaggaucuauuugaucuucuaaugagaccagaugucuuaagagaauucugggaauggauauauaagaacuuccccucggugaaugauucugauacauguacguauuaaaaaaaaucuaaauuaauccugacugaaacucccaacuagcauuucuguggaaaauaggucucagagacucagggaguuugugccaaaggaauuuagccaugcugaaguugguuuuuaaguauagcuuuaucuaaagcgagggcacaaggggaggagcaaaccuucuuuuuucucuagccaauuauggaagcuaucugagcagcauuauuuaucuauuuuuaacauucuagauccuuuuuccuaaaucacaguuaccuuucccaaugcaggccuauaaucucagacuuuauugaaucugccccaauuuuaagcuauauucuuuaguaaauuuacuuaguccuacuuuuuuuuuuuuaagacagggucucucucuguugcccaggcuggagugcaguggcaugaucauagcucacugcagccuugaccuuguggccucaagccaucuucccacuuuagcuucccaaauagcugggaccacaggcgcaugcaaccacgcuagcuaauuuuuuauuuuuuguggagaugggaucuugcgacguugcccaggcuggucuggaacuccuggguucaagcaguccuccuaccuuggccucccaaagugcuggaauuaaggcauaacccacugugccuggcagcccuacuuuuuuuuuuuugugacggaguuucacucuuguugcccaggcuggagugcaauggugcaaucucagcucacugcaaccuccaccucccagguucaagugauucuccugccucagccucccgaguagcugggauuauagcgccugccaccacgccugguuuauuuuuguauguuuuaguagagaugggguuucuccauguuggucaggcuggucucaaacuccugaccucaggugauccacuagccucggcaucccaaaguuuacaggcgugaaccacugugcccagccagcccuacuuuucuaugggagagaaagagaaacugagagagaggauccugcucggugucuaccacauuuacuugccauauggcuguucuuugccuucuccugagaguuggggucaggaaucauggguccaacacgagcacuccucauugccaugugaugucacagagcaauagccacuuuacuuaccuuuguuuucacuucucuggaugcaaaguagcuaaucugggaagcacaaggaugacacaaagaaaauaaacauuaaaguuuguuuuccagucaaauuuuucaaugaaugaaaauuuuccaaucaaaauuugaucucaaggcacauuaagccaucuauugccaguucucauacucaucacaaaguugccagaaugaaauaaaucgaaccugcauagguuuacaaggaaaugauaaaacugguuuuucuuccgcugaagguagauaugaaaguguucugucuuugugaauuuggagagaauguuggaaucagcagguuugauucauggucucuaaggucucuucagguguuaagcaucugcuuuuauaucuuuuuccaagcagaccugaaacagaaggcuuugguguggcugauaguguuggaugagaauuuauguuauuucagccuuucuugcuuacauacguauauugcaugugucuauuguagacucagaaagccauuaucuuucuucuugcuuucuucugagcuuucuucuugcucacaauucacugaaagaaucagcucuucucagucaaugccuguuugugcuauggccaacucacuguggggcaguggaacaugcccacuuacuguggggauguguauuguucuuuacugggauaucuugaaaguacaccagucaccucaaaacucccaugcauuaguuacuucuacuaagguaaaauuuacucucccuaaaauuuacuguuuuuaauguacaaaugauaaaacagcucuuucacacuuuaaaauucucuugugucccuuuguaauaaacuccucuccccaccccagucccugccaauccugaucuguuuuuguccuuagaguuuuuuuuguuacuuuuaaaaagaaguaaauuugcuuuauucguugaguauacauuuacaaacugcaaacucaguuuaagcucccugaaacuuaugguuucagcguaguugagcacuaauaguuuccauggaaacauauccuccauggggcgcugggauauuugguaagagaguagugaugaucauaacuucacacugggucugcuuguucacaugucuuaugagcguccuguucguauuaaccuguauguuaucuacuggaaccauggggagaacaugagaauagcgaggcacacccaagaaauccauguuuaacuagcuuggccaucgucaggugucugaaucugaacagugagaguaggaccacacugcuaccgcauaccugacugccucauucugugucccuccuguucgauauagucugguuuugcaaacugaggcuuaagccucggcagccaagagcaagcccuuguuccuguucugaugaggauguacugaauuauuuuguauucaguuuccuacgaugaccuucucuaauuacacaaaagaaaacauaaugaauuuacauaucuuugggucaauuuaugaaaaaccauucuuuucaguaauacaaguccuuuaagaccuguuggaaaaugguacagacgugagcauuuuccuugcucugcucuaggucauaugguaaaggagaagagaaguaacuuuucuuggguacccacuaagcaccuacucuagugcuaggugcuuucaggccauuuucuaguuugaucuuuaggacaguccagugaugagagcacaguguauggucauuuggucagagugggaguaaaagaccaucgcucucguauaacauguucucuguggaggauacguccgucagucauaaugacucauagagaugucaaguuaauugauucguaaaaguuugcuaaaucaauuuuuuuucuuuuuuuuugagacagggucucacucugucgcccagucuggagugcaguggcacgaucuuggcucauggcaaccuccaccuccugcauucaagugauucgccugccucagccucccgaguagcugggauuacaggcgugcaccacaacacccaucuaauuuuuguauuuuuaguagagaugggauuuugccauguuggccaggcuggucucaaaacuccugaccucagggugaucugccugccucggccucccaaagugcugggauuaugggcaugagccacugcgccuggccguaauugugcuuuuuuuuccuuuuuucuuuuuuugagauggaguuacacucuuguugccugggcuggggugcaauggcacagucucggcucacugcaaccuccaccuccuggguuccagcaauucuccugccucagccucccgaguagcugggauuacaggcaugcgccaccaugccuagcuaauuuucguauuauuaguagaaacaagguuucaccaugucagccaggcuggucucaaacuccugaccucagaugauccacccgccuuggccucccaaagugcugggauuacagaugugagccaccacgcucagccaaauuguacuuucaguaaaguacuuuacuguuuacaaagaacuuccauauacauuuuuuugguccuggucucugucuuucauuuugggagcauggauguaacuggccuuucaucaaugguucaguaguguuguuuuuuaaagccuacaacagaaccaucuccuaugaauugacuaucaccugucuaaaugcccuguuuacagcauguuguaccugcaagagcaggauauuuaaaguacuuuauaauugauaauugccauuaucaauaugcucaccucuuuaccauauuccaacaggucuuaaaggacuuguauuauuuuuuaccgaagagagugguuuuucguaaguuuacccgaagauacauacauuuauuauguugguuuuuuguuuuuuuuuguuuuugagacagagucgcacucuguugcccgggcuggaaugcagugucgcaaucucagcucacugcagccuccgccuucccgguucaagcgauucuccuccgucaaccucccgaguagcugagaucaggcacacgccaccaugcccugcuaauuuuuguauuuuuaguagaggcgggguuucaccacguuggccaggcuggucucaaacucuugaccucaggugauccaccugccucggccucccaaagugcugggauuacaagcaugaaccaccgcgcugggcuggguuuuguuuuuuguuuuuguuuuuuuuuuucauauuagaggaggcccagacaggugcgguggcucaugccugugaucccagcacuuuaggaggccgaggugggaggaucaccugaggucaggaguucgagaccagccuggccaacauggugaaaccccuucucuacaaaaauuaugaaaauuagcccggcgugguggcacuugccuauaaucccagcuacuugggaggcugagguaggagaaucacuugaccucaggaggcggagguugcaguaagccaagaucgcacuacugcacuccagccugggcggcagagugagacuuugucuuaaaaauaauaauaauaauaauuagaggagaccaucguaggaaacugaagacaaaauaauucaguauguccccaucagaacaggaacagggucuuguugguugcagagacuucagccucauuuugcaaaaccaggcuauauauaauuggaggggcacagaaugaggcagucagguaugcauuagcagugagguccuccccagcuugugaauaccuggguaggcuuaccuuaucucccaaccucccagugcucggcacugguuccuacugaacaaucgguagaagcaauuuugucagcuugucugccuagaaguagccacaugcuuguuugcugagaauaauuagggucccugcuuauuccaguacuuaugcuuuuccagcaggcacacagauugcucacagaucuuauggaaaggcugccaguguuacuuccucaguguuggggagguagagcccacuaagccugagcccccuguucccugucugcacacugucauacaaagucacagaauaaguuaaacacauacacacaugcacacaaacacacacagaaaacaugacucauaugugacaucccucaacacacuuuugaaggacuuugcccucugaaccuauaugguaaaauagaucuuuuuuauuuuccaggauaaauaaagaaugauuuugcucugaccuauucuucugcagcuugggaaguagaucauacaaaucuuugagaguucaacauccauuugcagaauggcuccauggaaauuggccauuuaaacuauucuucacguuaaagacauuaagcucuaacccaagaaaaccacccacagccaagaacaacaaaaaugacauaaaccacgucaccuaacccagcaguuagguauuucuugaauaucugauacuuaaaacuuaacuccccucuacaccuguguccucuccauacaguaggcuaacaucaggcagccaguggcaugggcgcccuggcuggcuucauggggcacacuaaccuugcacaucauuuucuuuaucuucuccucucuccuccuuguccacuuuucuucugucccaauucgcuuuuucuuuucuuacuucauuaacucuuuuuccuuuccuucuaauaccucaggaagcacgcuuaggcauuaccuuguccucagcugcaucuucauuuacccuucaggugaaaugugguugagcaaggaaggcaacucguucccuacaagucugagaauggguggagcaggcaagagaaacgguuaaauagaccccagagaagggcugcaguuaaugauaauaggauuucuaucuguccuuccacuguaccaagugacuuccacacaguggcauuuuccaagggugagugcagagggaguagcugcucagcuuggauggguaugggcaggagagguuacugaggcugcaggcuuagcaaggugaguaugcauggaucccacgaagucaaugcaaaagcaauuugaaaaucccugcuuuucaaauagguguaaggguuucuguccaugacaaggcuguucuacuucagucuuuuaaccauguauccacacagucccagagauggucacuagugucuuccucaccuuuaacuuccuccuuggaaauaauuuucacaugcuacguucuugaccuaccaggacaaauucuaugaauucuucacguauguguccugggaaggaauagccaaaagcuuugacaagaauaacuaagucugggcugggugugauggcucaugccuguaaucccaacacuuugggaggccaaggcagguggaucacgaggucaggaguucgagaccauccuggccaagauggugaaaccccaucucuacuaaaaaaaaaaaaaaaaaaaaaaauacaaaaauuagccuggcauggcagcggccaccuguaaucccagcuauucaggaggcugaggcaggauaauuggucgaacccaggaggcgaagguugcagugagccaagauuugcgccacugugcucuagccuggccaacagagcaaaacuccgucucaaaaaaaaaaaaaaaaaaaaaauuaagucugaaguacccaggacuuguugaaaugcugccugaucauuucucucagaaaacuaacagaaaaccacauuauuuugaauauuuggaaaugucaaugucacucagagugcacaacauucgggauuaacuuuuuuuuuuuuuuuuuuuggagacagaguuuugcucuuguugcccaggcuggaguguaauggcgugaucuuggcucacugcaaccucugccuccaggguucaagcgauucuccugcuucagccuccaaaguaguuggaauuacaggcguauaccaccaugccuggcuaauuuuguauuuuuaguagagacaagacuucuccauauuggucaggcuggucuugaacucccgaccucaggugauccgcccaccuccgccucccaaagugcugggauuacaggcgugagccacugcgcccgacccgggauuaacuuuacaaccaaacuugauccaacuucuaauucuguaagaauaccauuucuuuacaugacagauggaauaauuggccaauaggucuaaagucuguccuuuauugugcaauaagagccucgcaaagguggaaugcaaccugagaucuuaagguccuggucucugucuuucauuuuugggagcacagauguaacuggccuuucaucaaugguuuaguaguguucguuauuaaauucuauaacagaaccaccuccuaugaauugacugucacaugucuaaaugcccuguuuauagcauguuuuaccugagagagcaggauaauuacuucauuuaaauuaaaaacauauuuuuaugggaaugacccaugguagacacuggauacauguugaauuaacgugcucaagacauaaaggacggauacagauuucucaaugguaaaggcaauauguagacaucuuugcuuuacuuuuaagcaacauuccauagauauugucaauaaccugaaaauucccagaauaauguuuuaaaugacuucuuaauuagcguuccuuauuuucauacaggcacacucauauucauuugcuaaaaacaauuaucugcaugcacaaguucagggucccaaauaauucucccuggcagauuuuguguguguguguguguguguguguguguguaucuguguccauguguguaucgcaguguuuugagugcauauccuguuuucacacacauucucugaaauguuggcucauucuaagggcuguuguuucauuucgaucacuguauccuguggacucugaaacugcuacaaaugcuucuucaccacacaucuuaucagcacaguugugugccuuuuugaucuaaaguugugaugaauaagaggcuuuacuuguugccuaauuuuuaaaaaacuuaccaaauauuacauuuccccuuauaaaauaaugauauagauuaguguuugugcagaaguguuggcaacagaauucuucaaaaguuuuccguugagugaugaaaagcuguuauauuauuuugacuagcuaaucaaauguaauuggggagcuugaagugccuuagauuuuccuuguacaguuaucaaagcaggaaauguaacucgcagagcugaugaaagccaucucucaugguauucuuucaauuauagaucuuacagagcaaaugaaagaaaagcucuacugcuaaaaacucagaggcuugaaaugccccuuaauguuaacugcuguauuagcuaguuaacacauuauuauguacuuuaauugauucuuacuccagcuuuggagaaaaaaauuauggaucuguuuggcauguaaauuaagguggggggaagacaccugagugcaauaacagcacuauugcuauuaacacuuaguucaaguaacaucagauaccugcaguguaaacaauggcccugguucacuuuggcguguuuuuuuuuuuuugagauggagucucauucugucacccaggcuggagugcagugucgcgauuucggcucacugcaaccccugccucccagguucaagcaauucuccugccucagccuccuaaguagcugggauuacaggcgcaugccaccacacccagcuaauuuuuguuuuuuuuuaguggagacaguguuucaccauguuggucaggcuggucucgagcuccugaccucaugauccaccucccucggccucgcaaagugcugggauuacagaugugagccaccgcacccggccuaauuuuuguacuuuuaguagagacgggguuucaccauguuggucaggcuggucucgaacuccugaccucgugauccacccaccuuggccucccaaagugcuguaauuacaggugugagccaccccgcccggccuaaaagcauuacuauguugcacucaucuguugguauuccugcugaugaguguuauugaaggaguuuuauuugaccauugagaauugcuuuuaugaguuuaucaaugaaguguuauaaucuaguaaaaauaacuucauuucagucauauuuggaaggguccagcugagauuuuuagcuuuugaaaggaucaaaccacauuacaccugcauuuuacugggguguaguauuuuucuuuguuguugaaucacacucuuaaagcugccccuaaaacauuucagccauaaauggguaguccugaccuaggaucaggccaaauucaaauuuuauucacauauucauuuauucacucacacauucaucaaacauuuaucaaguuuguacugugugucaaucccuaugcuaaauugcuggagacaugacagaagcaagugcuguaaucccagcacuuugggaggcugaggcaggaggaucaccugaguucaggaguucaagaccagccuggccaacauggcaaaaccccgucucuacuaaaaauacaaaaaguagcuggguaugguggcuuaugccuguaaucccagcaacucaggagucugaggcaggagaauugcuugaaccugggagguggagguuacagugagccaagauugcaccaucgcgcuccagccugggcgacagagcgagacuccaucucaaaaaaaaaaaaaaaggacgagagccgucuucacuuuacaaguuaagucuucauggcaguuuucucaauuaaaguagaaccccuccugacauugaugcggcacuaaacacaauggcaaacucugacccugaaaucuugugcaaguacuugguuaugacagcacacuaauaaccccagcccuguuuacaccaauguuuaagauuauguuugaacuggaaaggacaacuuaauucccauagacaacaaggugagaguaagggaggguucagggcggcaucacuaggagagaacagcucguguaaaaauacagaggcuuuggcauagcacuucuuggaaacuucaaguaauuccuauggcuggaaggacaaggauagggaaggggcaagggguaaagcuggacaggugagcagcucauuuauacauacgguucuaauauggauuuuauucaaagcaaaggggagccacuggaaaaacuuaagcaucgggggccagaaggauugaaaauguaccagggacauaugcccaccacauaaugucaugauuucgguccugguauaggauuuuccuuaauugccagcauuuagcuuaaagugcauuuaaauauuguuuuguuuuuaauuuacuaucuaaacuuguacuaaaggaguugguaucuuuuauguccuuaguuauuuuuguuauugucuccaacagaccuuuuuccucuagguaaauuuugguuauugaugacauguauguauuugagguccugguccuuguuucauauuuaauuuaaagaaauguaauguuuuaaaaauuauuuauuuauuuauuuauuguagauauggggccuagcuauguugcccaggcuggucucaaacuccuaggcucaagcaauucuucugccucagccucccgaaguguugggguuacaggcuugauccaccaugcccagccuucagauuucuucaguauaacauucuuuuugaccagaaaguuuucuuuuucuuuuuuaguuuuaauuuuuuuauuguuuugagacagagucucacucugucacacaggcuggagugcaguggugugaucuuggcucacugcaaccucugccuggguucaagugauucucuagccucagcuuccugagaagcuggcacuacaggugugcaccaccacaugcaguuaacuuuuguauuuuuaggagagacaggguuucaccauguuagccaggcuggucucuaacuccugaccucaggugauccaccaccucggccucccaaaauguugggauuacaggcgugagccaccaugcccagccaaguuuuucuuuuuaaccuugaacugauuuauugcugauuauuucauaguuauuauuuuaaugacaccaaaucauccuuccaguauaugcacacaucgagggggcagucuagcccagugugccuaaagugauuccacacuagcuuuuuaaaauuacauauucccaaauucuaccccagaccugaugaauugcucauccauucauauauuuauuaauucaacauacauuaauuaaguauccaguaugugucaagcccuguucuagaagugggaagaaacaagugaggaggaagggagcaguuagagggguucagagaagaccaaugugaagagcugacauuucagcugaaauccaaauaacaagaaagaaaacagccuugauaaaucuggacacacagcacuacaggcacaggaauagcauaugcaaaaauccugagguagaagcuagcuuaauauuuucaagaaaauaaaggaaggucacuaccuaaaaaucaaugauugugggggaaauagggcucuugaaaaugucaaaaaguuugacaagguccagcuccuggagggcuuggauuuuauuguuuggaauaggaagccauaggaggauuuuaagcaauggagugauuucaucgaauucucaguagaaaaacuauugcacuggcugcagaugggaaaaaaguugaagggaagcaagagaguauacaggagguccaucaccccaggggagagauggagagaugguggcuuagaucagggcaggagaauggagaugggggagaaguugauggacccaggauacauguugagguaaagcugauagaauuugccaaaaagacuuugagagaagaugaggcaggcaggacucagguuuuuggcuuaagccuuugggagccauuuguggagaaggggaaccagaccaucuaggggaaaauccugcacauguucuaaaacuucccuaaacagauagagccaggugccagagccaguucucagaugucaccuuugggaacuauucauuuauucuaauccuuauuuuuauucaagaaggcacagcucgaccacuccacgcagauauaaauucaagcucuucccaaagauuucucagggguggggauccucuauacauucccugccaucuauuuaauuaauuaucuuuuuuuuuuuuuuuuugagagggagucucacucugucacccaggcuggggugcaauggcacgaucucggcucacagcaaccucugccuccuggggucaagugauccuccugccccagucuccugaguagcaggaauuacaggugcccaccaccaugcccagcuaauuuuuguauuuuuaguagagacaggguuucaccauguuggucagggugaucucgaacuucugaccuccagugaucugcccaccucggccucgggauuacaggcgugagcccccaugccuggccccugccaucuauuuuaaaguuuggcaguagucaagacauucuuuuauguacaacuuaaauccuuccuucugcaucacgugucauucccuguggaccugucaauagagauggaacacguggcuaccccuugcuucaucauaacccuuuacaugaugacuugcugaauugcagcuaugugaaaaccuaaaaaauuuagacauuagggaaucuaaauuuauuucaguaauuaagacagagggguauaacuaagacugaucaccuaucuaugcagccauaaaaaagaacgagaucaugucuuuugcaggaacauggguggggcuggaggccauuauccuuagcaaaggaacacaggaacagaaaaccaaauaccucauauucucacuuauaagugggagcucgcugagcgcgguggcucacgccuguaaucccagcacuuugggaggccaaggcggggagaucacuugagguugggaguucaagaccagccuaaccaacauggagaaaccccgucucuacuaaaaauacaaaauuagccuggcaggguggcgggugccuguaaucccagcuacucacgaggcugaggcaggacaguugcuugaaccugggagguggagguugcugugagcugugaucgugccauugcacuccagccugggcaacaagagugaaacucugucucaaagaagaagugggagcuaaaugaugagaacucacgaacacaagggaacaacagacacgagucugcuuggggcuggagggugggaggagggagacagcagaaaagauaacuacagggugcuggacuuaauaccugggugauaaaauaaucuguacaacagacccccaugacaagaguucaccuagguaacaaaccuucacauguacccccgaaccuaaaauaaauguuuaaaaacacacaaaaaagacuaagugccuaugcagacaccagugugcaaauucaguuggcuacguaugcagagaaauaauggcugagaacauuuagugcuuccucccuugaaguuccugauucugagguuggcucugagcucaggaaacuuugcacuccuuguauuuaaagugugaaauauuaccuuuaaagguauuuuucuccuucaguaugaaaccuauagaugaauuucauccgauguuugcaucagugucuuggcauagacccaauuuguuuuccuuuguuguccuuuuuaugaggguaaaguugcuaguuauuuuaaauauuuuuuguaagcuuuaucuucaauucuuuaaugaucuuuguugcuuuuuaaagaacucuuucaacuuucuuuucuauaguagcacaagaauccaagcuauagucuuuccaaggcuucucuccuccuggggcagagcagugucaggguuuggauuagaaaucaaauccagggauuuaucuacaaaauuacagaugagcauaaauaugucauacauaucagaaucaauaacccugcuaauagcaaugaguguuucaucuauuauaauucuucagucucccaauauuccaacaggacuuaguuucccacuacuucgaaacuuacuuaauuuacuucuagucauuuggaaaaaaaaauugauaauauuuugucugauaucuuugaaguugaaaaggcuucuugccaguuuacuuauuagcccaagucaguggucccuugcagcagagauuaaucccagcuuugcggacucuaaauuuuauacaauuuaggaagcgcucagugaaaaagaccacaaaaaucucuuucuuuugcacauuuuacaaaaacauuagaccuggagcauacacauugcuugagucccucaaaaagccaugggauuuucugugcaaguaaaggcugcugaagcugaagcucauuaguuucagguaaaucugcuuccgauuugcaguucugcuaagguauuucuuguguagaauaucauuugggcuaggaggagguagaaauaaagauagaaaucuacacagaugaugauauuuuaaaauuugguaaaauaggauuuaagucuauacuacccaaacugacugaaaauaaauauuaaccccagacaucuguagugaguuuuucuuucuaaaaauaauuucucauugacccagggacuaucaagaaagucaugccuggagacuaaagaaguaauuuuucucugagcuaaguucagcauuuauagccucauuagacacucugugguuauucagucuuaagcauuccaccuucuccuaagcucaccuagacuagcugauaccaggcauagucccauuaguucaauuucacucuccuuacccuaagaaauuuuuaauauguauaucaaacaaauuuaaauggaaaaugcuguaaguucucuuuuaguucugaugaagaauuuauaaacaauucauauucuuuuuuuuuuucuuuugagauggaguuuugcucuugucacccaggcuggagugcaauggcaugaucucagcucacugcaaccuccaccuccugaguucaagcaauucuccugccucagccuccugaguaacacggauuauaggcaugcaccaccaugcuuggcuaauuuuuguauuuuuaguagagacggaguuucaccauauuggucaggccagucucaaaccucaaaugauccacccaccucagccuuccaaagugcugggauuacaggcgugagccaccacacuuggccaaacaauucauauucuacaauagcaauauaguauugcauauagauacaaguuuuacuauuaucuaauuaggaaacugugggguuuccuaugguaagauuauaaaguaugucauaaagguuuuggagguccucauacugcagaaauuuaauuuuucuauucguaaaaggaaucacauuaaaaacuacuaaauuaucuuacauuuccuauuugauuuuauuuacccagucuugcccuucaugccaaaguaaaaagauuagaauucuuaagugacuaauuaagaggaacauuggaaaacauaaucucuaauuaugucucaauauuacacguguccaugaauaguuaucucuaagaugaacuccauuuggcuuuaaaauaggauguuagagauauuuuuaugaaaaguuugcucuccagagcuguaaguucaacauaaauuuggaaggcuaagggaaaguuuuuuuuuuuuaagucgucuuuauucacuucuaauuuugcccgaaaaauaaagugacauccuuaaguacuuuucauuugugagguaguuugacugauauaaauugugcaggguaguaguuuuguauacaguugguuuuagguaauuuuucccaggcaucuacuuuccuguucauaauaagcugucaguauauguuaguuaaaugaauggauggcagagccccuuugugcauuugcugugggcuucggcuuucucggucuuuugguuugaggaauaguuaaggcacacagagaagguagccuagcaaaucuuauaagccagucauauuugggagugucugaggauuuuuauuuuuaaaucaucuacaagucaagaauauauacuuuaaaugaaaugaucagccaggugcuguggaucacaccuguaaucccagcacuuugggaugccgaauuaggaggaucacuugagccuaagacaaggagucucagcauagugacccugucucuacaaaaaauuuaaaaauuagccagguauaguugcaugcaucugagguuuuaguuacuugggaggcugaggcaggaugaucgcuugagcugaggagguccaggcuacgguaagcugagauugcaccacugcacuccagccuaggugacagagugagacucugucucaaaaaaaaaaaaaaaucacucacuguuccugcauaauaacuuuuaaucaaaaaucuguuccaaccccccagccccaucccccccaccaaauauauacacaaaccugauuuagagcugguuuaaguggcuggcuuuugcucugugucaaugugccacgccuguguauguaccugagcaguuaggaugcauagcagaguuucaguuuauaugugcaggcucucagguaaaagggagaauucuggaagaaucugcagggaauacuagaaacguguuggcaauacuuuauaagagagaguaaaaaugaauuuaucuuuugaaaugggagcaaagcuaccuauuuuuccagauauauacguccuuuuacaagucguccuuuuuagagcaauugacuucuuugguuugaaauuauuuacccagauggcugccuaacgagaauuugagauuaggucaaaucauuuguaggacuauuuugauuaauguucuuugauuucuaaaucaaauguaccagaccaaacacuuucaaagagaggaauuaauauccacaaaauauuauuucauaugcuuuugcucuagguuuuuccacagcuuucagcccugucucauuucaccuuaggagguagagaaaaauaacuaacacaucaauaauuaguuuagaccugaaaacacucugcugcacagcuguaauguuucacaaugguuucugagcuaagagguguuuauguagcaucaacuuuaucgaaacaaaacccuagguaaaaacacauugaaauggcacuuaaaacaacaacagugcccaaaaucuguuguuucauuacacuugaguauaaggcaaaucuggaaguuaaauugucccauauugagaauaacugaauaaauguuuacauaauugcucccacuuuugcugaaucuuuugguuugaucagguuuagagcagagagguaaaaaauacauuuauuaaaagagagcuuuugagauugaaugcucuaauuaacugcuaauuacuucucuaacuaggcuauuuuagauuaaaaaccuaacugucucaauucuaguggauuuugagguugugaugaagagcagagccgauauucagugggaccacaggaucaagcacugccuguguuacucaguauuucucugcucagagacagaaccaauuauaauauuuagcagauuuuuuuuauuggaaagucuuaaaaauugaucaguuuuaaaauagaugcacacaaacuaccuugagcuuuacuuucugaugaaaacaaucuauacuauaugauaaagaacagauagauauggaaugcugguucaagcugacaaaauaugcacuuuuguugucuuagaucuagugaggaaauugauucauguuugguaugacuaucuucacaaggaauugcuuauaaagagguagggccuaacucauuuauauaaaucgagguaaaggaauaccaggaguaaaucuaggaaaauuaauuuuucuguuuuuaggugcuucuaauacugggaaacccuauugguuucaaagggaacuucuaggugagaccauuuuuagagaacuuguauuccagcaagcaauuuuuuauggagcagaggaagcauuuuuaauuauuauauauucuaaccauauuauauagcaaucagauaaauuuaaaguuauagucuguugauuaauaaauucaugguggguuggcuauaauagcaauuuugcuucaguaucuaagacaaaauuugaaugauuugagaaugcaugauuuaccucauaaugugacacccuuuuaaucaaaacacccgaaggccaaauaauuagaucuuguauaaaacuuggaaagaaaacaccguuguauaccccuacccaccauugaaaucuguuuuuaguuaauaaggaagugggaguaaaauauuugagugagccuauauauaggcucucauguauuaaaagaaaagcuauuuacaacugauuuguugcuaaauaaaaucuuggaugaacacuuuuaauuacuaaaaagguaagguuacaauaaacacaggaaauauaaaugaauaaagugugcacagagucaugcugcuuucaggacuauaaauagcaccuccaucucugcuacuauuauuagcaaguaugaacaaaagaagauguccagaaauagaaaggggaagagcaucuccaugagccuuguauuccauggcauaggaaauguuucuagcaagcccgugaauuuagaggguuaauugauuuuuagaaaggacauuuccaugcugucaauuugccaaggaaauucuuuuaccagcauguuuguaaaauuggcaggcugauguuuccucuaggugacacaagaugugaugaagaauuuuaucuuuacuuccuuacgaaaaucagcguugauugcuugccuuuuuguuaacuuauuugguuacuauuaguuugcaucuacagaggaucaguuaacauaguugaaacuggaagaacuagugcaucgugaacagcccugaaccaaaagucagguuucaguuucaccugagccacuaaugugcucuaugacuuuggucaaagcauuuacauacauauauauauauauauauauauauauuccccuuuauauauauauauauauauauauuccccuuuauauauauauauauauuccccuuuauauauauauauauauuccccuuuauauauauaugcgcacacauacugcugucccuugauaucugugggggauugguuucaggaccuuccacagauauuaacaucugagaauguucaagucucugguauaaaaauggcacaguauuuacauauaaccucccauguacuuuaaaucaucuuaaaauuauaauaccuaagagaguauaaguaguuguuacacuguauuguuuagggaauaaugacaaaaaagucuguacauguuuaguacagacacaauuuguuuuccccaaauacuuuugauccaugguugaauccacggauguagaagauacagaaucacagauacguaggccccacugaaacacacacacacacaccacacacacacacauaugcacacacaucuucucugagccacaguuucuugauuaauuaauauagcaaacauauauggagcgccucaauaugccaggcacauugcuaagcagcagggauacgaagucgguuaagauacccaguccuugcuuacuagccucgcacugcugggagacagacuuuugaaccuguaauuagaaugggcaauggguguauaacagagacgauagcuguuauaagaacacagggcagagcuuuucugucuguggagggggcaccagggaaaacuuugcagagauggugccauuugaaucaacucaaucuuaaagaauuccucuugaauuuuucuucaagacugauuuggaugaaaauggcuauacuugguccucgugaggaaucaaugacauaauaaaaguaugcuaaaaagcauaaaaaacaauauaaauagucuauuaguaaugaaaugauucaugggcaugaauauuacagaucuaguucuaauuuuugauugccuguuuauuaauguuuuuuucuuuuugauaaugaauuaugagugcaguuauuugagaacugauuguaagacuguaguuaaaagugggagaggccaggcacaguggcucacaccugaaauccuagcacuuugggaggcugaggugggaggauucaagaccaacauagcaagacccugucuuuaaucuaaaagaaaagaaaaaaaaaagaaaaaaaaacaagaaagagagaaagaaagaagaaaaagggccgggugcggugggucacgucuguaaucccagcacuuugggaggccgaggcgggcagaucacaaggucaggagaucgagaccauccuugcuaacacagugaaacuccgucucuacuaaaaauacaaaaaauuagccagguuugguggcgggugccuguagucccagcuacucgggaagcugaggcaggagaauggcgggaacccaggagguggagccugcagugagccgagaucacaccacugcacuccagucugggcgacagggcgagaguccaucucaaaaaaaaaaaaaaaaaaaacacgagagaaacacaaaucucaaacacuuuaauuuuuuuuuuuuaaaucacuauggacuggaauuaaaaaaaaaacuucuccaaauauggauauauuuucccauaaguagucaugauagacugaaugauuauuuuuuaaauaguuacauuuuuagggguuuacacgugaaauuaugaagauauggaauuuaguaauaauucuuuuuaaaaacauguauuacuuauuuauaaacuauauguguauucuggugaaagauuguccucuaggaaaaauaagucuuagaauuauuucucuccaguaggaauuuauuauuguccuaucuucagccagacagcucugugguaauuucauuuggugaucucuuuaauaaauauuuuuuggagugccuauuuugugugaugccaaaugaaguaaacaguguuuuauguaauauguuccaauauauauuuuuuagaaugaaccauuuaccaaguauacauaagucagacauugacugcauaucccacugaacauuuccauuaauauaaguggaaaaaggaaagccgcuuugcaaaaaaaggaggcuuuuuugcuucagcaauaugcaaauuaauuugaagcaugccaguaguuuuaauauagguugauucagaauuaccauugugaauaacauucacuucuauuacugcuuuuguuaaaacuaagcgccaaaaaaggaagccucuuugcuucagcaauaugcaaauuaauuuggagcaugcaaauaguugcagcaugcaaguaguuuagaauuagacuuucauuaaaacuaagugccacacagagaagagguguaaaacagaguaguaaucuguugcgugcacuugaaggguucuugaaagacgugcauaaaccguuaccguuguagcacaaguugagcagcaaaagccaaagucgcacaucugugucuugucgccaccucuccacuuauccacucaugcuggcuuuucucccagcagcucuuugcccuccuccuuuuaacacugugggcugaggugaggauguucuagucaagagucuuuacgagccuuauaucgccaggcuuucagaaaaugugaagcaugguagugugaauuuagaaaaaauaaaaguguguauaaaagcucuucuguuuucuuuucuuuuuuuuuuguuaagaaacaauaguguuuauuuaucauguuuugcuuagaauuccuuugguauucuguucucuugauuuuaacaagaagcuaaacucaauaacaucuuuuaaaaacaaaacaauuuucgguugagggugggugaggaaguuauaugaagauugagugggaaccucaacccaaggacauaauagacaagaaacaguuuuuuuccuccccuuucuucagaaguagucuuccgcaugguuuaaugugcuaacauaaccccgguuccaauauuucaaaagauacagaacuucccagcaugaugauaaaguuuuccuguguuccaauaauaaaaccucaacguaccagugauuuccaguuccuuuguggcucagcaacuugugaagaccaacuaaguccuaaguacccagccugcaguaucagugugggagucggaaacagauguucacgggacaaugccauuuguugucacugucgauacuauguggcaacuuucccaaaugaaauuguuuguggauggaaaagaauguaagcagugauucaugcccaggaauuuuuuuuuuuuuuugucugcaggcuaaccguaucuuauuuguuuuaaaucgcagagcauuaguggauuaaaaauuuuagguuaacuuacuauuauaguaucuuuuucauuuuuuguccuguacuucuaaaaggagugacuaauuuagguagcuuacugagaauaguaaauaccuuacuugauuugagaauucaaaagcagcugacaucuuuucagauuuaguguuuuaacuauugaguagguacagaguugccauuuaaaugaacagcaugacuugcuuagcauuuuuguuaauaauuuggagguuuggagaauucaaaauaaacauuaaguagaaacauauuuuuugguaauagguggcauugcaugaucuugguuugagauuuucauaaauauuacaaaggaacuuccacuaacucacucacuguuagagauaauagauuaauuuguauaaauuaaauauuaauuauagagaaguuuaaaauguacuuaaaaugaauuugauacaacaaagcuacuuaaaaguuagguagaccaugucaugugacauguauacaaacuauccuuuuucaagaaaaaaccuaacaagcguuuaaggcauaauaucuacuacuuuagugccguuuuuauaaaacauaaauuuuaaucuacaaaugaaagucuuuuaaacauuuauucauaccaacagaugccuaaggccagaauuauaaaauguuuuauguuguuuuaaaaacauauguauuucucauaauuagguuucggcaucacagaaaaauuauuuuaagggucauacaacaaaaucugacuuuuaaacaacagccaaaggaaagauugguaucacauguagaggaagagguccuuaauuaagaagcaaauuccggaguuucaguaacucauuuucacuagcuaauguuuaauaaauuguauuagguuagugcaaaauuaauugcgguuuuugccauuaaaaccacaauuagguugggcuggguggcucaagccuguaaucccagcacauugggaggccaaggcagguggaucaccuaaggucaggaguucaagaccagccuggccaacauagugaaaccucgucucugcuaaaaauacaaaaauuagccaggcaugguggugggugccuguaaucccagcuacucgggaggcugaggcaggagaaucgcuugaaccugggaggcggagguugcagugagccaagauagugcuacugcacuccagccugggugacagagcaagacuuggucucaaacagaaacaaaaacaaacaaacuggcaauuaauuuugcaucaacuuaguaguugugugguuccgucuuccucggacuucuuuuucucauuugcaagaugguacgucagucuggaugaccuuuagggcucucgcaguuuuugauucuaguuuagggcuuugacuucuguucucuagcagucacuguuaacauuauuugaguaucugaugauagcuuguacuaauuuucccagaaaaaugcauaaaacagaaauuuugcaugcaaucccagggcuucauggacucauugaagccuagugauagucccagguaaagaagcuaguuaaagaaaguuaguauccucacguuucugugaagauucaagcaagcauuucaaauugcuccaaacgugggcaucagaacuuucugauuauuaaacaaaguugauuguuuuuauuuucuaacauaucuacguuagaaauuuggcauugauaccagcacacuuggagaaggcaaaaacacaugaguugguccacuaaagacuucaauagcacuuggaaagagauacucguguguguuauguauggcaugucaagggaaguuaccuacaucccagcuaccuugcuuuagaacaggaaaggaaugaacuaaggugcacuugccugucucaaccagugaaucaagacugauuguuuguaguuauuuuaauuuaugaaaaauucaaaauuuaaugcuacagaaaagacaaugggccuagggaggacuauguuaaagucuuguucauuuucuagacccaacagagaauacuugaaugcacagaacaacugaggaaaaucauacuuuaaguaacaaauacaaacuagaaauuaauucuuucauaauuaagacuauuucaacuauuaauuuucuuccaauauaccccucuacuuuuuuuagccauuuaugggucauucuacauuuucuuaaguucuaauaugaucuggagaaugucuuggacuucuuuaaaguaacuucaugcaugugcucucauuagauccuuuauuuacuaccuuacuuuaauguuauacauaauacauaauaaacaugugaaauucauuuuaaugaauaguguaagccucaaaaaauuuacuuaaccacuucuuugaccuagcaaauuuauaagcgauaguaaaacuuuccuuuuaccuuuacaauaauagcuuuuaaguacucaggcugacaaauucuucauggacucacuuuuauguuuuucaauuucuauuaauuucucuguauuaaaguugaauuagauggauuuauguugccuauuccuggcauucauagcaacuauaaggcaugaucaagaaaacagaaauucuaauccucauguuacagaaauggccccaauucuacuugacagaaaugauuucaauuagggagucucugggcuaccuuuucuguuucaccagaacaaauguuauugauauaaggggaaauccuuggauaccauauaaccugcucacucuauggagcagaguuacuuagagugcuccgaaucccaucuuugaucucuggcgauauuuuucucuguuaugucacugaggucaccuggcucaugugugacaaacugccugcauaagucacagugccaguggcagagauuuguaaccaugccccugguccauugccuuugaauuauuucacaggcccgcugcuuuacauuuacacucugucggaagaugaacaggggaagggaguaaaaucaagggcagggucucauccugaaggacaaggggaaacagguggaagguuaauggcccuggagcgauuccacaagccucucaggcuugauauaugggccuggggccuaaaacgggcauuggcuuucaaagauauauuauuucauuugaggagagacauucuggaguuccugcauuugucugcugauagaugauccucuguccacaauugguuauggcgugugaguuuuccuugggccugcucccauacauaaaaauuuugcugagcucuccaaccuuuugcaugccuuuaggaaugggaccggugcaagcccacuggcaggcuguuggauuuuuuugcugcuauuuuaguaguuccuuuugaaccgugaggcaaguggggaaugaaagacacuucuguucauucauacaugacuugauaaggguggccuuguuauaaaaaaaaaaaauggugaaagggauguuaggaaucaaacauaugugucauuuugggaagacaggcucaguccaaaauuuagucauuuggguuucaaaaaguugcuuacauaaaagcuagauacuaucaaauagcuuuugacuuuauuacuguuuugcacuccccaggcuuuuagcaaauggcuuacucuauuuuucuuuauuauuuccaaaaaguuugaggugauuuggagaaagaaggagaacagacaguuggaaaaaggugcuuuacacagagauccaugauuaauuugccuaacaagaaccaucaggcaaugcuaccaagaaauaugucuaauggcucaaauguuacaaucaaauagaacuggucacuagauuaauggaaccagucacccgaauuaaccuuguguggccucucaaaguuguacuauagagucuaagacugcaaaaaucauuugccucagccucuuaauguucauagacuuaauauucaugaaaauauuuggauucuaauaugcuuugauuuauaguauuuugaaauuuaauuauuaacucugguuugagauauauauauauaaaaucuuugauuuuauaguuccugguaauugugauacuagcuuugucagagagagaaugcuuauuuuauggcaagcauuaaggaaaaaugagcucuguaaacucacuaucuaaacaaaaggcgauuuuucuuuccagcucuuuuguguuccauuacccuuguguuuggugaauucucacaccacuguaugaaauaucaaaauccuauuuguggacauuuuaucucgaauagcuuugucaaaaacaaauucuucaccuggagaaacuuuccauuaucaucacagauacacuggcauuuaacuacaagaaguuaauauuggacaaaugaucagauaauaucugaguaucaauaggaauuucauucuuggaugagaggcaacaaauugcaaauacuuuucacauauauuuacaagggauccuuaucacaaucccuauucauauugcccucaguagaaacaugcagcaucuggccauuggccccuguuaauaaugauuacacagauguccuuuucuuuuccucuggaauauugcaaaguagagguuagaccagaagcaagaagacuggagaggcauguuuaguaccugcaagaagauauuuaauaacuuucuuagaggaaagauucagaaucaccaguuacauugaguugaaugaggagcauuagccgucaaaagaaucuguuuuuccacuuguugcuuggauaaauggauaaaagccugccaaggacuucaguccaccagcugaggguaccauagcuaaaauacucccaacagaagggcaggucccaaaccacacaggcaugcuuuucaaucacagaauaaaauguaguuguuuucgucauuucagcuugugaccuaaaugccucauuuucauguuugaaaaguuaccaacuuuauuucaguccuauuucccuuccucugugguauuucccagucaguagaccacaguccuguggguuauaucaaugccuaaagcagagaucaaaucaaagcauaccacauaacugguuaaaaugaaagcucauuccgaauuaguaaauaaugcccgccugucuuccacaucugucaaagucucccagcucagauggacaccuccauaagcugauccauaggaagccaaauacuugcaaacagccucuuaauugcucauuugcaguuggacaaaaugcuaaaugcagaaagacuucaaaggcaauggaaucugcauugaaaacaggaucucaauacacauagucgcuuauuguugcaaaauuagaauaacaaauguucccagcaugaagccaacauaaacuugccugaguauuauucaaccugaaacauagucuaccuuuuuuuuuuuuuuaacagcaauagaagaggcauacuuagcacucuguuuguuauucuauacuguucauuuuaaugauauauuuaggucucccugacacuuuguauuuuuacguguaauuacccauauuaaaaaaaaaacaccacucauuaguguucuguucuacugacuuaauuaugccccuuaauuaaaucucagcuaacagggggucaccgcagugucagugggauuugucacuguuugucagcaggugucugguugcaucuauuucugguuuucguaugguuugaaucuauuuaagaacuugcuacaaccccguccuccccuccacaccaaccccaaaugccagagacagcauucucauuggagggaagaagcaguaucuauuugacaggcaacugcuucccaaaagcuuguuuguaagaggaaauuuuuguuuucauuacucuagaaaaaaucuccugauuaggggaaagaugcuuaaaacagacuuggauaaaacagaugcacuauuuaaaagaugaauagguuuacauucuaaaaauuaugaucauauuuuuguauacaauucuaaaaguuccuugaagaacaaaaaauauauuuuguugcugcuguuaugagaagaacaucacauuagguguuuugcaucaucuggccauuggugucuuuguacagaguacuuuguaucaauuauuugguucacguuuuucauuuuaagaauauaaaacaaauuacaaacauaugagucaaaccgaaaaaaaugucuuuugugugacuaauguagggucaauaggaauuuaauucuugaaugagaggcaacaaauuacaaauacuuauuauuuggaaugagucuuaguauuaagacuuauaugucuucacauuucacauuagaauguuuuaaacucaugauuuuaguauauuaauuaagggagauauaauucccauguuucuguauauaauaggcaucuaauguugaucugaauaauugauuaguccagucaggcuuuuauaauuaguugucagcuuuucaguguaaagcccucaaaacaccugcugugcaucuacaaaggucuuacauauuuauuaguguuuuuaaccuaaaaaggcaugcaaccuaccugaaaagcauuuaauuuuuuuucuggaacuaagaugacccuuccaacauauacccuaagaaacuaaggcuauaugucucugaguuuuucagucuagaagauuuuggacugaaauucugauuuuuaaaaaucauaacacuuaucuuuauuuaaagauaaaaaugucacaguuuuucuauggaaguuuuucagaacucauauuucuaauaguaagguuaagcaagacaauggguuacagauaucaaacuaucaacaauguaaaguaguuuugagacuucacugucauuauuguauaagcaauuuuauuuuucuggguuuaccuacaaaugugguagucacagaagaagaaaaauaauuuaaagaaaaauuuauaauacucagcuuauuuauuucugaaauucaaaucaauucauuucauccuaaaaaguuaacuccaacuggcuuuucuuaaguaacaaaugucaucauuugcuguccaaguaauuuucaauacaaugcucauuugauguugccucuaaaguucuuaucacacaaguaauaaguaauccauacauuacauauauguguacauuuuaaaaaccauuucaaauggugagauaagaauuuuuaugcauuuuauggauuccuguacagccuccucauugucauuagauaaugaaaggcuucgccauguguguaucguaaagaccuacuaagcaauaugaacucuccagauugcuuuacauuuacacaguugaaguauauauauauacaguauuguacaguauuguacagcaauauuguauagcaauguacaguauugcugggcacaguggcucaugccuguaacuccaacacuuugggaggcugaggcagguggaucaccugaggccgggaguucaagaccagcaugacaaacauggagaaaccccgucucuacuaaaauacaacauuagccgggcaugguggcucaugccuguaaucccagcuacuugggaggcugaggcaggagaaucgcuugaaccugggagguggagguugcagugagcugagauuacaccauugcauuccagccugggcaacaagagcgaaacuccaucucaaaauaauaauaauaauaauaauaauaauaauaauaauaauaaaguacaguuuaaauaccauaggguaggucagauauucuuaagauuccuucuuucauucaguaaauacuuaucaaguauuagucguaugccagguaacauuauaggacuuagagauucaacaugaagagcauagacaaaaaucccugcuuuugaggaucauauuuauaucuauuuuagugacuaagagcauuuauuuaagacaauugcacucauguaauuaaaaagcacuuauaaucuggcaagcuagccuaaucuuagcaauggaauguuucugcucucuuucuguuuaagccuucaggagaucauaccaguuuucccaacuggcauauggugaguucaaguacauuucccacauaugcucagggauuaucuuaauuguauuccuuucugaagcuuggaaucaagggaaaaaaagaacaauaaugauuuagggaaaaauaauaguuuuuuaaagguagauuuauaguuaguaacuuuauauaggugaacugaucacagagaaggguguaaaucaucugaauaaacaauggauuuucacacuuacuagaaucucuaagaauaauauuuuccauauuacagcuaaaugagacccauuauguaugcuuucagauaaacucacaaagcucuuacccauguaaaucucauagaucugccauuauucguaaugaauaacaaguuuuaucaugcauuuucauuaaaaaugcauuaaucccuuuguaguaaccucucccuaauucauugauucgauaauacaagaacaguaaacauuucuggcauaacaaaaaugugguaucaaagcauacuguauccauaaauacaaaauguaacaggaaaacaaauacauuuaucaaaggaggaucagguuuuccagccacuaaauaaugcuauggucgaauacugcuacagucuaauacauuaagaacucaaucauagugccgcauugugagccguuuguaccggaucugauucuuccagauuaaaugacuuguugaaacuugaagaugaaagacaggcagaaguauccggggcucuacccucaggaggcuccaggguggguuacugccagugggggacuaaugcuuccgucuaguggagauaggaggaggaggaucagaagugacauguauguacccuuuuuuacuuguagauuauuuacuuagcucguuuuaggcucuguguccucaucuguaaaacauggcauuaccucuuucagguauuuuacuggggauuaaaugacuuaacacaaauuaaguccuugguagauaguauauauucaagaaaagucaauuuccuccuuccuuuauugaugcuuaaaagccccuggugcuguauuugauugauucaacaaauacuugggcuuggcacaaggcacuggcuauacaguuacuucccucuuaucaucaccauagaagccuccugauguggaaauuaggcaggccuuggagucacacuuggcuucaaauccccuuccauuugcuucccauaagcucagcauguaacuucacuguccuucucuaaaaauagggguaauguauaacuuacgugguuaucuaaaaaauuaaauauuuguagagugcagugugcuagaauaucuggauacagagagauggauuagagauggugucuagagcacaacagaaugaagaccuaucucaaaaaaaaaaaaaaagaaaagaaagaaagaaauggucucuacccuuaaagagggggauacacauguacaaaacugugaaucccaaugcgauuuuuguggggaauguguucgaaugcuguuccugaacauauaucucagcauuuccaaaacaaaaauuacauuucagaaacucaguagauaagaaacaucugcaaaagaccgacacaauuuaucuucaaacuaacaaauguguugaucuaugugcauuugauaucucuauacuuauauaggaugcuaggagacaauuguuuuaagucuguguggugcucauuuucuuugcgccuaauguaagagcuguuugguccauagucaccucuguccauucuagaauagaggguggugagauggggggugguguuuuuacucgugagucguuuggagauuaucaggcuaacuacgugauaaaagaugcugaaacacugguuugaguuaggguggagaaaaugugaccaacucccagaguccaguaugauucacuuacuguuguuaagacuuucugccuuccuuuaauuacuaugucaaacaagccuuauuuaugccaaacaauuaagucuauuauuaauggagagguaagaggguggggagagaaugaguuccggaaacuuuuuuuuuuuauuuugagagggaguuuugcucuuguugcccaggcuggagugcaguggcacaaucucagcucaccgcaaccucugccuccuggguucaagcuauucuccugccucagcuucccgaguagcugggauuacaggcaugcgccaccauacccagcuaauuuuguauuuuuauuagagacgggguuucuccauguuggucaggcuggucuugaacugccaaccucaggugauccucccaccucagcacuccaaagugcugggauugcaggcaugagccauugcgccggccugacuucuggaaacuuuuuuagaaauaaaagacucagcuaauagacuacgauauguugagugcagugauagaaguucccuaaggagaguaaaaucucaacaaaugugaguccucuuuuucucugcaauccugaccugugcuaaaauuggggacaaggccgggcaagguggcucacgccucuaauuccagcacuuugggcggccaaggcggcuagaucaacugagguacggaguucaagacuagccugaccuacauggugaaaccccuucucuacuaaaaauacaaaaauuagcugggaauggugacacaugccuguaaucccagcuacucaggaggcugaggcaggaaaaucacuugaaccugggagguggagguugccaugagccgagauggugccacugcacuccagccugggauauagaaugagacuccucaaaaauaaaaauaaaaaauuggggacaauaucggguagacaaauuuuaguuucuaaaguagcugaagggucuuuguucaggugguuucugccuuucagcuuugaccuuuaucugccuuguugcagcccaugcauacucuuccucuuccaauauucauacauccacaaaugucccucucccuucaacacauacacccuucuucaccaacacacacacacacacacacacacacccuuccucuuaaagcuuauucucaagaaagguuuaaguuuguccuuucaguucaauagccaucuuuccucauggaguuugucaggucccuucuuuuguaauucuccuacuuguacucuccauccacuuuauuucccuuuuuuuuugagacggagucucacucugucucccaugcuggaguacgguggugugaucuuggcucacugcaaccuccgccuccuggguucaggccauucuccugccucagccuccuaaguagcugggacuacaggcacgcaccaccacaccuggcuaauuuuuuuguauuuucaguagagacagaguuucaccguguuagcuaggauggucgcgaucucuugaccucgugaucugccugccucggccucucaaagugcugggauuacaggagugagccaccgcgcccggcuuuauuucccuuuuaucuguucuuucaucccuuagucacauuuuauuuuuuuuauuuuuauuuuuauauauuuuuugagauagagucuugcucugucucccaggcuggagugcaauggugugaucucggaucacugcaaccuccgccuccuggguucaagcaauucucccaccucagccuccugaguagcugggacuacaggcacccaccaucaugcucagcuaauuuuuauauuuuugaagagauggaguuucaccauguuggccaggccagucuugaacuccugaucguaggugaucugcccaccugggccucacaaaaugcugggauuacacguaugaaccaccaugcccggccccuugcuaacauuuuaauuuuguuuguuuauuguaauuagagauggagucucacguguggcccaggcuggucuugaacuccuagccucaagcaguccucccacauugguuucccaaaguguuggcauuagaggcgugagccauggugcccagccccuuguuuuuuuuuguuguuguuguuuuuguuuuuguuuuuuuauugaaacaauaaaaaacuccucuccaucucaucccacuugcucuuguugcccaggcuggagugcagucgcgcgauccuggcucacugcaaccuccaccucccggguucaagugauucuccugccuccgccuccugaguagcugggauuacaggcaugugccaccacgcccaguuaauuuuguauuuuuaguagugacaggguuucuccauguugcucaggcuggucuugaacucccgaccucaggugaucugcccacgucggccucccaaagugcugggauuacaggcgugagccaccaugccugaccgcccagccccuuguuauuuaaaucuuuccucuuccacuggcucucaucaguccacaugaaugugcaaagcuccccuccugaaaauagaacaccacauuacaugggucucccugucugucaccguccuaccuuuucucaucaugacaccuuugcccuuuucuccaccucuucuuuuugguguuaacacagccaauacuguaggacugcagugcuaaagccgggcagcaagcucacugcauuugcacuucuccaugggaaaugccucuugugaaucuuaaacaucaucaaggagcuuagccacaucuucucagcccucauccucucuccccauuuuaauccuuggccauccuugaaauuccuucuggcccagacuucuuggucacuacucaguacuccucucugagugcaccuugcuagguuucuucacuagcuccucucccucuacccaaucuuaaacaauauuuuuuucuaguuuucucuuauugguuuccuuacuuucucauccacacauucuuagugauuucucccacaaacacaauuaugccauacuuucucucgcaaacuccacagcagcaucgugaauugcuugcugaaacauaaaugaucaucaccuccaauaagccucauuuaguucugcaacuuuggguuuuguuuuguuuuguuuguuuuguuuuuugagacagagucuugcacugucacccaggcuggagugcaguggcaccaucucggcucacugcaaccuccaccuccugaguucaagagauucucauguuacagccucccgaguagagacuggguuucgccacuuugggcagacuggucucgaacuccuguccucaagugauccgccucagccucccaaaaugcugggauuacaagcaugagccaccacaccuggccugcaacuuuguacaacuuucuuucuuucuuuugagaaggaaucacacucugucgcccaggauggagugcaguggcaccaccucggcucacugcagccugcgcccccagguucaagcuacucuugugccucagccuccugaguagcugagacuauaggcgugugccaccaagcccagcuacuucuuguauuuuuaguagagaugggguuuugccauguugcccaggcuggucuugaacuccugggcucaagggauccauccuccucagccucccaaagugcugggauuacaggcgugagccacugcaccuggcccuguuucuuucuugcacugucaaacaacacauucucugcaguuauuauccuggguugucugguuugaucauaucacucacaacuuucuauugcauaugcagaaaaaauuagaauuccucaaccagguaucucaucaucacugucuuccucuccaucucgucucaccugccaaacucaaagccauugauuugacuagucuaaauguaggccuggacguauuugacauggggacuauuugaaauggggacuauuugaaauggggacuaucuggcaaaaucugggaugggauguaagaugaucgcaauugcacacucacuccuagccugguuucuguuaguuauaugucuacccccucaacucuuuccaaccucuuucuugucacuguuuccucucacaaacucuagcacagaguuuugaauuugguaguuacaccacaaaauuuuuaacuugucagaaauucauuuaugauuauaugcaaaugacuuguguugauuuaaagcaguaguucccacaccuuuuggucucaggacgcuuugcacuucugaaaaugaggacuauggagaccuuuaguuuauauaauguauugggaguuaaaaacagagauaugguuacaaaucaagcauccacaaauacacauuccauuugucaccagagugaugaugucauuacauccuguagccucugcacacuccugacaaguggagggugaaaagggcaaauaacaucuugguguaauuggaaaaauaguuguaaccucuugacucccuggaccauacucguaaagccacugauuuaaauauuaucacuccuaugggugucuacucuuucauugggauuaaagauugaugccaaaugaauacauuuuccaaccuugaauuuucaaaucaguaaguaagaucagggacauccaggggaacaaaaacccuucucaguguccugggauuucucucccaguggcugugagacuguacuccuggagguagggggcaucagugagaccagggccaguuugaggacagcacagaugucucuagguaacugacaaacagacacagguuucccugagugucagccucugcccccucccuaacacacacucacauucacguacacaauaaaucacccuggagugcgauggaaauuccaagaacuucagcauugucuuaaccuguguucuggugccauccugagccuugaccacauugacuggcuuuuaaaguaggugccauugcauucauucuucugagaucaauaucccucugggucuccccagcagcuauggucuuucugcuuggccccaagacaauuaagagaauuaauggggagaccauguccaaauaaaagacuggaguuauugcuuuaacgugcagcaacuccaguauuugcauuaaauuauuauuugcuuuguaauauuugaucaagcuaggguuagggacuagacugacuuuuauagaagagugaugcacucuaacagugacuacuauuuauugagcucaagccuuaaguucuauucauuuauuagcucacuaaacccuuacaacaaggggaguggggagggucaauauuaauuagaauuugacugcagccagaauaaacuaaagcucaggggguuuaguuauuugcccgaguucacacugaucugcuggccacugguggagccuguuucuguaccagaccugucugauuuugcaccuccuuacccuuugcucucuuucuuuuuuuuuuuuuuuuuugagacagagucuugcucugucacccaggugggagugcaguggcgugaucucggcucacugcaaccucuaccucccagguucaagcgauucuccugccucagccuccugaguagcugggacuacagguguacacuaccaugcccagcuaauuuuuguauuuuuaauagagaucggguuucaccauguuggugaggauggucuugaucuccugaccucgugauccacucgccucagccucccgaagugcugggauuacaggcgugagccacugcaccuggcccccuuugccaucuuaguuauuguucucaucccauauuccugugucuaacauuuuggugugugaguguguguggaggacugaugugcacauguggaguggggagcauugguuugcuagaauuuucuagagcuuuuuauucaaagugcgguacaugaaccaccagcauugguuucauuagucagcuuguuagacauguagaaucacagucccccgaacugcuggaucacuguguauuuuaacaggacccccaggugaacucuaaguguguucaaguuugagaaacauggaucuugagcacaguuguaucucucugaacuuuuuugagagaauuaagugaagccauuaguaggguuuccugcauagacacauauucaacaccuuuaguaaaaaacaaaaagcccgcuucuuaaaagaauaugcuuuacuuugaaaguuugcauuuaugcuaucuugucuauuuaaugcuauauaauuucagacauaauauaguaacucuacaagaccuccuucccuguauaaaaagacgcacuauaaguuuuuguagucaucuuugaggucugucuguagugugcuuuauuaaaagcgagcaaauacugaaggaucccauuuaaguauguggucugcgguggagucuaauuuguaccacuaggcaaaggucacacagaggagcucguuaaugcacuuacuccgggaugaaaucaaucuccauacuucaccauauugaucugauagcucauuggcgcuucccuccgugaacugguuagcucacgugugaauggagagagauagauagcuuucugggccugagaauucuagcuggggugccauccagggcaaaagguggauguuuuuacauccucauuuggguggcccuuuugguuucugguguuaggcucuugugcugguauaucaguuagucagaaaaaaaaaagguuuuaaaauaaauaaguugcuuuucuaccauggguuuauucuuuuucuucuguaguuuuuaugaaucaugugugcucaaaaguauggaucacauuuaucugaauacaggcagaugacuugcuuuaaaguguaacauugauauuacuaaaagacaggucuuuuuuuuuuuuuuuuuuuuuuuuuuuugagauggagucucacucucucgcccaggcuggagugcaguggcacaaucuuggcucacugcaaccuccgccucccagguucaagcgauucuccugccucagccuccugaguagcugggauuacaggcacaugccaccacacccagcuaauuuuuguauuuuguauuuuuaguacaauuagacuuguaguuuuagggauuucaccauguuggucaggcuggucuugaacaccugaccuugugauccacccaucucagccucccaaagugcugggauuacaggcaugagccaccacacccggccaacauaggucauuucuuaaugaaaagauaaccugcucagugcaaucuucaggacucaggagucuccccuauguuccuuuuugucaaaacucaaugcuauugauguauauauguggucauuuaauugcagaaacaccaaggaaguagggcuuggugaauccggcucauaaaacacacacauggguacuaauuccuugaagaaaugggccaaaauaauucuagaaaugagguagaaacaagccaacaagccaaauauuuccaauuuuuaaaagauguauagauuccagaugcaaacuggauaaaagcagacucagaucccuucuaacuuugagacacgguuuuccagagaaacuaugaauauugagaaaacagcagccuccaaagccgccaagacuugauauuuucauuacgcuugguuacaagcucguugaaaaguguuuccgguucauccuugaaucucuuccaaucuaagcacaaugcugugcacaugagcagguggcuuuguagucuauagacuccuccuagacuuccuuuuccuagauuuuaagucaaauuuugccucgaggaagaguuugaagcucgagucugaggcaaguaucuagcccaaacuuucgcaaaauugaauuaaccucauucuuuggauggguauuucuaaauuuuuaaaaauuucuuggccgggcacaguggcccacgccuguaaucccagcacuuugggaggcugaggcgggcggaucacgagguuaggaguucaagaccagccuggccaauauggugaaacuccgucucuacuaaaaauacaaaaauaaaaauacaaaaauuugcugguugugguggcacaugccuguagucccagcuacucaggaggccgaggcaggagaaucacuugaacccgggaggcggagguugcagugaaccaagaucacgccacugcacuccagccugggcaacagagugagacgcugucucaaaaaaaaaauugguuuuuuuuuuucuuuuuuuggagacagaguguugaucuguugcccaggcuggagugcagugacgccaucucuguucacugcaaccuuuaagcaagggguuuaagugagucucgugucucagccuccagaauagcugggguuacaggcgcgggcuaccacaccugccugauuuuuguguuuuuaguagagauggaguuucaccauguugcccaggcuggucuugaacugcuggacucaagcaguccauuuuuugcaaccuccgaaaguacuaggauuacagaugugagccaccacgcccagccuggauggguauuucuaaaauacacaucuauuaaaugccacuuuuuuuuuuuuuuuuuuuuuuuuuugagaaggagucucgcucugucgcccaggcuggagugcagugguucgaucucggcucacugcaagcucugccuccuggguucaugccauucuccugccucagccucccgaguagcugggacuacaggcaccugccaccacgccugacuuauuuuuuguauuuuuaguagagacgggguuucgcugugcuagccaggauggugucgaucuccugaccuugugaucugcccgccucggccucccaaagugcugggauuacaggcgugagccaccgcgccuggccaaaugccacuuugaaugucaaaauaugacuguucuucagaugaaaaaauagccuuuuuagacaccaggcaccaaaauaacuuucagaaaaaguaguguucuucuagaguucucauagauagaaaagaacauaaaggaauauguuaaacauaacaagaagacuggacauauuuguaagauuccaaaucuuaggauauaauucuguccccagccuuugugaagacagauggucacaaugaggaagaggguauaguuuacccuucaaucaggcuccaucugaccuccuuuuuaauaaaaagaaaaaaaaaaaaaagaucucacuguuucccgggcuggagugcagugguauacucauagcucacugcauccucaaacuccuauccucaagcaacccucccacaucagccuccugaguagcugggacuauaggcaugugccaucaugccuggcugagcucuuuuugaguaauugaaauagcaaugagaugcccagaguccucaguuugaacugcuguguucagccuagugagaaaugcauaggcacuucagauaaaguggcaugagacuucagggaacaaauauagaacaaugcugcacaaauucaccugaccuugagcaccuggcuggauguccauuggugaauguuguuagauacugucuccuacgaauggguuaugauuacuacuugguaucuucuaaguaaaaguccuuaaccaucaccaaguaauauauuuuuuuuuugagauggagucucacacucucgcccaggcuggagugcaguggugccaucucagcucacuccaagcuccaccuccuggguucacgccauccuccugccucagccucccgaguagcugggacuacaggcacccgccaccaugcccagcuaauuuuuuguauuuuuaguagagacaggguuuuaccacguuagccaggauggugucgaucuccugaccuugugaucugcccgccuuggccucccaaagugcugggauuacaggugugagcccccgcgcccggccagcaaguaauauuuuuuaaaaaauuuuuuggcagugaaaagucuaaugagacauaaagaaauaauaggaaaaguacuacuagaugggccugaaaaugcuuugguucucuaacuuguguguaauggccaacaucauuaagacaaggacaugugacagacuaauuuugaaaauuuauucucauguuacugcauuuuuguuauucuaguuaucaaucuacacccauaccacaaugcugcuuuauuuuguuuguuuguuuguuuguuuuugagguggagucugucacccaggcuggagugcacuaucuuagcucauggcaaccucugccucugggguucaagugauucuccugccucagccuccugaguagccaggacuacaggugugcgccaccaugccugacuaauuuuuguauuuugaauagagaugggguuucaccauguuggccaggcuggucuugaacuccugaccucaggugaucuaccuaugucagccucccaaagugcugagauuacaggcgugagccacugugccuggccugugcugccuuccugacacucaaacacaacaggguaugaguuguaugaucagcuauggaaaacagacugugguauguauguaugacugauaugugguaacaacccuucucuaggccuguaucugucuacacaagcagaaacuguuggucaguucaauuaaaaaauuaacugauuuaaugaguuggcugaauuaccuuauuguuugacaugagucaaccagcccacuccagcaaaacagccaaccaacucagucacucuguagaagcagcgugucauugaacaaccaaacacacaguacaucgugcacagcauaacgaugcuucauaaaugauggacugcauauaugaugguggucccaacauauuauaauaauguauuuuuacugcccauuuucuaguaacacaaauacuuaccauuauaaguauugcaguguagaauaguaacaugcuguacagguuuguagcccaggagcgauagacuauuccauauagccuagguucaugguaggugcuaccaucuagguuuguguagguucacucucugcuguucacacaaggaugaaaucaccuaaugaugcauuucucagaacauguccccaucauuaagcgaagcaugaccugcaugcaugaguaauuaugugugugagaagccaugagaauaccucuagaaacacaauucuucuuucucugaaaaaugcuuucccucaaagaacagugcaugcucauggaaaauguaaacgauuucuuucuauaaauaucaaacccauuuucucugugauucauauuucaaauaaaacacacacaagaucaacacuuaaauuggguauuauuucuuuuuuuaaaauaaaccuuugucagaauauuauuucuucuuuuuuucuuuuuauugccacuccuccucuccagaauauuauuccuacugugugaaauccaaaggcaaugggaagggauacaguucugucucucucccuucuuacaagggagacaaaagaacucccuucgucacucaccucuguuagaaaugcauuccuuuaauacaaagaguauuucucccauuuuaugaugagaauaauugggaaaaagaaauucaauacuuuaucuuucacuucucagccaccuuuggggaacuuauauuuuguauaucaggauggcugugcuaugcauaacuucuuacagaucuugauaugcuaucuuucaucauuauauucagauauaaacccaauaguuguagagauuacuaacagugaguaaaggaaaggcuaucuagaaauauggaagacauaaagggauugucuugggacugaccuacagaguccuugccucauggggacagauucaacagggcaaugcugacgucuuaggaagggaguguguaggcgguguguauguugggugggaaugggaaaggcaguauaguaucauagccugcauauucuucuccuuuaaucuagaauaggaagaauaugaaaguagagguaauaagaaauaugccauaagacacacccucuucagacagugcaaaagagcuaggugugguuuugcuaaaaaucuagcuaaugugauucugauuucaaaaucauuaccuugcagcuuguguagaauguuuuccccuguuuaacuggccaggacaaggaaacuaaaauauuugucaaaacuugugccuuacaauguuguaaaugauguuuccaugucccuccuuuugagauuuaagcuaucuagugggagugggugcccauacuccacccugccgagcuguaagcaauuguaagaggggccacugacaacuucaccucugagucuucugggacugagacccagaauaaaugcuaggccucaguucaucucccaaacagaaucacuuucucuuguuuuucccccaaaucggaaggagugucuaucuagauuuuauguccagauaauuccaagguucuaucauuugguaucuaugguuuuguauuuuguaaacuuccaaaggacuucauuucccaaaucacaaauuucuuuacauuugaaauagagaaaucaaauuaucauuaauguauuucuuugcaggaaagaaacugggcaauauuauauuuuaaaaaaauaacuuacagaaaaaaauaggaagauuguucuuuacucuuauaugaaagaggcauagugaaagagcacugggcuuggauucagaacaccuggauucccauccuguuucuggcaccugaguagccuuauauaaaccacagcccaccuagccugaguuuccucuucuauaaaaugauguaguugaacgaaauguagcuaucagauacuuucagcauugauucagcaaauauuaauuaagcaccugcggugagccuaguaccagggugugauucagcauguaacaggauggggguguccccaguccagguaaugaaaggguagaccauucacagugucaaagacagaaaacuagauaggaccuauuacucuuagcaugcuauguuuagggcacuggcauaaauauuucccacuaaauauucuacacuaucuagaaauuuuuaacaaagcaaaaauuguuguuuaccuagacuuaaucuuucuguaguuuagggccaaacuucgacuguuggagcuccaucuucaauugcuacuacuuucuaugaauccauuucugggaaucucugaaggcauagacugacuguacacuuagcacugugacauuaaggggacauuuaaauugugugaagggacaaguccucuacuugucccuggggaacugagcagaggaauucucccaggagccuuuguacccagagaauucccaucacugaacaguccuuagggaccucuccuuuaccucugcccuaauuucgguuguacuuuuggugaguaauauuuaggccacucgaauucuuuucuccuuucuuuggccaacugccugauggaagcagccagccaaaaaggacccaaggacauuuuagccucuauaagccuuuuuuuuuuuuuccuggcuuuguaaagcaaccuaugaaggaagaaguugcauuaaaugaccucaagggagccacggagcaugcccucuggaauaucccucaccuucucccuuucuucuuaauccuacuaugccaaggaccuucauugugcaucuauuuuacaagcuggagggcaaccaaaaucuuccuuaauuuaugccauaaucacugauauccagaugaugggucugcugcacaccuggauuucuuuuauuuuauuuuauuuuuugagauggaaucuugcucugucgcccgggcuggagugcaguggcgcuaucucagcucacugcaaccucugccucccagguucaagugauucuccugccucagccucccaaauagcugggacuacaggcacgugccaccaugcccggcuaauuuuuguauuuuuaguagagacggaguuucaccguguuagccaggaugauccugaucuccugaccucgugauccacccaccucggccucccaaagugcugagauuacaggcaugagccaccgcgccuggccacaccuggaauucuuuuuuggcugauggcauuguugccuuuaaggcggugucuggaaaaugagaauuacaaacauaaccucauuaugcuauuagaaaaaugaccaucauauucacaacugccuucuugacauuccaagcaacccagaggaaaauauaucaagcugagaaggauucuguuuuuauuacuugaauauuaucugccagguuagacaugugagaacauugcuuuaauuauacauaagagauuucuaaacuggagaacaggaaacagguaguggucauaaaugaaacaauacccagaaagagaaggcacuggaaaauauuucucauuaaucuacuuuaaaauauuucuuuucuaguucaugaacauuuugcaucaccugaaauauuuuccuucguacuucauuuagcaucuuucauauuuugccuuuauuuauuuauuuauuuggauuucaguuuaaguauuuuuaacaggaugucugcuaugugguguuuuuaauagggugucuguuaaguuuuaguucuuugcccaaaguuaccugguuagugagaauaccaagaugggugcccaggucucugagcuccaaagcuaugcauuuccuuauaguguuuagcagcccuggcaucugcuauaauggagccuaaaauauaugcauucucuccaugucuguguugucuugguuuaucuuuguaauaaaacagaccauuagaaaguugugcucuaggaccaaaucgucuuggcucuucuuaacauugccaucagcguacacugagggcauucaaaagaacacucucugugaggcuaaauauuguaucuacuguggggauauuguuagagcccuguuuacauaaucuggaauucucugucuuggaaaaacccacaaauuuugcucaggaguccaguaguaggagaagauguuuugcaaaaaagugcuuugauuguuaucucauguacaaaaagaaaucaugucaguaaugggcucuggcuacaaggaaccaaauuguggcucauuuccaacaacugaaacaacccuuauggagcuuauuuuggggcugauccugauccuuggcuuugacuuauuuuccugccuuuauuucccuuuauccucaugucuucauuuaucccauucaucuuauaugugaguuuauucaucucacauguaaacugcuuccaaaucuuuucuuaaggaugugacauuauccauaucuauauaugcauacauacagauauuuacuguugaauuauugauuccacagaguguaauacuuuguaugcuuccugaugcacuaaguauuuugcagggcuaugucuuguugguccaauucauuuauaaguuccuugaggauaacaacuagguguuauauucauucaagucuugagaguccccagcacuaauauauguuguucgcuuuauuguugauuggaguauauccacaaucugagaagauaaaugauuccuagguuaaacaugcccuuguacaaaucauccuuuuucauaccagugucaaaaaaucaggggcuagguaggcuaugaaguuugucaauacacgaauugcuauguucuuuacuuugcaacuucaugaaagagucacccuacugcacuagcugaaucaucauguugagcacaacucuuaagggaaguaugggaaagcuaacccaggaguggcagagaccuccuuuuccuccucuaucuuaacauguguacaugcuuugacuuugaagcaauggaaugugauugauuccauaagccacuuucaaaaauagucccauuaccuguuagugcucaccuuaaucagaucauauaaauuauauguggcuauauauggaaacuuaagaaacagaaaagucuaccaggacugcggugacaaaauuccugaguccccagauaugaugaacuuaucauuaguuuguaauuaauugauauuucaacaagaagcuuuuugaaacgugguuaagaggaagaauaaaagcuggccaaacuuuguccuuugguuugauaaauucugagaauguagcuauaauucuaugcaaaagaagcagacuaaguuacauuauauacccuggugauuauauguuucuucacagugcuguuuaacauuuacauacaauacuguaaaccucaaagaugucacucacuuauguaauuaccucacaguuauauaaaugaaaaaccugacauuuaauaagugacacuagcauaucuuuauauaaaguaguguuacauuuaacaucccuggggacuagguauaucguguauaccaugcggauggauguucuggaugaaugaaacuuaacuuuggaaacauugcacuuugaaagaauuuuuaaaauuuuugauaaagacucucuaauacaaaucgcaccauuccaugacuuuuuaaacagaggauuugauaagccuguucccaaugacuugucaugguugugaaugcucacuguuggacccuagguuacagagugguuucuuuagcgguuccugaagucuaggccucugacuuccuguacugagugacucuggauugagcuguucaagaagcagaggaccagccuguuuugcuuucugucuaccccuucugcugacagcuaucauguucauuucccaacugcugugcuauucguucacuuuacaccuaaacaugugaacguugggcaggaccgaggaggcccugcuuccauggagauuaaggaugucagcagaaugacagccacuaaacuccaccccuaccucugcuuuacuuccaauuuuacuucccuuuacucccauucccaauuuaugaaguucccaaaaucuggccccaagacaaugaaagcuuauuuuguacaauuuaauuuucagucuauaugcacucaaguuuugaaccgcuuacucuaagaauuuugcacaauccaaauccauuaaugcagguuaacauauuacaaaagguuacaugaauauaggaaugauaguaugggauggaguugaucagggaagacuuccugaaggaggcgccuuuuagaaugguuucucaaugcauugauggauauuuuagguaagguauaaugcuauaugccuuguugcuaggaccaugaacucuucagauauuggcucugcugcuuauuugcugugugacauuuggaaaguuacuuaacuuuucuaccucaguuuccucauugguaaaaugaggauuauaauaaguucugcuucauugaguuguugugaagauuaaaugaguucaugcauguaaaacucuuuuuuuuuuuuuuuuuuugaguuggagucucacucugucacccaggcuggagugcaauggaguggucucggcucacugcaaccucugcuucccagguucaagcaauucuccugccucagccucccaaguagcugggauuacaggcacaugccaccacgcugggcuaauuuuuuguauuuuugguagagaggggauuucaccauguuggccaggccggucucaaacuccugaccugauccacccgccuuggccucccaaagugcuguaauuacggaugugagccaccgugccuggccugcauguaaagcuuuuaggacagugccugagaguacaauguaaggguuucccaauagugguaguagaaguaacaagucauaagaaagaugccuacagcaaagaggcaaugcuuaccaaagaacuaggauguaauaagagcugaaguugacaugggaaaggacauuuaaagaaaaacuucuccaucuuuuucauuauauggcucauauuuaaaaaauaauauuuacaugucacagcaguaucaacaaagcggguugcucgcagucugaggcaacugcccucaguuucuggcugcugcaggccaaccuaggcuagaggagaaggaggcauacggauaaucuauucccagcauauacugauuagggagaucugguuuagugaagauuuucgaagagaagucuagggaauuuggaagaggugauuguccaaaggaacagugugaccaaaacagauaguuguaguaacuguauaugauaaaacagaacaagagggagaaguauggagaugguguagguccagauucugggggacuauugggcgugacguacaugggagaugaaaugaaugaaaacugggguuuggugggaauagaaaagagagaguccagaucuggcaaaaggagguuagggggagguccuuugugcugcauuggagaaacauggaaaggggccagcauagcucaguuauccaaggaaguguugauagauaggacuuuguauuauggaacagcagcagcacaauuagaaagcacauuggaaucacccccaguuaucucugggcagggaagaacuucugguuauaaaucuauugaguauugcaacaauugacuagggcguuuuacuggcucuuaguucucuuguacaguaguguuuuuagugcuuguuuaaucauuguuaaugugaaaucauuuuuucuuggacuuuguagcaguuuauuauagagguugcagauaaucaucaguguucuuuaugaaaacaguaaaggauuaaugcaguugugugucuguccugcccagagcagguucucauuaagauaugguaaguugauuuugauuuguuuggguuuuaauuuuucucuccccucuucagaacaaacuucuauaaaugucaucauuguuacaaaaagagauggaaauucaucuuuagggauuuuuuuuucuuuuugccagaaagaaaaaaagaaggaauaauagcuggacuuaauuuguaaugauucugaagcaucuucaaaaucauuuucuuuccuuuucuauuuauuuuuuuugagacagagucucacuccgucacccaggcuggagcgcaguggcgcgaucucggcucacugcaaccuccgccuuccggguucaagcaauucuccugucucagccucccgaguagcuggaauuacaggcacgugccacuaugucuggcuaauuuuuguauuuuuaguagagauggaauuucaccauguuggccaggcuggucucgaauucccgaccucaaguagucugccugccucggccucccaaaaugcuggcauuacaggcgugaaccaccaugccuggccuuuuuuuacuuuuuugagacaggguuuugcucuguugcgcagacugagugcaguggcauggucauggcuuacugcaaucuuuaccugcugggcucaagugauccuccagccucagccuccugaguagcuugaaccauaugcgugugccaccaugccuggcuuuuuauuuuauuuuuuuguagagauaggaucuuacuauguugcccagguuggucuugaauuccuggaugcaagugauccuccuaucucagccucccaaauuguugggauuacaggcaugugggccaccuugcccagccucauuuuuuucccuacauuauacuuuguuccaagagcauucuaacaggaaacacugagagagaaaaaaaaagugauucuacaaguuaaaaccugcuucagcacauccuucucugacccccuaggaagccuccccaagaaauggaaugguauaaacuacucccguuuuccuugugcauauggcauuauaauaauggauucacacuucugucuccucucauuggagugugaguuucaugaaggcagggauuguauuuuaauaaucuguuuucccucaaguuucuaacacaagaccugacacaccaaaauuaacgaucagaaauaagaaauuaguucauaucuacuuaaaacuaccaguccauauuguagaauguuuucuuuaaaaaucucuuucuuaaaguuuaaucacuggccaggcuccgggggucauacccauagucccagcacuuuggaacaccaaggcaggaggauaccuugagucuaggaguucaaaaccagucugggcaacauagugagaacucgucucuacaaaaaagaaaaaaaauuagccggcaugguggugaguucuggugguccuagcuacucaagaggcugagaugggagaauugcuugagcccaggaggucaaggaucuaugacgucaauuuuaaaaagccucugcaauaaggaaaguaaaauaacagcucacuugcuggacuauuaaaagggaaaugggagggggccgcaaaaagguuuugauaggcuaaaugugggcuugacaaagaucuacacauuuuucuucuaauuguuggccagauucacucuucuuuuuuuuuuugagacagagucuugcuguguggcccaggcuggagggcaguggugccaucucggcucauugcaaccucugccuccuggguuccagugauucuccugccucagccuccuaaauagcugggauuacaggcacccgccaccaugcccaccuaauuuuuuguauuuuuaguagagacgggguuucacuauguuggccaggcuggucucgaacuccugaccuugugaucugccugccuuggccucccaaagugcugggauuacaggcgugagccaccaugcccggccuagauucacucuucuuaugaaaaaguacaaguuucuaaugauuaacuuucuggguuaugggaaguugugcuucauaacaauaugggacuuguauuccuuuacacucucaucuauaauaucaauauaaauaguuucucugauaaguaacuagguuucugagauaagcccuuccuuuuauuguagcugauaacacacgauuauaugaggugguauugcuaaccacuagugagagguuuugcuauauaauguggaacuuaaacuucuuuggucuucuucccagaacugccuagaugccacucuaaauuguuuauugacagcauuaauaccuggagaauuugcuuaaaagaaguagauuauuuuucuccccuuccuuuuucuacccacacccccauaacucuguuuuucuuaaaaaacaaaaaaucuucaaaauugucaacauugcucaauuguugagaacaagggaacaagccaggcaucacauuuacccuauuuuuuuuauucauagagcugcguaaaaacuauguuauccaaagcaccaugaagcugcacacucaccaauuucaagauaauauaaaauaccacauaaucaauuauggaaaauaaugaaauggaauguuggcauagaaaaccuccucggagaguauuaaaacaaggaaucaauugcucgaguggcgggggcggcguuggguguuaaaauuaacaaucagucaagucuuuaccaagggccagcugugggugcagaccugcagggcacgugugagaagggucagaugcaaguugcugagguagucacugcccuguaaagauugucauuaauucuacaaacaaacaaugaaagaguuguuugcuuauguugugggcuagaugcacaagauacacagaaaacugcagaagugaaaguaauucagucauuuguuccuucauuuagcaagcauuuauuaaguggcuuuuuuuuuuuuugccaggcaccagggaagacacuugggagcuguagcuucagaauccgucccugcccucagggaaggcagaacaauaagcaaacaaucauaauacuuugcgaaagcagggagauuauaggagaugccguguuagacacaaaggaagacaggauaaugugaacagcacagaauacaaaacaaaaaugaaguacuaauuacagaaaacagacaggcucaauuucaccuauuccugcaauuuuuagagaagcagaggaacagaggauaugcagauuuugaaguguguccucagcauccuaaaagaaaagaaaucuaggaaaagucagacuguuuuuugcuuguuuugagacagagucuuguucugucacccaggcugaagugcagugacacgaucucggcucacugcaaccucugcccucuggguucaagcaauucuccugucucagccucccgaguagcugggauuacaggcgccugccaccagaccuggcuaguuuuuuaagagacgggguuucaccauguuggccagacuggucuugaauuccuggccucaagggauccgccagccucggccucccaaagugcugggauuacaggcauaagacauggcacccggccucagauuguugucuuacaauuuuaguauggcuuaauuguggcaaggucuuguuaccguaacuauuucugucaaguuauauaugaaggacaggaaccaucaaaugcaaaugaagaggaagaccccuugaugagauggcucuagaagacauacgugugugugugugugugugugugugugugugugucagggucuugcucugucacccagccuggaaugcaguggcacagucaugucuuacuucagccucaaccuccuggguucaagcaguccucccaccucagccuccggaguagcaggugugugccaccacacuuagcuaauuuuuacauuuuuuuguaaucucccuauguugcccagucuggucuugaacuccugcacucaagugauccucccaccucggccucccaaaguguugggauuauggcugugagccaccacaccuggcugacauacuucucuuaauuuucacccaccuuuucuccuucuguucauggccagaagauagucucaguucuuccauuuuuccaccugcaaaaugggaauaauaaauuuucuuguauaaauagguucuuaagcuggaauccuuuuuagguguccauaaauagacuuuggggauucuacagucccccacccacuuagaaauuugaugcaacauuaacauguaugguaauuguuucuggggagccaauuucaaaguaaaguauuuugggcuucccugaaauaagugcuaaauaaacaacuaauacuucacaucacagaacaacauaacaaaaccaaauuaccaucauagacuaauaaaucugaaauaagaugcugauaguguaugagaauauaauaaaacccagagagagcaaaguacaccuggcuuugaaaucacuccuuagcaccugagaggaucaguuccuggaaucugcuguguaugcaaugacaugcauauugcuaggacguuaggccacagcuccuugggucagcugugggcagggaacauuugggcagaucugcauaagcugcugcccaccaccuggauuguaaaaccacaugccauucuggagacuuuccuucaaagaaaaaugugaacucucacuguccacuaaaccacuaaauacuguuugggugaacauucucccgcaccagaaucauuuucaaaaaggcagugacugcguuuaucuuguccacccuuauaugcuagggccuggcacuuauaaccaccaaagaauuggcucucaacaauagcuauuuacuuaaugaauguaacuguuuuggucagaacauacugguuugaaacauuucugauggagaugugcugggggaugccuuuuccugaucacagagcuugauuauagcuucaauuucuguaaguaauuucuuuuucucuucuaaacagcacuuacaugauccuccaguugggagccuucuguuaguuguuauuucugcauuuguguguugcuuuacacuucacaaagggcuuucccauccauuaucucauugcaucuucacaagacuugccccauauauuuuuagccgagaaaauauaaggcuggagaauuaaguagcuuggccaagcucucauagcuagaaaguguggaacugugccucaaauccuuguuuuugcucuguguuuggugguuucuugagcucacuguguccugaaauuguggaaauaaaguuagccagaaacucuuaucacuacuaauauaucagugacagcuauucagagucuuauggaauggccacauaaaaaugaauuugauaaagugaauuaaauguauuuguuuuauaaaauuauagagccucuugauauaauuuggagacagccuagauugugagagggagaaugagaauucuuauuuugagauggaaucuugcucugucacccaggcuggagugcaguggcaugaucucugcucacugcaaucucugccucccggauucaagugauucuccugccucagccucccaaguagcugggauuacaggugugcacaacgaugcccagcuaauuuuuguauuuuuaguagagacaggguuucaccauguuggccaggauggucucaaacuccugaccucaggucaucugcccgccucagccucccaaagugcuaggauuacaggcaugagccauugugccuagccaauaagucuuuagacauaccccugaaccucucugacaccccuguuuucucaucugaaaaaauggauaccaguucugcuaacuucaaaggcauguuuugcaugucaaaucuaaaauacacaaaacucuuaaaaauauuacacaacauauaaauggcaguugcuuuuucaauaauguauaguguaugucuaaauauggccauugcauuuggguacaccaagguuuuuguccgguaaacaucacaaaacaaaaaguaaacugauacaaauagcuauagaaauggauaaauaugcuguccauauuuaaauacgaggacuggacaugagacagaugugcauuugucauugaagaaugcaguucccuggcggggaagguggaacgugcauaagauccccauuauaauguagcacuuuucauuguaauccucauagcaaccuugucaggaagauacuuacuguucuugggcccguuuuucagaucagaaaacugaaguuuagagaguuuguggcaaaauuguccaaauuauaaaagaaauuccaguuagcaccgacaucaugcuuggugaguguucucuucaguccagcacaaucggacuuucaguuaacacugguuacaaaacgggcugugugucuuugucuccaaaaguccuaugggcuguaaugcuaauuuucuuuuauaugaauucuuuuggcuuggcaguuugcuaauaucuguguacuauuucagcuucacuuuaauguacuguauucacuuuuagauacauaagcauaggcaaucuggggucauucuaauggagccuacucaggacaaccugaggcaccuggaccuaacucuaauagcucuauuaauguuagguagaccaguuuaauggagugcauucuccuagcaguucauugauuauaaauacuuagcuuaaguaccuacguguguccuaaaaaaacuauuuguccgaaugaaaauccugauuuucaggagcagugauaugaauucugggcaccugugcuucagugaccauggguggagacuuucuuguuuauauguaguccucuuauguugaaaauuacacaaaaacaaaaaaguagugaauaacagugucauuuuuuguuuuuuuuguuuguuuguuucuauuucuuuugcagguugaugaccaaaugaagcugcuucagaacugcuggagugagcucuuaauccucgaccacauuuaccgacaagugguacauggaaaggaaggauccaucuuccugguuacugggcaacaagugaguguagagaccaaaaaaaaaaaaaaagcaucuuuuuauuaagcauguucagaauggccggaauuuaacuaggucagaagcacucuugugcuuugaaagggagagauuggcugccaauaauuuagaaaagaugacuuggugcacucuguuccugcucugauuauuauaguuaaacuuguaaaagcaaacauaaucaugaacauucugcugcuuccagucugcugggacugaaaguccugcuuacaaggguccgaagaacugguaaaugaaacguaaugauuaguacccagguuuucuuuuuccucgagcuucugcuuuaacccaagacacuuguuugucagcuguuuuaaaaccuuauaacuuguggaguccuuacuauuuuggaaaaauauuggugaacgagauggauuuggaugucaugaauaauugaaauaguugguauaaaggcaaaugagaagggaggggaauuucaguuuucaagauccagucauucaaaugaaagauagagagaauaaaauuacuguuagguccuacaccuuucugaacagauguuuguucgaucaacaaaaauuuauugagcauccuacucugugcuaguuacuuuuugggggcuuugguguauauuagugaacaaaauaaaaagguuccugccccugcggaacuuaauguuguagcagggagaagcugacauuaaacaauaauccuaagaaacaagccuguaauauguuaaaggucaaagugcuacugaauaaaagaaaaaaaaaaaaaggaaagaaccaaugaaaagaaaaucaacacucauccacagacauguguugcagugugacccauaaguugcacugugaaauaggaaugguugguuuggcuuuauuggaaauguaacauuugagcaaagucuuaaaggaggagagacagcuuugugaaugucuuuggagagagucuacuuaauagaccuaacugcaacuuuacaggaauuuaggcaagucucuccaguuucuuaacccuccguucuacaacugaugugcuauuuaaauaaaugugugggacacagugauuccuucaauccuuugggucauaccuauucagggucccacugcauuguucagcaauggugacuucaguacucggcaccaugaucuuuuauguucagccauaaauguuuaugugcugugaaaccacagcaaugcuauuuggaaaugaagggcugucuccacaucauuugcuguauuauuaauaaaucaaaauuucccaaucaaauuaaaagcaagcacuauuucagaguuuuugcaaauugggucaauucaagcaucuccaucacuaucugguccuugcuaucugcaccucucaggagaaaagcguugcagaggagaaaauaaagucucaauggguuugacuuccugugcuuucaaauuuuuuuuggcauuuucauucugggacccaagucuuuggagaaaauguacccauuuucagagucuaaucauugggugugccucccaccuucaccgaacuaggagcugcauuggaaguacaagacugggcccacuaauuaauuugauuucauuuccuucugaguuucagaaaugaaauggguuugugccguucuuuuucucaaagcacuuccauuccugcucuuuagaaauauuucuuauuucacauuucauuuugccuuaagugcugcccgugggugaggguaauuacuauuuaaaaaauagagaaaagugcauuucuugcugucugauuuucaaaaccaagaacaaucaaggaauggaugguauuauaguuuuuuggaucaauuacuggugcuuuguguuuugucaucagaacugaaugaggaacuccaugguggagaaauaguuauuuccuuauauguuuccugcagccuggauucuuccagcuccccuccccacucuuuaaauauguuuccugcagccuggauucuuccagcuccccuccccacccuuuaaagugugccacaggucugucagaaccccucccuucacuuuuuucauccaguccaguggcuacccuaguaaugauuaauuguaaucagacauucucauuuauggcaauuaugguagacauguuuauuuucuuuugcggaauaucuagacaaaacguuuugaauuuaucucugugcuucuugcguuucauaggauggaagcaaaagugcugcaaaggaagacuucaaaagccuguaaccucucuaucagaaugagacagauaucuuaaagcagggucauauacauguacuucuuuuauauccucacaguaccuagcacaaagcugaauauguugggcacaugauacauauuaccugauugaacuaaaugagaacuauuguaucucuccugguugcuugauuaaaacaaauuaaguauaauuuuuuugagaauuauaaauacuucccugaguguaaaaaugggaaaauuagauuuuugcuacaacaacauuacuuuguguacacaaauuuuaagaagguaguuaaaacaaugaugaguggaaggaaaggaauauauuaaguauaagaguaaagcaauaugcuagaggaaaagaggauuuauaaaaaagaaaagaggccgggcacaguggcucacgccuguaaucccagcgcuuugggaggcugaggcgggugggucacuugaggucagggguucgagaccagccuggcgaacauggugaagccccaucuccacuaaaaauacaaaaaaauuagccuggcaugguggcaugcgucuguggucccagcuacuugagaggcugaggcaggagaaucgcuugaacccgggaggcagaggcuacagugagccaagaucgugccacugcacuccagccuuggcaacagagcaagacgccaucucaaaaaaaauaauagaaaagagguggaagcuagaagauauauauauauauauacacacacacacauacacacaaauauaucuacauauauacauauauauacacauauauauacacacacauauauaugauaugaaaguugaaggaggcagaaaaaaaagaaaaaaagaacugcuuccuguuauguuuauaauccaauaacaauugagcugugguuagaguauauuuucuucacuagugcagaccaugugcucucugguguguguguguaaaauucacacauacagguguaauuuagaauuggaacaaccuguuuucgugucuccauuccaaaacuuccuggcugugucauauuuagcaagucgcuuuaccuuuugagguucaguguccucaccuguccaguggcaacuaugauguuaucuaccagagagaauugcaguaggaauuacaggaaguauucugugaaaugcugacacaaaaauuagaagucaucaaaacuaggccagcgcaagggugacauuuauggagucaacaaccccacgaagaaaggacuauuaucccucuuuggcagaugaggaaccaaggcaaagaaagaugaagugguugauucaaggucaagacccaucuaguaaguggcagaacagauggucagaucgaggccaacuagugcuagaguuuguguucuuuaccaacaugccauaccguuuaucugauuaacucacagaugcugcagagcuugccuucacgccggcauuuaauauggucuucauguguaauuccagugcaugacagacucuauggaaauuccaagcaaaacaaauucauuuccuuuuuuauugagacuaaauggauaugcuuuuuuugugguuuaguuaguuaguaguuuguuuuugggggaauuuucuauauggcauuguaagcacauuguuacaguagauuuaaguuauucacaagcaauuuuaaugugauuguugcuuaguguuaugaaauuauuuuaauauuaagaaaaaacuaaaacuaugaaaaaaucacucauaaugccaccacuugaaucaacuuuuuguugaauucucuuccaaucuuugggggaaaacauguaucuuaaaagaggauuuuucucauuuuucuaaauaaaauaacucgccugccccagagacauauugaccugcuaucauggauuuguguggaaugugaacuuucaaacacugcuagaaguguguuuccaugaagcacuguauugaggccauguuguugauaucaugggaaaaaguaaaugguauuaccccaauacagcaugcaaaauuccccuaaaggcagcuugguacucacuuguaggagauaaauacauuuuuuaauuuaguuaaaacaaaugcuucugauggccugauaaaugaagggaaaucaaagauguaaggggaaaaacauuagacacagcucugcagccaauagugauaagaggcauaauucauccaccuaauuaaugacugcccuuugcauagugcuuuucacuguguacuuucacagguaagccccauuacacagggucagagaaagugcggggaaauuucagaggaggaagugcaaggagaauaagauggguguucuaagcuguccagaugauucagcuucuauaaggaagugccuuaccccuaaagugaggauauuugauuguacucuccuuuguaaguugaggaaaacaccauugcuuaaaauccuucuaggucagaggaacagugacaggcaauuacuagaugaaacuuuaacuaaacucgccaccuuuuucagccucagccagaagaaauacaauucacucauuauagauuuccagguuuacuuacaguauuuucucaacugcccuguugagaaaaugauuacuucugaaacaaaugaaaauguuuauacugaguauuuugagauuggcaaauaggaauauuaaauaugccucaguccacaauaucaggaaugaagucccaacacaaagggaacaccagacagugauuuuguuucaccuugaaagcauguaugucaugucuacacauugcuuuauagugacccuuuggacagacagaggaaugcaagaccccagguguuccguagcccaaucuucuggcuuuuucuuacuaaacacagcucacuguaaauaauguggugaauuugucauagcagagaaaaaagaaaaagacuagccuggauuuuaaaaaaugagugacuauccaggaaauugcuccuuggagcuugaaaagagaagaaauauaaaauagcacagccuuucucuuaagcccaguggcucacaaguuugcuuaauaaauguuugcagaauugaacuaugucuguucauaguucauucagaacuagagaaaccaaaauagccccacugcaaagagcagcccaggacaccaguacauuguauauugaaaugaggauucaguguuucacuuaacccuguaaguuagcuauuauguuuuaauugcgucuuugaaucaggcaucuacauaaauguauauuaaauagccuuguuaagcaaaaaggaaauuaugauuaucaguaauauuaagcacuucaaauguucuauauagucgcaacuuaguuaugaaaagaauuauuuccuauccaauauuuuaaaaacuacacacgcacauaugcacacauauaucuauguauguauaaaauaauaauguacuuugaaguggggucagguuuuaguauuugcauauuguugcuaauuaacagccacuguaacaucauccuaagggaaaggucuacuggcaacuuauuaucuucuauuauuguguaucauauuaaaaugacaggcaucuuauaauauacaagucaucaaaauuucagugauuagaauuaaaagcaauuuagguaaaacuguuuucuacuuuuucaugaugagugaaauuuaucuaaaggggacaucaguuuagaguauugcuucaauaucucccuugaauuuaaugacacaaagauuacauguaagagagcaaaaaauuaauuuuacuaaguacauaaaagacaaggccaacugcuccugaaaugagcacaaacucugcauucaacaaugaaaauauaauuauguuuguaauaaaauguaaggaaguuggagaucugaauguuguuucaagaauaaaucaccuauccuucuuuagagcugugcaauuugauaaauauccuugaaagaaauguuuucuaagcccccauuuaauaagcauguuugagcuuucaaauuagcauguaaauaaauguauaguuauaaauuuguugguaaaccaauugauuuuuugagguccaucucacuaaaggucucucacuaaauauauaauccuaugaaacagauuccuuuccguuauaguguacuacauuuucacauaugaaauucuuguauuugaacuuauuauuauacaccuguuagaacuauacacaacaauauuuaauuaacuccaucuuaauaauggaaaauuaauaccaacauauuuguguuucauuuuaguauggucuuccugauucaggccuuaacuagugauuuuuuuuucuuuucuuuuuuuuuugagagaagucuugcucuugucccccaggcuggagugcaauggcgcaaucucggcucacugcaaccuccgccuccuggguucaaacgauucuccagccucagccucccaaguagcugggauuacaggcacuugccaccacgccuggcuaauuuuuguacuuuuaguagagaugggguuucaccauguuggccaggcuggucucgaacucccgaccucaggugauccacccgucucggccucccaaagugcugggauuagaggcaugagccgccgcaccucgccuuuuucuuuuuuuuuuuuuuuuugagacagucucacucuguugcccagguuggagugcaguggugcaaucucaguucaccgcaacaucugccuccuggguucaagcgauucuccugccucagccuccugaguagcugggauuacaggcauguaccaccacgcccagcuaauuucuguauuuuuagcacagaugggguuucaccauguuggccaggcuggucuugaagucccgaccucaggugauccacccaccucggccucccaaagcacugggauuacaggagugagccaccgcaccuggaucuuaacuagugguauuuacuacaauauacuuuguauauauuaagcuacagcuacagcgcauuccguugauuccaagcuuaaauuguuaaucuugucccaucuaugauucuugauaaucauagaagugagagguaccuuauuaucaucaccuaacuuaacugccuuacuuaaagauaaggacaccaagggauggagauuuauacguacuuguccaaggcucuucguuuguaagaggcagcauuggcucgggucucuuaccuagucucuggcuuuugccaccacuguuguaccaucaggccuuccugcucucauucacucaucuaucccauuagucucaguaaaauuuguauuauuauuaucugaaguaguugacuaugugcaguuuuuaaagaauuuauagcauaggcaccuuuuuaaaguaaggacuuuccuugaaguagaaaguuccccuguaagagaacuggcaaaaugauaguugagacgucacuuugugugcucugcaaauaaucccaaugugccccacagaguucaacaguguguccugccuccuuccagcucaggguucagguugcccagguacugacccuucuuucacacauucugaaacagaaaccacaggaguucuuacaacacuugauguuuaaauuuagugcguagaugccagcaccuggcuaaagcagguagacagugcuguacaugaugcaagagcuuuccucuaacacacauuaacuguggcuuuuucaugcauaguugacucuauauaaacugauugacaccuuugggggucaucuuuccucugacucauaauuuuucucacucuugaaaaagguuucuguacacccaguauucucuaguuaaagcugaaaauucaacucaucauauuuacacaauaaaaaaaauccauucugccuuguuuuuaauugcaaauucuacucaagggacuaguucuccugcuuaggaggcagcccugugccuucuccuagagaagcaagugcagucaauuaugguaaugaaaugucaauaaauauaaaaauuuaauacagucugcucugggugaguggcagaugaggacuugccucccagacaaauuugcugcugcugcaaauauuaaaugcaccuaaaagaguaucugguugccugagagcucuccaguaaaaaaaggaugggagcgucagguaccaacugggcuuucccauuaugcuguaaucgcagcagcaaagccagugcuaucacugacagccaucccaacaucuuaacuuguuauaaauugaacuucuuauguccccaugaauaaucuaagauuggugccuagcaacacuuuuuuuuuugagacggagucuggcuucuucccccaggcuggagugcaauggcacgaucuuggcucacugcaaccuccgccucccagguucaagcaauucuccugccucagccuccccaguagcugggauuacaggcacaugccaccacgcccagccaauuuuuguauuuuuaguagagaugggguuuggccuugaacuccuggccucaagcgauccgcccaccucggccucccaaagugcugggauuacaggcaugagccaccgugcccggccagcacuuuuuuuuuuuuaaugaaaagggaaauaagccuuuucuuuuuuugcuuccagacaacggaauuauucuccuaaauaaaguuauugcugucuuuagagagaaacacauuaaucugauguaaucuaauguaaucaucugagaauagcaguuuuaugucaugcuuuuuaggaaacagaaaacuaaagaauaauuuauuuguauuuauuuuaaauuuuuaaauuaacacuucugcuguucuauaaagaauaauuuaaaugugauucuuucaucauccacaaacauccaaucuugaacuaugauuacuuuaaaauguagucucauaauacaaguagaaauauaucugccuuuauuuuccucaugcacuaguuaauauuguauauacauagaacacucuccuggauucacuuuucauggacaguauguuuuucuuucaccuuauucaugagaguuaaaauuuuuuaucuuaugugaugauguaauuucauaauauaaaaaaggcauauauacuugaaaaauuuagguagccaaaaccucuuuccuacaaagcuuaucaaaagugauuauauuuaucagacauaguaauucugaugcauuuuagaaucauggaaugugccucaaacuacuugcauggggaaaaucccuucuguuaucaaucuguauuguggccaggcaugguggcuugggccugcaaucccagcacuuugggaggccaaggccagaggaucacuucagcucaggaguucaagaccagucuggucaaauagugagaccccacaucucuauucuauuuuaaaaaccuguauugcaaucugauuuuacccauaguucuuacgacucaggugaaauacauauugcugauucugauaguccuuaaaacugugauucuguauugcagguggacuauuccauaauagcaucacaagccggagccacccucaacaaccucaugagucaugcacaggaguuaguggcaaaacuucguucucuccaguuugaucaacgagaguucguaugucugaaauucuuggugcucuuuaguuuagguaagaaauccuuuucucaugcugugcucaaccaacgauugcuaaaugauguugaaguucaaauaucuugugguccauguauguuuuuguucuaucaauauaaugcccuuccugucaaauuaugaaaucuucaaacgugaauauauuuucauauauauuucugcaugaugcauagcccuucaguggauacguuggggaauggaaaaugaguuauucaauugacucauucaaaugaguccugguuuuucuuccauaauauacagauaagcaauaaccaaauaaagcuaugacaaagguuuaaaacagacagcuuaggaaagauguaugguaucaaauuuuagccaucuuucucccauugguaauuucuaugugccuuucguuucaacuugcuauuuacuucuguuuuuauucuucuaaaauaugaaucguaauuaaaaaccuguauuuaaaucucuaucgggauuaacuagagaauguuuauaaccagaugcaccacuaugcaaguacaaaagaugacaguugucaaggggaaaggaugauucuuuaggaaagcuuuggaaaagaaagauaacuaagcaagacagauuagcuaaaucaagguucucagugagucaguugagaaaaaucaccacagcuuggaauaaaaaaaggauuaaggagauggauuuuuauugacuucaaaggaacagauuuuccugucugucccuuacuugauuucuguauuuuguuggcuuaauaaagccaacuuaaauaaacuuuuugccaaguccauuuauuacuuauuggcagacagcugagggaggcaacuucccuugaaugaaaaaaaugcagaaaucagauucaccaacauauguuuuuucuuuagucuucaguuauaagauaguugugaauucauauucuagggaauaaaacaauaaaacaaacugcaaaguaaaacagaugugucuacucuccaaauuugguacuuuauuuuuaaaauucuucuugacaggacugcacaacuguugcuaauaaagggguaguuugaaguaauagaaccagaguuaauuuuucauguauagucaacauuuaaaauaaaaagagcauuuucauauuuuggaaaaugugauaaauacagcaaaaagaaauguuacugaaaauuuaaauggacaacagaauuucauggauguaacguucaaagguuuacaaugccaagacuggauccugugugguuucuguauuaaccacaauaaaaaggaaaguucuguucaaguaagucugcaucuuuuacccgagaacaguguuuagaauguuaaaaaggaagauagcaagcauacgccugcuugcuguaaucgcacaaauuauucugguuuauguuaagaucuuagucuuuuaaacuagugcauuugaucacuaauuaaauggaaaaugugguaauauauguauaagaaacuguauagcaucuuagugauaaaauauuuacagggucaucucauuucaaugguauuuuaaauuaguugaagaaauguauuacauuugaagauguacauauuaaccaugagccaucuuuaguuuucagcacuuuuaacuuuccuucaucaucuuccaaaauuauuauauucucugcuaauacuauaaggaggggguugggcuagaucugagaugcuuucaacuuuugaaccucaaaaauuaucuuccugaacaacugggccauguauuuaccagaacuuuagucauacacucugauguuuaaugagcacuucgauuguuucaggagcccaguacaccagugaauagcuggccuaaauguccauuaaauccaugucuauuuguugcuuaaggaagaaaggaaagcauggcuuucagaucagaggcaaauagaauucuggccgagagucuauuuuuuuagagaagcaggagaaaaguaaccaguaguaaaauucaaguaguuucuaauuugugaguggaaaaacuuuuuacucuguagaaacaguggcuaaucaauuuuuugaauuucaccuuuauugagguauauagauaauuaacuuuaggugccucagcuagccccaaaugcugguuuuaccugugauuaagggugaaaucauaccagagucacucuugaaaguuaaggccaaguccuaagcugguaccugcugucccagaugcuccuccugagccucgaguccccugagucugaagccugcuauauuuuugucucagcccagccuugagacucuuugguccuggagaaaaaugaagauucuguggacuagucagaggccagggucuauucugagagaugacugcagcaguauucuccugugagagaugaaacaguguuuuccagauagauuuggugagagaaggugggauguggucccaagcgggugcagcguuccaagcuagaagcacuaccagugugaaagcuuaaaggcaagagagagcaaaaugaguuuggggaacuguuaguugauggauacggcuugagggaagcagcagauguggcuggagacauagacaggagccuggacauggacaugaaagccacagaugcauucaacacauacucauugagugcuuacuauguguccagcacugaagaaggcacuggggcuauaguggcaagaagaaguaagugccauggcuuucauucucuagacaauuaggaaguauagcaguguucuuaaggcgacggggaugcggugaauaacuuaagucgauuugccuuucugguagcagcauggaaaguggacuggaccaagaacagugcuagaaacccuguuuucagaaguuuuauuuuuauuuuacuuauuuaauuuuuuuuuuuuuuugcuuuuauuccuggcaugcugugauuuauuuuuagaggugguuuuuuuuuuuugaaacggaguuucacucuuggugcccaggcgggagugcaauggcaugaucucagcucaccacaaccuccgccuccuggguucaagugauucuccugccucagccuccugaguagcugggauuacaggugccugccaccacaccuggcuaauuuuuuuguauuuuuaguagagacgggguuucuccauguuagccaggcuggucucgaacuccugaccucaggugauccaccugccuuggccucucaaagugcugggauuacaggugugagccaccacgccuggccuagaggugguuuuaauacuccaugugguuggacugagaugaaggauacaaaccaguuauagguuucaagccacaagauguggcagaguugagagggaaaagucuaggguguguuuggggcuucuggaugucuagcuggaauagaaacaucuacaggaacaguaacugaucaguugauucaaagcgggucccaauagcagucaucacuuucuaaucuaaaagucauucuucacuaaaguuuguuacugcugacacaaaaagcucaugacaggacucaaaagaaaaguacaguggacucaaguccuucuaguuugcucucugacguuuccccccucagauuguauccaugagcagacaucaguuggguaagcuggucaagaaaggaaauaaguaaaaaaugcccucucagcacauuucucuguguauaacaucauagauucuguaggcccaaucucuguuaguuguuaguuuuaauguuuucuuuacauuucuagcacaaugcuugguacauaguagggacuuacaaaauguuuacugauaaaaauaaauaaaugggccagguaugguggcucacaccuguaaucucaccacuuuggaggccaaggugagagaacugauugagccccacggguuugagaccagccugggcaacauagggagaccccaucucuacaaaauaauuagccaggugugguggcagacaccugugguuucagcuacuugggaggaugaggugggaggaucagccaagaucguacuacuucacuccagccugggcaacggauuaagauccugucuuagaaaauuaaaaaauaaaaauaaacaaauaguuugaaacuuaaagcgaagccuuuaccgaagcaacucgugauagguaauaggaggugguuuagcuaaaagccguauucaaauacagguuauuuuucagagaccacuuuuuccaaagaacucucuaauaaauaacuccucaaaauuaaauuauuucuguuaucaguuugcauucucccaguuuaugagaggagauguuuauucauaagcucuuugggaaagcuaacgugaagaaaaauuagaaagaauauuacugacuaaaaccagguggcaaaugcauuucuguuccaagcaaaugcaagaugauaggcuuucagcccauguuaaguaauaguaguuaagacaauguuguacaauucuuucuuggcauugauacaauccuguuuccagcaaaaugaauggagaaaauguuauauuuguucaucaugauagcucuuugcuucauacuaaacuuccaaauuuugaaugugacauuugauuauacacaucccagguaaguuuuguccucauggagacaaacaccccagggaagauggguuaugguugccucagggaaugacucaacuggcccagacagaaaagcuacugcaugcuaaauguccucaccagccugucaccugauccucaucugcagagaagcaacgggcauaauucaagaacaaaacugauugaagaguugcuuguuucauccacagguucaguucaggcauucuguagugucuagucaugauuucuuuaucuuaaaauaauuaagaacauuaucuuaaauuauaaaaggucaucuaagcaaguacuauaaugucucagaauaaacaguauuguuuauuaauaaaaaaugugacuugaacacaaguugaaagggauuuucaaaauggauggguaagaccuucagggcuugaaagaacuuuauuuuauuauuuauucuucuuaauuuuagagacaggguccugcucuguugcccaggcuggaguguaguggcaugaucauaacuuucugcagcuucuaacuccuaggcucaaaugauccucucgccucagccuccugaguagcuggggcuacaggucacacucauugccuggcuaauuuuuuaauuuuuuuauagagacagggucucacuauguugcccaggcuggucucaaacuccuggccucaagcaauccucccuccuuggccucuccaagugcugggauugcagccaugagucacaacaucuggcccucccuugaaagaccuuuaaaaucauaauuuggaaggaaaaaaacaguauuucuaaggcagagcagaacauuuuucucuuuguuguggcuacuuuaaacuguauaagucugaccccaaacaaaguugggggcagggcucuaugguuguucugguuuucucuuuuuauucuuuuauuuuuucugugcuaagugaaauguucuuguuuucuuagugaagcaaaguucuuuuaucugucaaauuaauaaacuguaagguucaugaacacaguguauguuuuacuccucauguacugccuggcauauaggcuuuuaauaaauauugcuuucaugaaugaaagaaugccuuuccucccaacuucuagauuaaaaagaaaaaaauaaugggaauugaaaauaauuagcuaaaaaaaaugcaagcacaaaauuugaagaaagagagacuagaaaacagauucuauggauaacuauuagaggauuuggcaucuucuuuuccccuuuagaaaguagggagauaagucuucacauuaugaaggggauuuuuuuuuuuuuuuuuaauuuuuaguacagacgaggucucacuauguugcccaggcugaacuccucaagugauuugccugccucagccucccaaagugcugggauuauaggcaugagccacucugccuggccuaugaaggggauuaguauaaguaauguagagacuaaacugagucccuccucuuugcaaauaaaauaauaaaugaaauuaauuacugaugaucagcauuuagguucuauuugaaguuguaacacuaacagugucaaacaccaaaaugagccauagaaggaagugguggugaugcuuuucuucaguaauguuaauaauaaaauguccucaggugaauaaaucacuuaguuucucucuuacagaaugaagagaccuaagagaacauucuccuccaguuuuguaauuaaaaaaacaaaacuagaugauuuauccaacauuuuagguucagauccaggucuagaacuaauaaccccaaaugacagucaguacuuuuucugauucagccuacuuuccucuucggagacauuggaucucaucaaugagcauauuaaaaauacuguguaaagaagaccuuugaagacacagguuugaacuguguggguccacuucugcucaaaauuuuuuuuucaauaaauacagucagcccucuguagcugcagguucuguguacaaaugcaaguccaaaauacaguauccaaaaggccggguacaguggcucaugccuguaauccuagcacuuugggaggccaaggcggguggaucaccugaggucaagaguuugaaaccagccuggucaacauggugaaaccucgucucuacuaaaaauacaaaaauuacccaggugugguggugggcaccuguaaucccagcuauuuuggaggcugaggcaggagaaucacuucaacccagggggcggagguugcagugagcugagauugugccauugcacuccagccugggcuucagagaaagacucugucucaaaaaaaaaaaaaaaaaaaaaaaaaaaaaaaaaauauauauauauauauauauaugguauccaucagaugcaaaauccacauauacagagggcugacuuuucagaucugaagguuucacaggguagauggcaggacuugaguauuugcagauuugaguauaggcagggguccuggaacugaucccccuuguauaccaagggaggacuguacuuacuaagacacuauuuauuuauuuauuuauuaaggcaaaaugauauaagaaauuaggacagucaucugaagaauguggacaaaaauaaaagcaauaucuauugguagaagcagagaaauacuucaccugaauuuccaauuuuuauugaauaugcuaaguaauuauauagcucuuaauucacucaguuucuaaauaccgucaucccucaguauaugcagggaaucaguuccagcaccccuguuuauaccaaaaucugcacacacucaagucccgcagucggcccugcagaacccgagcauacaaaacauugguccuccauacaggcagguuucguaucugugaauacuguguucuuaucuguguuuggcugagaaaagucugcauaagauguggacucacgcaguucaaaccuguguugugcaagggucaacuggauauugucaguuuuguuuuucucuaugugaacucuggguuucagagcuccagcaagcucccagaaugcauuugccucacagcuuugguaccucuuucuuaaagacuuccuccuuguagcugauugucaccucuuagguaugacguuuucuuuggaccauucacuagacauuaggaaagccaaaugaucauagcuuucguuauauauaugucuauuuuaggauguauuuuaacugcuugugaugguaaaaggaaaaauaauaacaaaacaaauagucauucuuuuccccucugacagucacuggcauuaaaaauccuaaaguagccaauugcaucucuaagauuuagguggacgagcucccuggggcagggcaggguggaguggggguggugggcaggcagagaggaguguaguaaguuuguacauucuguuuucaaguacagccguccgcuuuccugaaggguucaaucauaacucggcucuugcaauaugacacugacauuguuaauaguaaauaaaauguuuacuagcugaaagauuuggauaaaagucuuuuagauagggaaauuuauuugcagugguuaguuuuccaauagucuuuaguuucugcuauaggaauguuuuucuuauuugaauuuuguccauuauuucuucugcuuugacauuuaaagaaauaucuaaugcuucuuuucccuuuacuuaagugugugccauuuguccucuggcauucaauaucagaaccuggcagagguuugcugucaaagcucccuauagagugguugguaaggcaacaugcaaauagggagacuggccccauaccccaggcccagucaggaccucugcccagagcuuauaacuccagcacaagccaucauauaugggaacucugucucaucacuuuugagacucucucucucucugaauauauacacacacauacauacacacacacacuucauuugaaaaugaaggcuuuauaaacaagccaagaacugcagagcaacuacugaucucacaucucacuuaagagacaacagagauuuguaggaauagcaaacauucagccauuaagugaggcauacaaaaggcugcuguguuaacauagcccagaaaaccacggcacuucaaucagaacgucuuucuccuugucuguuuuucuuuaaaagaggacccuuccuuuuuguccgauaggaaguacuauucugaaucuaccagcaaggcuggcaugugcucucuuauaaaaggaaaagacuucaccaugcauagccucuucacccuaacugcucaguuguuugcuaccccuggcaaggauguucuaauugugcaguggagggugugaacucguugcuuuaacugcaguuccauuagcuaaucggaguccugaugucagugugacauugugguguaaaucaugaagggguuuuucugccacuuccuguggagagaaaacaguuuugcaggaucaccugaugauuggccauugugggguugucuucuugaaaaagaaaaguuguucugaccugggcugugcucaggaugccuacauuuugccuuugcuaagcgaugaaccccccagaaaggaaguguauggggggcacuguuggagucugagugcucccuucccucagcacuucuggagaagccuggaaauacuguagacacaguuuuggagaagagaauucaaagggcuuacaaaaggagaguacuuuuuuguccacuucucuagaagaggcacagcaacuuguugaguuuguguuguguuguguuguuuuucugccaccaaauuagguguuccuauugugugggaggugaaaaagagagcacaaaucuauuaauaaguaaagcaacugaaacaaagggaaaaaugaauccccauuuugcuuuuuugcaacauuacauccaguuaauaaaagaggcuuacaaauccaacagagaucugcuugcaggaacuaacuaggaagaagaagaagaagaagaagaagaagaagaagaagaagaagaaaaaaaaaauccaacagagaaauuugaucacugauuuaaauuguguuugcagugccuaaagcaagaugaacgauucauucacuguaagucagaaggugacaguaccagguguaccauuugcuauauggcaaaucuacagcugcucuagaaagugaaauagcagugccuguucuuaucccuuaguugacuaccucaucacuggaagugcuguaagagcuucagaaggguggaaaacuaguaaaaaauguccaauugugcaucaaaauuuaugcuuauuaauucugaaauaagcauuauagucuaaacaucauaaaauucuuuuugcuugguagcugcauaaaaguugguuuugaaacagcaaaaccugauuuuccuauuauguggcaauucuccuuccugaagcuggucacaauauuugcuuuauugcuggcuuccucuaaauaugauuacauacucacccacacacacacugccacuggcuggacugcaaagccuagugaagcagaacauuuaccucacaucuuuacccaagagcauugguuaaauuguucuucaugaagucagauaagcaaaagaaauaucccaggguucuucguacaauuagcauucauucucaguguuuaccuuuucauauguaauauucuaauuuagaaaaacacucacuagacacuugucaaauaacugcacauaucuucauacuaaugccuugcugauauauaugcaccugaggguaaugcuggcaaauaagcauuuccuaaaauuuauguaaucauuugaaauucagaaaggauugauuagcauucaagagaugccacuguucaauauuuacaccauagagauuuggcagaagcaaauaauggcauauaaaguugaugcuugucuuaauuaaaugcaguauaauagguguuguggauuuuuuuuuucuuccagugagcaaagcaguuuagcaaugaccagauguaauucauuuuggaguucuaaguuugaacuuaaucaauaugaacuuacagccauggaagaagugauuaucauuuguuauuugcuggcacaagaauauaauugccuaaauagcauuuauuuaagcauauuucugaauaccuuaugccuaaaaauauuugucauauuuuagcuguuaaugcuuaucuugucauuuugcuaacuacugcuauuuagugagaugauuuuucagagacauauuggccaggcaagcuaggaauaaccagcaagaaaaaucaagugagaaugccaugugcucuugguugauguuucucgcugcuuuagcugugucaaccacucuguucaaaucucagaauagaguggcugucuuaguaccagcucagaagagcguaguugguuaacgugguuagcccagaugcugcacucuaguggacucuggacaccccagggccucaggucuguucuacaauggaccaaaucagugacucacaucugagucuugcauuagaucuucuuucuaguuuacugauaaaaaucugauaagucuuaucuugaguuguggcuguguuugguuaagaagguuaaauuucaaacagaccaauccaaagccaggagagaagaacaaauagaaguacaaggccucucaucaguauugaaacauuaaaucacacaaaauauauugaguggccacuaugcagaaccauuguacuaggcaagcuaugaaaugacaacauagagucuuuuuuuuguuugagauggagucucucucucuccagcuggagugcaguggugcaauuuuggcucacugcaaccuccgccuccuggguuugagugauucuccugccucagccgccugaguaguuaggauuacaagugccugcuaccacccccggcuaauuuuuguauuuuuaguagagacgggauuucaccauguuggccaggcuggucucaaacuccugaccucaagugaucugcccaccuuggccucccaaagugcugggauuacaggugugagccaaugugcccggcaagaacuggcaauauauagucuuuccaaagagaaggaaacuccugugauacagagcugcauuuuggauccccaggacacuguucugaauaaggcgugguacaccaagcgaagaguccaaaacaugccaugccaucagcaaugcugcaugcaucucuugucuuucuuucuguuccuuguuuucacugaacuaaugcacguuccacacacaugcuauucuccuugauuacauuuuauuaaucagaaagccuuugucaacccccauguuacauaaaucucacagcaaucagaggcuucaugccucuucaguuucccaacuccucugaaaggagaugauuuuucagagacauauuggccaggcaaacuaggaauaaccagcaagaaaaaucaaguaagaaugccaugugcucuugguugauguuucuugcugcuuuagcugugucaaccacucuguucaacuccucugaaaggaguugggaaacugcaugggaucaccuccaggagccuuagcaaggggcacugucccuaacacccacaucccaaguuacccagauuuuggacagcaccaauguggccucagcccuggaggaacugagucccagaacaucagcauggaagagaaccuaugcuguugcugaauacaaacacgucuuauuucugaguaagaaaauuuaagcuaauggagguuaagugacuuguacacagucauguagagucaggauuugaacugaaauuuuugaacuccacacgcaggaaaagagcacagauauggauuucuauauuacagaaauagugcuuuugcauuuguuucaaaauuagacuuacuauuucuuggccauccuuuucaacuaaaucuaaaauuuucauugugaaguguaaaagugauuucccagaaacguggggaauguacauugccuuuugcugccuuaggacucagcugugcaugcugcaugcuggguacccugaacuuuggagggcagaaucucuccuacagucacucacacuuugacucucuccacuuuacucuggguacauggagcucugugccauccauaaaggucaguguguccugaguggccaugcuggacucaaauugggcaauucugccuaaucccucagcaggaaugaucauauucauuuuguccuaucuugguuauacagucaagcguuauauaaugauguuuuggucacugauggacuauauauauauauauauauauacacacacauauauauauauacacauauauacacacauauauauauacacauauauauacacauauauauauauacacauauauacacacacacacacacguauauauguacauauauacauuauauauauauggucauauauaugauagaagacuauaauggaggugaaaaauuccuauugccuaguauuuacccuacuauauacuuugaaguuauuuuagagcauauucuuuauaccuauguauauaaaagaaaacuuacuauaaaguagccucaggcaggucccucuggggguauccagaagaagguauuguuauaggagaugacagcucuauguguguuauugccccugaagaccuuccaaugggacaagauauggagguggaagacagugauauugaugauccugaccuuguauaggcuuagaggcuaauguguguguuugugucuucaucuuuaacaaaaaaaguuuaaaaaguagauaaauaaauuuaaaaauagaaaaaagcuuaucgaauaagcauauaaagaaaauuuucauacagcuguacaauguauuuguguuuuaagcuguguuauuacaaagagucaaaaagcuuaaagaaauugaaaaguuuauaaaguaacaaagguauaguaagcuaugguuaauuuauuacugaagaaagaaaaauauuuuuuauaaauuuaauguagccuauguguacacuguuuauaaagucugcaguagucuacaggaauguccuguaccuucccacucacucaccacucacucacugacucacccagagcaacuuccaguccugcagucuccaccuaugauaagugcuccauacaggugugcuauuuuuuaucucauagacuguauuuuuacuauaccuuguuuucuaugauuagaugcacaaauauucacuguguuacaacugccuucgauauucaguacagugacacgcuguauagguuuguagccuaggagcaauaggcuuuaccacauaucccggguguguaguaaguuuguguaaguacacucuaugaugaucgcgcaacgaaaucaccuaucagugcacuucucagaauguauccuugucauuaagcaacacaugacuguguauauaagaauugauagcacaccugaaauaauccuuucucuguaccauuuaucccaagagaaaguaauuauuauaguaguguuaauacugcuaacaucuauguaggaauuuuuaagugcagauuuauuuaauuuuuaauuuuuaaaauugugauaaaaucuacaugagauuuaccauuuuaacaauuuuuaaguaugcaguuuaguggcauuaaguccacacacauugcaacuguuaccaccauuugucucuagaacuuccugucuuccaaaauuaaaacugugcuuaugaaacaguaaauucccaauucacccacugcucagccccugcagccgucauucuguuuucuguggagaacauuuuauuuacaaaguacccuauucuuauaacauuauccuuuacacauaacacaacauugaaaguuuagugauuuuauaauacaaaaugugacuggacucagcauggcuaacgugcucaugaccacacagcuaggcaucugagagagcccaugcuccaagccagggccacugauuccagaucugcugucgucacucacaggcaaggaagucuuuugacuuggggccugaaauaauaaagcaugaggccaggugcagcggcucacgccuguaaucccagcacuuugggaggccgaggcagguggaucaccugaggucgcgaguucgagaccagccuagccaacauggugaaaccccgucucuacuaaaaauacaaaaauuagccgggugugguggcaugugccuguaaucccaacuacccgggaggcugagacaggagaaucgcuugaaccugggagguggagguugcggcaagccaagauugcgccccugcucuccagccugggcaacagagcaaaacuucaucuccaaaaaaaaaaaaagaagaagaagaagaagaagaaugcaugaaugaggaaaaagagaggcguucaugacaaguuucuuacuauugaggugauauggccuaauggugaugacugcaaacuugaauucagauucuuguucuauuguauccuuaggaacguguaucaccucacuuuuuuccaucuguaaacuugaaauaauaaugaucuaccugaagcaugauugugaugguuacaugcaauaauuauuaggaagaacuuaccauaauggcuggcacauaguauuaauaagugauuauuacucaaaacaucugugaaagucauagaaaugaaggcugcuuaucgggaaaugccucuucucagauacaaucuuugguuuacagauucugugaaaaagaucuuucucacgucagcaauaacugauacauuaauucaguaccaagccauaguuugaaaucuuugaucuacuaaccaaaggcaucauuauuauccuugauguuuuggaauaugucagaguaagcagacucaagccgcuucacuuuaauucaucuaucauaaaucccaaaaucaagccaaggucuaauaauaaacaauuaggccucuuccuagguuggugcaggcccuagaugaugagaaaguggaauggcuaggcucacaccugcccucugggaaugccuaugcuaggaagcucuucacuuuuuucuuucuuuuuuuuuuuuggagauggaaucucacucugucacccaggcuggagugcaguggugcaaucucugcucaccgcaaccuccgcuuccuggguucgggcgauuugaacacacacaagaaagagcacagauaaggauuucacuuaacaucaugccuggaauaaaguucauauuaaaaaacaauacucaguauguucgauuauaauagcuacaucuuauuguccuguaugagcagaguacauuauaccuguuguuucuaaucuucauaagcaagccuucgaugaaaguaucauuugccauuccuguuuuacugucuuucccuaagaucagagaagucaaacaacuauacaaaauugcugagcuaguaaguaauagaacugggauuugcacacuuuagucaucaaagucuagguuuucuccacuauucacugcuacuuuucugguucauugauuaaguauguagaucagaaggcacuauaccagugcuugucauuuaugaugaagcuaacccauucuaaaucugauccuucuagauccuacuugaaaguacaagggcugaguaacaauccugccuucuuaaaugcuuaauaauucccccucaucaacaugccaugguuucagucagagcugcuuucuauugaucgguuucaagaaguaucacagcuuuuaucaccacggucagaagcacugcugaaauuauaggguauuuaaucccuuaugcuggccuacuuacucuaagcagauuuucuuuucuuuaucuuuuuuuugagacagagccucacucuguuacccaggcuggaaugcaguggugugauccuggcucacugcagccucaaccucccugguucaagcaguccgccagccucagccacccaaagugcugggauuacaggcaugagccacugugccuggccagauuuuauuuuauuuauuuauuuauuuauuuuugagacagagucuugcucuguuaccuaggcuggaguguaguagcacaaucucggcucucugcaaccucugucucccagguucaagcaguucuccugccucagccucccgaauagcugauauuacaggugcacaccaccacaccuggcuaauuuuuuuuuuuuuuuuuuuuauguuuuugguagagacgagguuucaccauguuggccaagcugguuucgaacuccugaccugaagugaucugcccaccuuggccucccaaagugcugggauuacaggcgugagccaccacaccuggcccagauuuuacuuuuaauaugaagaaacaucugcugucuaaauuccuauccucuuacaaauauuuacugugaacagaauuugauaauugauugaaaaucauuaccagauuauuagccuagauuauuagcagauucucccuuuccuaauauugccagcaucaaacucaauggagugaaagaagaaggaaugaagauuaaaacaugaauuuguguacguuuuuaaguauuuuaagaauaccaaaauaaaagugucauaugaauuucuuaguauguuucugauauagacaggauagaguuuaguaauuagcaauuucuucuaauuuuuuuuaaaaaaaguuuauuguuguuacuugcuacaagaaauuaugggacaaauuggauaaccacaugugcuggcauuuguccaggacagcccauaucaaaagggauugggguccaugauacuguaacaguaucauuucuaauuauaacuucaaggaaauuccucucucaaagagguagcuaagaaacuuauucuugucuuacaaaagaauaggguuuuuaggauuuaaaaacagguugaugugccauuuuuccuccaacuuauguauuuuagauucuauuuugauuuucacugauccaugguauuucguuauauaauguaccccacaguuuauugauucauucuccgauugguggauauuuauuacaaacaauguuaaaagaacauuuuucuccaugucuuccuguaauauauuguuggacaaucacucuauuguuggacaauuacuugcaacucuagaaacugucaaaguguucuccaaaguagcuguaccaaauuacauuucuaggcguaguaaaugagagcuucuauuuuuccaugucaucaccagcacuauaauacagaugcugucauuauucuguuuuaauuuguauuucugauuaccagugauauugaacaucuuucuguuucuuugaaguaccuguuuaucaauguuuuuccauauaauuuuugcuuuuuaaauuuucuuaagaaauccuucccaaccuuggaggucuuaaaguacauucuccuuuaauuuuuuuccaaguguauuaaggccuugcuuuucuuaauaugaaucuuuaauguccagaauuuaauuuuguguauggugugagggggagaucuaguuuuuauuuuauuuuucuuaaggguagucaguuuuucccacacugcuuacugaaucgcuugucuuucccacuguuuuuaaugccaccucucuuauguauucaagaucuguauaugugugggucucuuucuggacuuucuacuuuguuccuuuggccuauuugauuaucucagugcuaaucucacauguuuuaugcauuuuuauaauaaaucuuaauaucugcuugaguagucccuccaccuuuuauuucaaaauagucuuaauuagucuuaggcuuuugcuuuuccacaugaauuuuagguuuggcuugcuguuguuccacaaagaacccaguggggucuugaguaaaauugcauuguauuuagagauuaauuuggagaaaaauuauuuucuugggaguauugagacuuucccguucaugaacauaguucaucuuuccuuuagucagguguacucugauguccuucaauaaagucauacaauuuucuccacagagguauuguacaucauuuguuacuaauuuauucuagcuauuauauagaguugguuuuuauaaugcaaaccuuuucuguaguuaauauccauguggcuggauauuuuuauauugcauuuuuauuuaacaaaucuacuaaaugcccuuauuauuugaaauggcuuuucuguaauuuaucuucaaccuucuguguagacauucauagucugaaaauaaauacagauuuaucuuuugcuuuucuggauuccauuucugaucuuauuuuguugguuagacaauauugacuuggugugauaacagguacucuugucuuauuucagucuuuuauaggaaucauucuaaagucaaaugacuugauaugaaaaguguugucuauuuuaguagucuucuuuuuaguagaaaaaagagaagaagcuauugaucuuggagagagauccaacagcuauuuuuucuuugccuuuuauuucaacaaauuauucucuuaucuuuuguuauuuuauuguucugguucuagcuucuucaguugacgauuuuauucaucuaauuuucagccauacauuuucauuguucuuuuguuuuguuuuguuuuguuucucauuugaugaaagcauuuaguauuagaaaguugccucuuggcacagccauaguuguauuuguggaaguuuugauauuggagacagacauucaaggcugcuguggguuuaugcaagucacuguacagaacucuagggggcaccacucacacuauaguauauaucaaugcaucccuaagaguugugugguacacaacaccaguagcccugucugguagcccuacguccagugcuaaauauuuugucaucucgauuguaaucgagauuuauuucacaauggguuuuaaaauuuccaaacaaauggagguuuugauuaucuuuuuauuuuuggauuauaagaugauuucacuaugagguuaugcauauuacugaaacuuucuuuugaugugauauuuaguuaauuuuaauaaauauggcauauaugacacagucucaauuuuagaugucaguauuuauuucuuuauaucauuauugauaaauuuguuauaucuucuguguagauuauuucuuuuauuauuaucgugugcuucuuauuuucuuucuuucuuuucuuuuuauagagacaaggucucacuauguugcccaggcuggucucaaacuccugagcucaagugauccucucgccucagccucccaaagugcugggaucacaggcgagcaccaccacaccucgccacuuauuuucuuuuaauguuuugaucuuuuaaaucugcuuugucugauauuaagaauguuuuaucagcuuuuuaaaauuaagauugacaucuuuuuucccauucuccuuguuuucuccuguucaguugauuuaguggaguuucuuguguuucugugauuuaggugguuuuccuguaagcagcagaugucuauauuuuauuuggcuuuucuuuaaucuagccuacaaucccuuuaaacuuuuaaauuugagaucauuuuaaaucuacaggaaguuggauguuaagauacauauaggggagucccaaguacccuucauccaauuucuccaauggcaacaucucacauaacuauccucaaucuaaaaaucagaaaggcagggcgcaguggcuaacgccuauaaucccagcacuuugggaggccaaggugcauggaucaccugaggucaggaguuugagaccagccugaccaacaugcagaaacccagucuuuacuaaaaauacaaaaauuagccgggcaugguggcacaugccuauaaucccagcuacuuggaaggcugaggcaggagaauugcuugaaccugggagguggagguugcagugagcugaggucaugccauugcacuccagccugggcaacaagagauaacuccaucucuaaacaaacaaacaaacaaacaaaaccaggaaaauggcauugguauagucuguagacuuuaccaauuauucaguuugcauauuucaccaguuuaaaugcacucguuuguguguuuguauguguugggggguggguucuggcaauguuaucacauguagguucauguuacuaccaacauaaucaugauacagaacuuuuucaucaccacaaguuuccuuugcgcuagcccuuuuauagcacccaccccucccuccauucuuaacaccugacaaucacuaaucucuucuccaucucuguaauuuugauauuucaagaauguuauauaaguauauaguauguaaccuuuuggaauuggcaucuuucacucagcaauauuccccuaagauucauccauaaguguaucaauaguuuguucauuuuuaugauuguguaguguucuuugguauggauauaccacaguuugcuuaacccuucacuuauugaaagacauuugaguuguauacauucaguuuugggguacuacaaauaagcugcuaugaauaucauguauggguuuuuauguaaauauaaguuuucauuucucuuggauaaaugcccaagaaugcacuuguugggucauaugggaaacauaggucuauaaucuauuuuuuaagaggugaguuugaucuauuuacuaauaaaccauccuaguuuuuguauguaggaaauguuuuaaauuuggccacuucuuggaagauaguuuaggugaauauaaaacuugaaguugacaauauagucucuuaacacuugggaagucuuuuggaagucuacugucuuuucuuuuugauaauuuuuaagguuuuucuuuauugccagugucuuauauacuuuuacuacaaggugucugaguauaccggaagugcacauccaauuagagggcacugaagaauucugcuauucucuuuucauaugucacuucuaugcaaaucccucugcuaacuccuaucaggcauauguuggagccucacagucuacugugucuucuaguuuuuaagcuuuuuucccccuuuuaucucacugugcugcuuuuugcauaauucccucuucaacuauauccagucuagcacauauaccaucaacuuaguguuuugaauaauuguuuuuuguuuuaaagacuucuuuuuuuuuuuuuuuuuuuuuuuuuuuuuaagauggagccuugcucuguugcccaggcuagagugcagugacacgaucucagcucacugcgaccucugccucccggguucaagugauucuccugccucagccuccugaguagcugauauuacaggugccugccaccacgcccggcuaauuuuuguauuuuuauagagaugggguuucccaucuuggccagguuggucucgaacuccugaccucgugaucuacccgccucggccucccaaagugcugggauuauaggcgugagccacugcgcccagccuaaagacuucuuuuuuuuaaaaaaaaauuauuauuaucauuauuaucuuuagagacagggucucacucugucacccagccuagaaugcuauggcaugaucauggcucacugcagccucaaacuucugggcucaagcaauccucccacuucugccucccacauagcugggacugcaagugcaugccaccaugucugucuugcuuuaaagauuucuaauagaccuguuuucccauuaauguuuaaauuuggcuucuauuguuucauuacguaucuuuuaaauuuuuucauuuuuuccuuuuuaauuaaucaauuuauuuauuaagauuuuuuucuucuugccuugucuuauggcacugauaucuuucuuuuuagaugaauaauaucucuauuucucucuuaaacaccucaagcaaacugauuuugagguuuuugucagauucuuccauagaaauaauuucuucuggagugaguugauguuuuauuuuugcugacuuuuuccuuagcaauauauaucuugcuguauaugcuguauguaaaaaguguguguguaugugugugugugugugguuuuucacauuauuaguugcagacuuacuuugaguaagacuuuugguggcugcucuuguuuccgucucuuucuccugucuuguguuuucuuugcuacacacacugugcucacuccucugcauuuagcauuucuguauuagcuucugucugacucuaugagauccugaguccagaggcaaguccuauaugguguuuaggcuucugcacuguggucauacugaagauacuuuagauccagucacagaggcagugggggcccugcuuuaacucccaguccggggauauauuuuugcccugcuaccuugccuaguuccacagcuuaccaaaucuauagcuugggcaguaaauuaggauuaguuuuguuuuuuuuuucccccuucuuucauuccuucuaauagccuccuuuuacaaaaggaguggaaguuuggaacuccugccccagcccugcgccaugcuuuacuuuaagcaagaccuagcucugguugccacaugcaugguugccacacuuuaggccccaacacccuucagaagcuggacuccagcuacuguucacuggacuccagcuauuguucauaauuuuuuuuuuuuuuuuuuuuuugagauggagucucacucuguugcccaggcuggagugcaguggugcgaucucggcuccugcaaccuccgccucccgaguucaagcgauucuccugucucagccucccgaguagcugggauuacaggcgcgcgccaccaggcccagcuaauuuuuuuauuuuuaguagagacaguuuucaccauguuggucaggcuggucucaaacuccugaccucauguuccacccaccuuggccucccaaagugcugggauuacaggcaugagccaccaugcccggcuacuguucaccguuuaaauccuggccacugcucugcauuucugcucuguuugugacagagauguugacauuguuugagccuagcuauguccuuuucucucccuuuguauuuuucugucauugauauguuuguaacaggaagagugcaccaaaaugagaauucaccacaauauuuugacaagaagcacagcauaacucuucuguuuccaaagagccugaaauguuugaauccucccaucaccaccaaccaccaccgccaccaucaucccagcacuguuucucucucucucucucucucacacacacacacacacacacacacacacacacacacagaacaacacucaaggccaggaucuccuaaagccuugugccgugggucuccggucugccuuuccaaguuugugucucaccauucuccuugcccaugucagcacacuguugcccaacaaacugagcaauuugaucuuccuggagccuauucuauaucuuacuacuuuggggcuaguuuguguucugccucucuucuugaaaugccauucaaaacaacccccagucuuucaagcucagacaaacucuuccucuauggaaagaccuaucaaaucugccauuugggaaagaauuucccucuucuauuaacccauuacauuguuuccaauuuuuauuacauuugccaugaucaaaauaccauuuuaaaacaucuuacccagucucaaacacuuaacauagucuuauacugaagauguuaacuguuuauuaagaaacucuuguguacuagaugcuguccaaggccuuuuuagauacaucguuaucucauuuaauuccuucaccaauuacgguaugaggugaaauuugcucauuuuacagauaaggaaauugagcgugaguaagucuuacccagguccuuaugaaacuagcagauuccuaagaccucucugagaccuacuaaauaggaauugcuaaggauggggcccaggaaucugcauuuuaaccaccucuuuauaugaugcucuagcacuccuacuguuuaaaccucguugcucaucagaaucaucuggggguugagggagguggcuuaaaaauauucagaacugggcgggcgcaguggcucacaccuguaaucccagcacuuugggaggcugaggcaggcggaucacaaggucaggaguucaagaccagccugaccaauauggugaaaccccaucucuacuaaaaauacaaaaauuagccaggcguggugucacgugucuguagucccagcuacucaggaggcugaggcaggagaaucgccugaacccgggaggcggagguugcagugagcugagacugagacacugcacuccagccuaggugacagagcaggacugucucaaaaaaaaauuuuuuuuagaacuaccaaauuggaauuuccagaguaauggcaauuuuuuuuuuaccaguuucucagaugaguaugaagcaggugguucaccaauuccugugugaaauauaccuaggcaaaugucagaaacugguaggccauugauagaauuuguguguguguguguguguguguguguguguguguguguguguguguuauaaaggugacucaacauuuaaaaucaagagaauccacauaaaauaugaauuccaguuucuuucuaaaaaauuagaaggucggguuacacuagguucuuauguugcagguuuguuugauuauuuuuuaaaggcagggucuugcucuguuguccaggcuggagugcaguggcaauggccauagcucacugcagccuugaaccccugagcucaggcaaucagccucagccuccugaguagcugggacuacaggugcaugccaccacaccuauaggcuaucauguugcagguuucuaggugccuugauacuuugaugucccuaauaaugaaaguaacugcaagaagggcagucaguuuaugccugaacauaaggaaaaauucauauauuaggagaacacuguacacagauauaaguacaccagauaaaugaauauaagcuuuacuaaagauucauuaccaaauacaauuuuacucuucaaaaauuuuacuuaucaaaaauuuauugaagauaccucauaaucucuucccuuuaauaaaaauuaaaauguaaaugaaauaaaauuauaggauuccuaaauauuaaagacuacuaaguacaagaaacaagauuaguaaauauuaacaagguuacuaaauaucaaccaugagauucuugaguuucuaauuugccauucacuugcagaaguucaccugugaguuuugcauugguagauaaagaaauucaucuaccugcuacaauuggccucagauucuaggugaaucugaucugucuacagcacuccaaauauaaagaagaaauaaugauaguuucacuuucuguaacccuacucaguggauucuguugcucuacuuguuuagcuguaacuacugucagaaauuuucuguggaggccaacacaggauagucgguuuuuuaaugugauacaguugugauuguaacaggcuguauaaauagccaucaguggguaccauggaaaccaccuggaauucuuuaucucuguccuagaaaguacuggagcuuuuguacagcaacugaagacauauuuaagaucuuuccaaguaauaaaaaaggucuuugugcauuuuaaacauuaaauaaaauuaaaucacaaauaauuauuaaauagcaaauuacuagguuaggcccuuucucuagcucucugggaaucaugguuuucagaccuaugguucucaaacuggggcuggaagucaaaauuaaugaacaaauuaccccaaauauucuuaguacuuucaaaaauuuauuuggaaauuacacauuugucugcuauaaaguugcaaaggcuaaauaaguuuuuacugauuaaaaauuuacauaauaauuuacuuaucaaaaaauuacauaauaugacucauauucccuuguaaggauacauaaggauagagaacggaaaauguauccuuauguauguauccuuauccuuguauccuuuuuuuuuuuucugguuccacuuuguuuuuauucacugaaaccaauaaaagaguugaacacagcaaaacuuggaacaacaaggaauuaacuggguggcagcaaagggcaccaaaagaaaagauaaauugcccaaaauaaauaagggcuggugaggaaaauaaaaaauguuuccgaaaaaagugggcugugaugcaagguacugugagauaaagaagcaauuguuucacgcaaaaaauagaggggggcaccucgcugaagccagcgaggccgcugcaccacguggugucaggagaccuuagcaauggcccagguucgcuggcugcaucugcugugccaggcgccuacugugcgcuccucuccucauccagcaaagcucggccuacauggagguuugcugacucccccaggccaccuuaguuccucucggagucuguaugggucugggcgagaugcaggcagcuuaucuguuuauggggcugccuccuccaguacacggagagcucuuugaggcaagggacaauuugaucuguuucuucauccuuaaaauuucugcugcuuuugcuguuucugugauuuccuugguuucuccauuggugugcuuaaagcgaucuccucuacacgaacgcuagggcagagcacauuuucgcacaggcagcgccgcagcuugcccuggaucuugucgauugaguugaagucggacacguggaagacauggguggacuugggcuccgaggcgaucuccuccagcuccucccugagcgccucucccacguccacggugaagacgcggaugccggcgcgaaugccggcacggaugccggcacggugggcagccgccguggcguccagcaccagguccuggcugcagccauuggugagcaguauggccaccugcuuguaggcgcaguccccggagcgguggccggcgcgcggggagaagcugcgggcugugauguggugcagcgcuucgccgguguugguguugcccugugguaggcgaugcaucgggcggccgccuugaccuccucccgcgagccgaaaacgcccaguucgaaggccacguugggcaggucgcuggagcgcacgguccccaugcagucggggcccgccucgaagguauccaccagguugacuacccacugcugcaccuucucaaaguccuccuugcccacgcuggaggagguguccaagaggaagaccagauuguaguggacgcuucugcaaccuguccguugggccuaucagccgccgccccgacuccacagcggcagcauccaaaggaagccggccacagcauucccucggagggcagccauggcucuccuguucuuggggacaggcuuuucuuggccauuuaggccaagaaagacgcaguuagggccuacugcagcauggccuagcagggaggcacucgggcugccagcaggaguccaauccugggcccaggcccacuggaagcagcagcugggagaagacaccagccccaggcagcccccuccugggggucaccugccagcaacucgcccacucuccccccaauaaucucacaaacucagacucuagacaagacuugcaguaagucuggaggcuuuccccaggccagggggccagagaggauacauacauaaggauauguaggggaaaauuagucaaaaauaaagaaguuaagugaagcgcaaauuugagggaaaaaaacuuuuaaauaaaaaucucccugguaaacuucaaauucacuaaaaucauuucuauguggaugauuuucucuuuucuuuaauauauuuuaguagcuaaauaaucuacacaaaugagauuuaaaaauugaacuccagacaaauggaaacgugaaggauccuaugagcauuuccuguccuuauaaggguggagguuuuuucuucuucaucuuuuugucuccaacuccuagcccagucuuuggcaugcgguacuuuuuuuuuuuuuuuuuuuuccuuugaaaccaagucucgcucugucaccacgcuggagugcaguggcacaaucucaacuuaaaacaaccaacaacucuuggguucaaacaauucuccugccucgaccucccgaguagcugggauuacaggcaccugccaccaugcccaacuaauuuuuguauuuuuaguagagacaggguuucacuauguuggccagacuggucucaaacuccugaccucaggugauccaucugccucggccccccaaaggcugggauuacaggcaugagccaccucacccggccacacgcaguacacuuuuagacagagucuacuuugcacuucuuggugcuguuuacuggcacacauauucaaaagagugaccauggcugaugagugugggucgcaauaacugaugcguggccaaagguguuucccacaacaguuggcuuugauucaccguguaucuucugcacuggcuaccguguaguuaugccuugcccuucauggguccugggauuacuugacugcugccgaggcuaacagccucuuuuuuauucugauugugacccauuauauuagucuguuggccacugacucacuaguacuuggaagcaacccacagcuauguugucacauccacguauuccccucaacacgcagcaaauuggggugagaccaaggaaaggcccaugcacaaaggaaccugacagcugucagcaguagcaccugaggccaauuguaggcgguaauagcacacacucagaaaaccauacgccagcagugugugugcaucacaaugccgggagugcacauauugugggcuccucaucaacagggaacucauccugcauugcuuuuauaucccaacuguacuuagcacaagacuaaccauacaguagguaucugugccuauaaugauuucaccaauauuucuacauaugaacuacuauucaucauuuagggucucacuaaauguugcuucuuugaagauauuugcuugaauccccuauggcauuuuguaguuaccuccaugcaguaaugauaauauccaagucauucguuccagaguuuauaucacuuauguaaagcguauaacuccaaagcuuugcaauagguguucaagcagcauauaauggauggauggauggauggauggaugguugguuggauggauaaacauuaauugcuuagaagccaaguggagcaauuugaaggagcacucucuccuauacuucuuguuuuguuaugucaauucaugaaauccccagaaugacacauaaaaggaaaccaaaaucaaauuaaaacuuaugaaccuaaaccaucuugugucauccuugguagacauuuaguggaggaaauaugaaauuguacuauucauucaaggaguuaauagguaaaccaguuuauccaucacuaacuuguuuuuauagcaucaacaugguguaaagacaaaaacaaucuugaacucuaguaacuaucaucuauauuuaaugccucuaugcuacaacaguaagacucuggaugauuaucaguaccacuuagaauuagagcuucuuguuaaauaauucauacauuugauggggaagagcuucaaacaaugcucaaagcuccaguaauuaaugggcuaauuacgagaugcuuguaaaauggcuuaaacacugaaaguucaguguagguauaauuguuuuagaguuaacccuguguauuuaaaugucaaaaaaaauauucagugaagaugaguagaggguugggagagagaagagagaucauaagauaucacaccaguuuagaagucuucacuauugauuuaagauuucuaaaaaggcucuggaaaggcagaaugcaggccuuccuaaugccccaggcauuuuccaaccaugucucuaaucacauaagaagaacaucacccaugagucauaggacucuggguacucuuagaggucagaaaccgcugcagugcaaguccuuucagccuaaucgccucuucacuagcaacgcccagguuccacaagagugcucuguuucauuccaggacccgugggaguuaagaauugaagguaguugauuuuuugguugguucauuuguuuguuuuuccucccuguuguuugcuguucucagaaaugaccugcucucugagcuuucuuggaguguaaggcauuucaauucuagaaagguggggcugggaggaaaauggucuccuugacugcaaaccaucuagcugaaaugucuuucacucaucccacuggaagggggaaaaaaagccuucuuuagaagaugaaacauugucuugugucuuuuagcaucguucugggcagucagucuguuaggacauauugggcgauuauaggacugucuuuuuagagaaagccauggguuucaaguuagcaggaaccaucuaucaauucuuaagauuaugccaugauuuacugucagagcaucauguauucugauuuucugccucccaugaaacauugugcuuuccuuuucuauugauguaucaacuauaauaguuacaagcagcuacagaaaaaucaauagcgagcuuucauuacuguguacaucaaguaaagagccccccgcugcaagagcacaacuuguuagaugcucaccauggaagguguacaacacucaacuguuuuuuucccagacugcauuagaaaaaucaacuauagaaaaauuauaaaauaguaucauauucuacauggaagcacagagacccuauaaaaucucucaaagggaauggacaggaggcauuaucauguuucaaaaugagcacagcauuuccaaagugaauauaaagguauuuaaugcgauuccuacgugguuuuuguuucugguuuucuuuugcauuugucuucuuaaggucaucaggauagugggaggaaauacugaauuaguauuuacuagauugacugcguaagcagaaagucaccacuggcugaagugcaugcugcaauagucaugcgcucaacacccagccaagcaaugaggacccuaagaacugugugaauacagaguaauauuaccagggucuuaaucagauccaggagucccagacauacauaugcaaaguuuuauucucuuuccaagcacauguuggaaaaagaaaaagacuuaggauuuuaaagcaacaaauaccuuuauuugccuuugggagcacauuagcuaccaauuagugcauguaaauugagacugcugaaaaagagaauguaugaacugauagucugggugggggacucucaaggccucagaaguucucuagcauuucagcaucaauuugggcaacauaaagagauuuccaaagcaaauccuaacaaguccugaaucugaaccauguacaaaucauaaaucccauggaauucccaaucuuaacaugugcaaugaauguauucagaucuauauauuuaaguaauuaguucauuacuuucugauaguuaugaucuacauaaagguuuuccauauguuacuguuaugauccaaguccaaacuccaguuauuuuuuaucuuuagagauaauauauuuagcaagaaggcaaaaacgugccugauaauuuuuauguucauauaagaauguuaagaaacuacaaaaauguguuuugaaauauuacaguaacaaacaggaaacaaacuaaaaccuugaguaccagguuaacuuccccaaaauaccauuuuaaaauacugaugaauuugaacaagugguuugauuuuugggcaucuguuuuguuuuaggggaagggaggaauauuuaaaugauaaaauuuucaaauaucccauuuuuuucauaguuuucccaacuuuuguggauuuuuuuucuauuucguuuuucuaugcacccaaaaauuaugugagaauuuugcauuugccuuugacauucuaacaacagaaugaacugccauucagcuauggucacuacauugagaguuuaaugcuccaaaagguaugcucugcaaggacugugaaaagauuaauuagucuuugcugguuucaucagaggaugcugagaaacuggcaacaggcucucuccugcaccacagcccaagaggaagauccucuuuuccccagcaaaccagguagcaaugacaucugcaagguuagccuuucuauuugccagugucccugacaauuaaaacagugaaaauaauucaugcauugccaaucuuaauuacacucuugcuuucguuuauuccuuuugcuacuuuccuggcugguguuuugcauguuacuuauaugcaguaguacuuaucuaaagccuacuuuagaguaguuguccuuacaagaaauggaagucuaaguagaguggaauagcauuuggaugauuacagauucucugugaauucagcuaacacuuuccucaagguagcacucaugcuccuguuaaaaguacauucuuuccacaugcuuuuuucacauaguuaaaaagaaauccuuccaugacauacugaacccuaauaccaaauaagcuggugcuuccccugagccacauaggagaauguuggcucugagaaugucgcagcaucccugcacugcugugaugugcagucaacagaggguacgagcucuggcagaaaacccagaacaggauauuaugcacaguaggggcuuuccaacccagcuguuccaagcccuauagggucaaaaugauggggaaauccagaaugacaguaauuaugccaucaaccuuacggcucccugccagagagguugcugguuagacaucuauacaucuaguagcuguuuaauacauuuuuuaaaacagguauagugaaagaaugcauuuuaagcaggaauugaaaauguacuaagaaugagacaauaauguaugagcaaguacuuacuuuguuucuuacuuuagguaagaaaaaauaaaaggaaggaggaaagguauggagggggagauagagggauggagggaaaagaaaaggaaagagaaguagauagaaaaucaaacacagaugaaagcaaagacaauuaugauuauaauuauuucauucccuaaucauguaagauuugaauuuucuaauuaagaaaaaagaacaaaauuaguucauaugucaaaaagaggauucuaaaauugcacugacauaaauguuauucugugauucaguugcauucuuaaauugguguguuauuuaugcaaauuaugguaagaaaaauaauuuuggauauuuuuguuuuacaaauauauuuuucacuuucaccacauuauuuccagaaguaucuuuccuuccacagggguucccugucugcucuugcuuccuccagcuccucaauauauguaccuuucaggguuguuucagcaguccugaaguuguguguguguguaagcaugauuaagaguacuuuugugggagugugcuauugccagccucacagaugguguuauuuccuguguuagacuuccuacuuacugauagcugggcucacacuugacauccucucuuaacugccucuagaccaaaacaugcaaagucuugcagugugggagggaaccuguggcugugcauuggguucaguugauaacaauaaucaccagcccugaugagucaccagagagcaauggggugauacucaaguaccagagagauggugguggucucugguggccccaccacuguccaccacuugcaaguagauaaacuggucauuaaaggagcuguggagagccagaugcaguggcacaugccuguagccccagcuacugcagaggcugaggcaggaggaacacacaaggccaagaguuugaaucugaccugggcaacauagugagaccccuaucuuuaaaaauaaagaaauaaguaaauuuuuaaaaagaaaggcauuaugagaguuucagcagaacauuuaggaagggucuucuagagauaaugauggacaagucaguaagcugcuuguucacacacuaauguccaguucauguugacugcuaucuacccacgucuucucuucuggcaccugccuuaguggcuggaagcucucucagaagcuuaaaaagaugcuuuuauuuuaccuacccaacaagguuucuacgcauuccagccuccaaggaggggugguuccccuuugugaacugagauuuaggaauaucuauguuuacaacuccgggacuaagauucaauaaagcuucaggaggguggaagugcagcuugugagggcaaaacuuuagaauccaguggacuucuuaaggucaucugaacagugagaguaaguacuaggcucuuaucccacuuccaccaccaaccaaugcagaagugggauuaagauugauaauccugagauagcauuaaauguuuugauacaggcaugcaauccauaauaaucacaucagauaaacaguuguucugugcacacaaucuaacauuuaugcauuuuuucuuuaaaaaaccuuucugcauccaaauggcacauucauuaaguuuaaaaugaagcacaaaagauagagauaaaaugaagcaacucuauaauuauauaaauuauaaaucuuacuguaauaauuauacaguagacuuggagaaagacaggccuuucaagaauugguuuuuagagaugugucuaaugccuuaaagaaguguuugcuuuaaaaucuugaaaaagccucauguagaagugagauguuguaaagucaucauuggcuuuggccacugccaggucgacuaccaguuugcuauuugugauguauuucacuauuuuggaacuuacaaagcuauuccugauuuccuucuguuaauggaggauuaaugacaaugcugaauccacagauaauaauaaaaaaauuuuuuuuuuuuuuggacagucucacucugucacccaggcuggagugcaauggugcgaucuuggcucacugcaaccuccaccuuuuggguucaagcgauucuccugccucagccucccaaguagcugggauugcaggugccagccaccaugcccagcuaauuuuuguauuuuuaguagagacgggguuccgccauguuggccaggcuggucucgaacuccugaccucaagugauccacccgcuuagucuccccaagugcugggauuacagaggugagccaccgcgccuggcccaaaaaucaaauuuucaacaguuacuuaaauccacuacuucccaagaugaaagcuuuauuaccaacugaaacuuagagaacuaugaguggucgugggcugccucugaacuugcuguggguauauuuacugagccaccaugggggucaugugaagagucuaggguuuuguuuuacauccuuaacacuucaguuuugaaaaucccuauaagacaguaauaguucuauaggguaaacuccaaagagggcuucuguagggggcauaggaguggcacccacaguugugggaacgucagcaaaccugcauccucccucaggggagaggucagagcaacucagaauauuaugacuacugaaacaacuuuuugacuucacgaugcugcaaagcaauccacauccaguagaaaccauacuucaaguacccauacaaccauucugguuuuucugagacggagucucacucugucacccaggcuggagugcaguggcgugaucucugcucacugcaacuucugccucccggguucaagcaauucuccugccucagccucccaaguagcugggauuacaggugcccccccaccacacccggcuaauuuuuguauuuuuaguagagaggguguuucaccaucuugaccaggcuggucuugaacuccugaccucgugauccacccgccucggccucccaaagugcugggauuacaggugugagccaccgcaccuggcccauucuguuuuuuaguuucaguacaguauucaauaaauuacaugagauacucaacacuuuauuauaaaauaaguuuuugguuagaugauuuuguccaacugugggcuaauguaaguauucugagcacauuuaaggcaggcuaggcuaagcuaugauguucagaagguuagguguaguaaaugaauuugugauaauauuuucaacuuacgaugggcuuauugagacauaaccccaucguaaguuggagcaucuauauugccgacaucuuaacagagccgcucucuguauaugcugacugauacauuaggcuugggauaaaucauaucugaccuuuccuuauaauagcacuggguggacuucaaagguggaagagauauuucuuguucaauuaagucaucauugcagaaagaugaaacagaugauacuuuauaagccaggcacuguccuaccuugugguaauuccuauuaaaacacauuuaaaagauuaggaaacugaaacuuagagcaauuuacuaauuucaaugucuuauggccagugcaguguucacggauuuaaaaucacuucaaugcaaguaucaauaauucugcuaaauaaucaggaguugacuauaauuaaucugcaaaaaccaaacaauuuuccccacuugaauuaaugauuucugggugugaaagggaauggucaccacauagucuuaguuuccuuccaugcaaaccuuagaauugagcauagcacuuacgaaaccaauaugaucagauaauaagauaucuuacuauuaucacugucuuagcaaaaucugucauuacacugaaaaaaaaauaggauagcuucuuuugcaaauguuucaagcuccaaaaguucuuagaauaaucuuucuuguuauuuucucugccacaugguuacacaaauacaaaacaaauuggaaauauggauuuucugucuuucauauacaaauacauaucccugagcaauugaaugaauuauuaauuuguuuuguccaaaaauggauaaguauuuggcuuuaaugaucuuguuaggcaacuaguuucccuucccuuauaguucucaacuccagagacccucucuuuucauuuuucaagcaaauaauucagaaucaguguugauccacugcaugauuuuucccccuucauuucaaccucugaucuuacugagcagaauuuuaauagcuaagggaaaugauguaauaauaaguaacaaguauaucuagcucuuaaagaguagcuuuaauuuaacucuacaaacucauaaaauauuggauauuuagaaugaauguagauaguaacaguucucauaugggcauaaaauugcaagaauuuuacugauugugauguauuacuuuuagcacaaauagaauguaccaaguacaauaaacuucacuaauucaggacauuucaacuuggcaacaaaaagcucaauuuauauguacuuaaagaaaugcaauuuuaguaaccucagucuaaugcuuaauuaaaguaacauguuaacacaguggggcacaauuaaaaaggaguugggagcaucagcuauaauauucaaauaccuaguuuuuuuccaauccaauuaaucuauuuugugugucugucucagaaaggauaguaccagaccugccaaagguguuggcgggagugagauaaaguagaugcaagggguuuaauaaaaauucaaagaaugacauaaauauaaaguauuauucucagagauuacaauucacaauuagccugcauuuuauaaaauaccucuaaaacaucuucaacauuuaaaaauuggauguuaaaauuggugauacauuaauaauacucuucauuccuugaauuucugauucuguugcugacuuuagauagaauuuauuuuucaucaguuacauacucaaaggcuaaaacaggaaggcauucuuuuuugagacaaagucucacuaugucacccaggcuggagugcaguggcgugaucucagcucucugcaaccuccacagaaaggcauucuuuaaacuucuuauccaaaauaaacccaaauacaauuuccgaaguagcauagaguucaaguugcugagucuuaccuagugaaccaucagccaacacuguagaacaucauggugcugccauauaguguauuucuugcuguuaggaaagcaaaauucccuauccuauucugcauucugguauugaccugaccuuaauauguuugauucuuuuuuuuuuuuuccuaauagggacagggucucugucacccaggcuagaauggcccgaucacaguucauugcaaccucaaacuccugggcuuaagcaauccccccgccucagacuccugagaagcugcaugccaccacacccagcuauuuuuuuuuuuaauuuuuaaauuuuuugucaaaaugggaucucacuauaucagacuggucuccaacuccuggccugaagcaauccuccugccucagcuucccaaagugcuaggauuacgggugugagccacuuacugugucuggccauguauuugauucuuuuaaaaucaugaauacuuguucuuucaaacaacaaauauauuauagucauaucuugguuuccaauuucuguuuaaauuaacaagaugagaauugaggcccagggaaucagagguucuccagauguuucccuucauucacaucuaauccuaccccuccacaggagguaugaaaccaacucauugcaaagaugucacccagggccacaucacccagggauacugggguugggcgagagcauaacgggacaguagagaccucaccuaacuuugccuucgugcuugagcacuaaggucaagcaaacguuuuaugaaguuuccugcccagucaacugcugaguaauauacauuauaccaaauaaacugguuauuuuguagagauuguugaaugcuuucguucaacauuuucauuuugaaaagauuuuuuaaauuauuuauuauuauuauuauuauuauuauuuuugagacagagucucgcucuguccucuaggcuggagugcaauggugccaucucggcucacugcaaccuccaccucccagguuuaagugauucucaugcccuagccuuccaaguagcuggaauuacaggcgcgagccaccagcacccggcuaauuuuuguauuuuuaguaaagacgggguuucaccauguugcccaagcuggucucgaacuccugaccucagguaauccucccgccucagccucccaaagugcugggauuagaggcauaagccaccaugccuggucugagaagauuuuuuuaagaguguucugcugcucuuuaguuucauguaaacuuauuuuccccauggcacccuccucacugucauccaugucccuuuucugcgugagcugguaucgcuugcuacccucuaagaccuaggggauagaaaacaaugggcucuagccugccuucugcagggagcaaagccuagaaacaggaagcugcuacaagcaaucccaacugcacuguguccauggaguaucaugaauaguuuacacgaagaggauuucuuuaaaaugcugaauuaugaaggaguauugauugugugaguagaaauaucuagaagacuacaucuuuugucuucuagucuaaugcucugacauggagaaguguuuccagucaacgguuuauucugaagauagcaccuuguccacuaaaugcacauuacauucucaaauuuaccuuuuuaaagauucucuuugaaauaaucucuccaaaagucaguaagaaacaugucgagcacuaccaaagcugagaaaguggagcugaaucgggcucuuagccucacucacacaaaauaauauuuuaauuggcuaagcuaauauuugauccaaguucauaaaaguuugaaaucaaauaauuaaaugcaaauacagucuucaucccaaagacgauaagaaugccuuuaagcuaauauuuuuaacaagaacuguuccacagcgcucucuuguaaauuuuaucauaccugaggcaguuuuccucauucgauuagcuggaaagcugaauuuaucccgaggcaaaccagacaucuaguaugggcuaaauucaacaacuggagcuuaaauuuggcuuaauauauccccacuuggaucugccuguuuaauucucuuucauaugauaacguugguuuauucauagucuugacuugccaccugaacaaacugaaccucauaucuuauucuaagagaauaaaacuuugcaaaaaccaccaaaguuucugaauggaaaucaaauacaaagugaugcucaaaaacuguuucaggacgugaguacaaaaaaaaaaaaauagugaagagguuuucucugagggagggcugcucuuuacgaauguggauguuuccuaugcuuugggagcagauggucuuuagcaggauaaggacuaagaccuccaagaccagccaaggcagcugcaauugugucucaagcuugaaauucugcaugcuaccuauuuuaucaaacaccguauguauuuggccuuauuguuaaaucuauuuuaaauacaacuuuauuugagguuuaggggcaaacuaggaaauugcuucauccuauaucccuuuaaauucuguuuccuggcucagaauaucccaucgauuuccagccagaggccuuauuuuucuuugauuuuccguauauuuuaauguaguuuucacuaucaucugauaugcagaaguugauacaauguacgaucuguuucauaaaccccuuuaguauagcauucuguccucauuuuuaucccuaagaauucuagaaugcaaauugcaaauguguauacagagggaaaauggaaguguucuaugcccgugauguggucccuaacacagcucacagccccaaaauacaggcuuccugaaaauacucagauuaccacuucacaacaucaaacauaucaaaugguuuuccuucuacucauugagcucaauuacuucaauuuugaaucaaauuacacuuuuucuagagacacauuauaggaaaagagcuuuguuauauuugaaauugguuaggaauuuaacaaggugaggaacuuuaaaauugcuuaagagucuaauagcuggggguauugauacauagaaagugcucaauauauuuuuauugaauuaauuugcauaugcuuuguauucaugggcacugaauacaaauuagccaauucaauaauaaaugcauugguugucuuuuauguguguggugcuauaccugugugguguaggaaauaagaaacauaagucagaaucucugccuucugagagaaugcaaucuagcaggagaggcaaggcauaaaccaguaaccggagaauccagaaaagcuugccugggaagaugcaauugcaaauauguggaagauguuccacagacaagcaagcaagaagacuggcgugugaaacaaaacggauucucuuauucgacaaaugugaacugagcuccuccuuuguccagacauuaugcuaggccugggaaagguuauaauuaacaagagagacauaucccuguccucauaauugacagugaaauuaccauguaauacccaaugcccugcaugaugggcaaauagagugugcuguagacucacagcagagaggacuucaaggaggcuuccuggacguaaugauaucugcgcugaggcccaggagauuggucaaaauuauccaaauaaagguuaggggaagaaaguuccagguacuggccaggcacauucaagaaacugaaagaaguugguggguggggugaaauaaaacgggauagauaaacaggccagauaaauguguuuaaucuuuaacccaggguaguggggugccauugaaugauuuuaagcagagggaacuagaggacauaauuggauucacauuuaaaguuaucacucaugcuguugugaggaaaaugcauuuggaggcggggacaauauuggaggaaucaguuauaaggaacagaggcgaguuacgguugcagcaauggagaauaaaggacagauucaagacgcaauuagaaagcagaggcagcaacucggugauggcuggauuggaaaagaagaggagagggaggagucaugaaugaaucugggucucaggcuugaaaucccagguagauauuggguaacgggauggauucuuaguccaaucauugguauaagaaaagcaggagaaggagcagguuuagaaagccagacagauugagcuacauuuuagacacugaguuugagauguccccuggcuaucagguagagacaucuaguaaauaguaaacagucauauguacagaaccaaauaaaguuauaugcugcagucuuccacaugggucacugagugagcuggugaaagcauugaacacacugaaauaaaauguucaacacauggaaaaguccaaaggauuugagaaaaacaagcaggcuuggcacuacaagccaaagcacccagccaaaaaguccucuuugaauccauuucccaagaaaguacaaucuauaauggaguuugugcuuuucacuugcuguuauaaaacaauucuacacaaaauaaaaauaaaguuggccaugaauuugauauggaagaauagcagcaugucaaaggcaaaaaaaaaaaaaaagaagaagaaagaaaagaaaaaaagaaaaauguugguuuagggcaagaauuuaaacaaaaaagcuuauucucauauuuccugaggaucuccucugugcugagcacuggccaggcacuaggaauacagcugcacauaagaccaagucucugccuacacggcuuucauucuagcauucuagugggggugacgggcaauuuuguuuauuguuuuuuuuuuuuugagacaagaucucacucuguuucccaggcuggagugcaguggcacuaucuugcuucacugcagccccaacuuccugggaucaagugauucucccaccucagccucccaaguagcugagacuauaggcgcagaccaucacacucacuaauuuuuguauuuuuguagagacaggguuucuccauguuggccaggcuggucuugaacuccuggggucaagagauccuccagccuuggccugccaaagugcugggauuacaagcgugagccacugcacccagcuuggcaguuuuuaaaauuagacaaauguaugcauaauguaaggucagucaugaacaagcaauaauaagaacacaucauuuagggauauaagaaaacaggugauauuguuuggauccuugucccugcccaaaucucaugucgaacuguaauccccaaugcuggagguggggccugguaggaugucuuuggaucauggggucaugauccaaaacaccaggucccucagggccugguguugucuuggugauagugaguucuugccagaucugguaauuuagaaauguguaucaccucccuacacauacucucucucucuggcuccugccuucaccaugugaugugccugccccacccucacccgccaccaugauuuuaaucuucuugagaccuccccagaagcugagcagaugccaacaccaugcuuccuguaaagccugcagguucaugagccaauuaaaccucuuuucuuuauaaauuacccagucuuagguauuucuuuauagcagugcaagaacggccuaguggaaauacagaauucuggauuaugaucaccucuggggcaucaggaauucguucuugggaggaacacacagauagccugaagggcucugaccauguucuggucuuccugaugagugguggauucauagguauucacuauacuauguuuaaaaacugacauauacauuacauuuaaaacauuaauuauaguaaaauaugcacaauguaaaauuuaccaucuuaaccacuuuuccauagauuuuaauagacuuuuuuuuuuuuuuuugagacagagucuugcucuguuguccaggcuugagugcaguggcaugaucucagcucacugcaaccuccaccucguggguucaagugauucuccugucucagccuccugaguagcugggauuacaggugccagccaccacacccggcuaauuuuuguauuuuuagaagagauggaguuucuacauguuggccaggcuggucuuaaacuccugaccucaagugauccacccgccuuggccucucaaagugcuaggauuacaggcaugagucaccgcaccuggccaacuuuauuuuuuagagcaguuuuuuuuuuuuuuuuuuuuuuuuuuuagacggagucuuacucuugucacccaggcuggagugcaauggcacaaucucagcucacugcaaccuccaacucccggauucaagugauucuccugccucagccucccgaguagcugggauuacaggcaugcaccaccacacccagcuaauuuuuauauuuuuaguagagacaggguuucaccauguugaccaggcuggucucaaacuccugaccucaggugaucugcccgccucggccucccaaagugcugggauuacaggcgugaaccaccgugcccagcccuggaguaguuuuaaguucaccacaaaauugagcaaaagguacagagacuccccacauaaccccugccccgcuacugucagcauuccccuaccagcacaagccuccccuacugucagcauuccacacuggagugaaaccuuuacaaugaaugccgcuacauugacacauccucaucacccaaaguccgcuguucacauuagguagguagggcucgcuguugauguuguacauucuauggauuuggacacacguaaugacauguauccaccauuacaguaucauacagaguagugucacugcccuagaaguccucugugcucugcccagucaucccuccuucuaccaacuacuggcaaccacccaucuuuuuauugucuccauaguuuugucuuuuccagaaugucacacaguuggaaucauacaauauagagccuuuucaaaguggcuucuuucauuuaauaauacacauuuacguuuccuccaugucuuuucaugggccaacagcucguuucauuuuaguguugugcaauauuucauggucuggauacaccacagucuaaccauucacauacuaaaggacauuuugguuacuuucaaguuugggcaauuaugaauaaagcugcuauaaacaucccuaugcauguuuuugugcagacauacauuuucuucauaaccauuuaaacguauacaguucaguaguguuaaguucauuugcauuguuauacaaccaauauccaaaauucuuaucugacaaacugaaacucuauacccaucaaacaacaaccucuguuccucauuccugccaaccaccauucuauuuucugugccuaacaaauucauuugacacaggugccucuaggugccucuuaaaaguggacucauaagcguuuccuuuuugugacuggcuuauuucacuuagcauaaugucuucagugugacagagaccagaguagcccaccauucccuuugaacauugguauuguaccacaaaaucaagugguuuucaaacauuuuugauccgugggagcuuuuuuucuaaaccauguauacaaaaaaagucaaaaguggagaaauucuuauuucuuagccuuggcaccuguacaauacaauuggaagggguugggguggggcuuguccagagaaguccccacaaaggugccccauaacacuagacuguacucagucuccaucgugagacuauuauuuauaauagugauuuguggcauuuaagaugugaaauuuccuucaaaaucucaaacauuaaguuguguuacaugccaauuuaaaugucaaauguauauuauuucauucaaauuaucugaaaaccauucauucgcauaucaugagacccuuuagaaacggaacuacuugacuaaccagcacuucccauucuccaacuccagcaagugacagaaacuugcaggcauugacacaauaggggaaaaaaaacuccaggacuuuaaaauaaugagcccugcaggguucagauuccugcuccgcccgagggaagucucaugguagagcauacaaggacuuuagagugagacaggccuggucauaaauucaagaucuucuuacuagcauuaaaauccuagaugagcuucucaaccccuuuaagccucuguuuuuccacugggaaaaugauauuaauaauaacuuccccauaagauucuuaagaggauuaaaugagaaaacauauguuaaagacacuugucacauuaauugguguuugguaaauguuauuuccucccucauucuuacugacuuugagauccugggaaagccauuuaaucccucugauucuuaauuucaucauaccuauaacaccuucuaggauagaauccuuuacaauuuagcuuauccugaaucccacuccuaggccaguuuucuacauacucucacuaacuccugggauuucacccaucacccaucagcuguacacugauaagucccaaaucuauaccuccagcccaagccuuucucuugaggucuagaccuuuaugucuggccauuuccuggacaucuucacccaauauuccaugugccccuuaaauucaacauggccauaccuagacuccuuaaauauugcuucucaaaucugcugcuccucuuggugacagccaccaccuucuucccuuaacagacaccuggaagccauccaggacccucacucuuucucucugucucuccuauuuuuuauuaacccaaggccagcaaacccuguugcaucaaccaucuugaugccuuucaagucccuccccaccuccuuggccgccguauuucucaucuguguuccugcagcaggauccuggcuggucucccuccaugagccugcucuccccucacccuccugcacacacuagucccuucuacacacuucuggcagaaugcuuucuuuaaaucagaaagcugaccauuucccucuuuccuaaaaccauucaguguuucugccuugcuuuuggaacaaaauccagaccaucugacaugcagcacucuucacagucuuaaaccuuagggcccaucuucaucuugcccaccuauuccuucuccacaaaggcugagcuguuuaacaguguaccaaagaccucucuguucuuuccuucucuaggguuuguauauagaccacugucugcuaggaugugcguucucuuccacgcguugcucagcucauucuaacucaucuuucaaaacuccucaggugucaccuuccccagggaccccucuuuucucuugaacccuguguuagcugcccauccuguaagggcacugcuuaucuguaucacauuaauugagcuacuguacacagagacugugccuuuuauuuccauaucuccaacacccagaccagagcuguuaagacugaaugaauaaaugaaugaaugaaugaaugaauguguauacauuguguauacacgaagguaugaaauaauaaauaaagcauguuaagaauguuuuguaaacuacaaagcaccaaucaguuguaagggccuguuauuucuguguacauauauaguauauacacuuuauaucuacuuuuuuuuuuuuuuuuuaagagacagggucucacucuguugcccaggcuggagugcaguggcacaauuacagccuacuguacuugaacuccugggcucaaaugaugcuccuacuucagccucucaaguagcugagacuacaggcacacaccaccacauccagccaacuuuuuauuuuuauuuuuagggggagacaagggucuugcuguggugccuaggcuggucucaaacuccugggcugaagcaauccuccauuuuuguagacagcuccugccaagggcagcauuuucuuauuauuaauuugccuaugaaagcacaaaauuauacauucuaguugguaaaaauaacucuuggguuagugugugugcauguguguguguguacacaccuauauuauucuaagggacuuaugggaaugaauuuaaaaucuugaguuucagauauugcuggaaacuggagacagaaucucaguuuaggugucagcaccaaaauuauccugcccuccccuccccaaucccuaaacagcccugauuucuuuuuaaaagugaacuuuguucguaugaaaagaacgaacauguucugcaacuuccagaaguucuuacaaaauuaguuaugcagauuauccauauuuagcccuuuaaaaaauaauuuugaacauuagcuccuuacagaaaaucuauuuucuuucuccuuuucuagaggaaagggccuucugagggcaaaucgugugacaguuuauagauugucaucucucuaaagaccucaaggaaaagaaguauuuucuaugugcaaaacgguaccucuuuuuuccaccuuuauguccuuuaaaagauuagauaaaccagcucgcaccuguaauuaaucccagauaacucccaguuacugggaccgggaguagcugaggccagaggaucgcucaagcccaggaguucaaggcuacagugagcuacgaugucaccacugcuuuucugccugggugacagaacgagacucugucccuauuuauuaaaaaaaaaucagacaauaauauuaguaauuuuuaaaaaauaaaaaauauuuaaaaucuuuaaaaagacaaaaaagacuaaggaauuuuuucccacuuuugaaaaauuaacaaagauaauuaccuuaucagcaaaagucaacacacuccaugugagccucacagcccccagcccccuggcucagcagaggacccauuucugaaaaaguguguugaaugacaagguuuauaggcugcaccauuauggcagcuaccagggaggcagagaagaguaucuuccucuucagagagagccugaauguugugugugacugaaaagucaguacuauaauauauucaagaagaccuaaggguuuacuuuccaauaaggauggaaaaaaucugagcaccccacugugagcuuaucguaaugcugcuucauauaaaaaguugguaauuagucccugagugaauaaaguagaauagaugauaacagauugauacuaagagaagcacaaaaugcucucgccagucaucaaaauuuaaaggcuauagagaaaggguuggggaugccucugucuguuuacauacuauuuccaacucagaauuuguaaugauaggguuuauuaacugguguuuuuaaauuguaugaaaaugaagcuuauauaaauuucaaaggaacgcacagagugccaaaugcaggagccuuugcaauccagccuaaaaugccacagaagaacugguggaaauuuuuaucucauauccaucucuuuuccuccagcugggggucuuuugcuaaaauccagaugugggacaaugcuauuuaauaugagaaccaaacagcaaauuucaaaaacauguauuucugggaacuccagaacauguaaucauuugucuagauuuugguuuuuuuaauauaauuuaauaucaauucacuuguauauuucuguuguuagagacuccugcuauagaugaguucagacucccaaguugccagcuacuauccauuacuuaauauggaauaggacuugauuuuuauuggagggacauuccagagaaaauggaaaucaggacgauuucaguguuuacauuugggccauagcuuugcauuaaacaugcuuucccuuuccauccccaaguucugagaauuuaaauuucuauuuauaugggauucauguuuuaauuuucaugaaaaaguaugcauuuucaucaaaacuaauuccaugaguaccgaggaaacacacuuaaguuucuaaacucuuccuaaaaaguaaauacaagugaaccacauaaaugagugaaaauuccaggucuucugggagguguuaucauuuguauuuuggcacuuaaucucuuccauugcuuuuagguccuugugaacuaucugugaacuaccucaauuacaguggaaaauccagggucuaccugucugucagguccaguccgcagcaucccagggacugauuccaguccaaaugagaacauaagcacguuucccuuaacacaaaacugaccagugaaaauccucauuugcaaaacauguaaauuagaacuugauuauucagaucacaaaaggauucaucacaggacuuuuugaauagaaaagacuauuacauguaaaguacaguauuuuauuucagggagagauccauuacauauaugccaaauuuuugaaaaucaguuucuaguuagaaaaaggaaggaaauuggcuugugaaauaauuuaacaggucaaauucacaauuguaucaaucuuggacaaaugcaccaauaaugugaagcaaggaguuaccgguguauucccuggggauggcugaacuaaagcauaucccuuauccccaggagcuuacggucugcauagggaaacagacaguuaaauagacagaagccagcaucaaggcaggcagcagagcaaugauccuggaauggcauggucaguaaaugagaggaauucacucagaacuucuucaggaucauugccauguguauagauguagaaacaaaauagacauucggcaaguaagaaucuuugggacaauuagcagcauauguuuuauuauuucaugauaacauucaucaaaauagcuuaaugggauaauuaacucaggcauguggauucaauucugaucagcuuuagcaaaaaauaguauauuuagccaaaauaugagacaccuauauauuuuccugccagaaggaaaauugcacauauuucccaaguuuugggggaaaagggugucaguuuggaccaguauucauagaaauuaaccaucgaggcuggacgcaguagcucacgccuguaaucccagcacuuugggaggccaagguggguggaucacuggaagucaggaauuugagaccacccuagucaacauggugaaaccccaucucuacuaaaaauauaaaaauuagcuggguguggugacacaagucuguaaccccagcuacucagguggcugaggcaggaggauugcuugaacucaggagguggagguugcagugagccgagaucgcaccacugcacuacagccuggcaacagagcaagacucugucucaaaauaaaaaaaagaaagaaguuaaccauugaaugcugagcugaagacucuaaauuaucauucuauaauaguaaguggauaaaccaaaacuuaugaucuagccuuuguuuuauguuuguugguaguuuucuuucuuuuuguuuuuccuuaacagagcagcauaguuuaucacagaauguuaaaacugguucucaaaaaaauacaauuaucaaaaaaggaaaguuucaaacaacuuucuaaaaaggguauucuucauuuuucuuacauuuuacauucauucuaugcaaauuucuacauccucucuauuaaucucugacuguuacuagcuuugcuugcuggugagaguauuuuucacuguagcguaaaauaauacugcauuucaaauuuuuaauagucauguuuuaaucacuauaaugcaaaacaaauguagauuuuucuaucauguaccaagguaggacauauugaagguauuucugauuguuuauauuuugcaauuuugaaccaaguaugacucuggauacauagccauacuuauaaauauuuuuaaguaacuuaaaaucauuuuuaaaauauauuaaauaagacagguggaauaugcuuuacuaacuguaaagugccgcauggguaaaauguccagagcacaccaaugugguugccaauuuaaaugccaccggaagacucagagcuccuuauuguguaguauuuauguuuguacaacucaucaaugaauaaucaacuauguuugagucugccaucucacuuugaaagagauaugguaccaacucacuacauaacuauuucaguacuaauuccucacuguuuuuaauuugggucagagacuuggggauggaaaggggaagcauguuuaaugcaaagcuauggcccaaauguaaacacugaaaucguccugaacacacuucaacagcgaauguaugacagcccaguguaaagccauuuagaaauaacaagauggacauguacacauauguagguuaaguucaacaguauauaaugcccaaaacaguauauaguggguaugaauuacuugaaccgaguuuaguaucuuuauccuuuuagucauaguacugugugguuuucuccauauucucuuucuuauuuauuuuuguccaauuagaaaauaaagcagggcaggguggcugcaucuguuuacuuucugagcauggguguauguaaacacacacacguaucugucuauuuuuuccagaggcuucuauguacacaucauauaaaagucauacuguuaacauaaaucaaccccagaagagaaauuccagcauaccguuuucccuugccuauugucuguguguguguuuguaugucagucugucuuuuuuuauucuggcuuucucucuuauucaguauuuauaaggaccuuuagggcagaugucuaaaaacaacugcauagucaucaggaguuaggcggaaugaaaugccuuugcucaucuucucuacaugagugaccagaagaaaaaaaagaaacacagaguaucagacuuuagaaacuacaugcagguuaaagggcacugaccauccuggcuuguguucugccuaaaggacaaggcucucauuugauaaagaucauuagucaccaagauauauauuuuagagaguucccaguagcgaauauucuguuggcagucacuggaguguaccagaugguucauuagcauaggcuagacaagucaaagacuuucagaaucauuuagaaaaugucaaacagaaacaagaauccugucacuuuuuauuagaauuaacuacaucauacccuggacacagauuucaccuugggucagaaaaauuaauacagaauuauaugaauuguguaauauacuggguuaagauaggucuuucuccagggacucauuugcuggcaauauauuaagaucccucuacuuuaggaauccucaauccuuuccuuuuguaagauaugaaaagaguugaccuugcucaaaauccacuggugucuaauugauuugagguauaugcagaauuucaacaagacauucuucuaaagcucuuuugugauccuuuucccaggaaguuuggugagugggguuuacugaauauucagcagcauguaaaguauguuuaugucaaaaggaaaauacauccauuaauugaacacauugcuuuaguaaacaggaauugaaaugcuauugaaauguugcuuuuuuuuuuuuuuuuuuuaaugcagaugucaaaaaccuugaaaacuuccagcugguagaagguguccaggaacaagucaaugccgcccugcuggacuacacaauguguaacuacccgcagcagacagagaaauuuggacagcuacuucuucgacuacccgaaauccgggccaucaguaugcaggcugaagaauaccucuacuacaagcaccugaacggggaugugcccuauaauaaccuucucauugaaauguugcaugccaaaagagcauaaguuacaaccccuaggagcucugcuuucaaaacaaaaagagauugggggaguggggagggggaagaagaacaggaagaaaaaaaguacucugaacugcuccaaguaacgcuaauuaaaaacuugcuuuaaagauauugaauuuaaaaaggcauaauaaucaaauacuuaauagcaaauaaaugauguaucaggguauuuguauugcaaacugugaaucaaaggcuucacagccccagaggauuccauauaaaagacauuguaauggaguggauugaacucacagauggauaccaacacggucagaagaaaaacggacagaacgguucuuguauauuuaaacugaucuccacuaugaagaaauuuaggaacuaaucuuauuaauuaggcuuauacagcgggggauuugagcuuacaggauuccuccaugguaaagcugaacugaaacaauucucaagaaugcaucagcuguaccuacaauagccccucccucuuccuuugaaggccccagcaccucugcccuguggucaccgaaucuguacuaaggaccuguguucagccacacccagugguagcuccaccaaaucaugaacagccuaauuuugagugucugugucuuagaccugcaaacagcuaauaggaaauucuauuaauauguuagcuugccauuuuaaauauguucugaggguuguuuugucucguguucaugauguuaagaaaaugcaggcaguaucccucaucuuauguaaguguuaauuaauauuaagggaaaugacuacaaacuuucaaagcaaaugcuccauagcuaaagcaacuuagaccuuauuucugcuacuguugcugaaauguggcuuuggcauuguuggauuucauaaaaaauuucuggcaggaagucuuguuaguauacaucagucuuuuucaucauccaaguuuguaguucauuuaaaaauacaacauuaaacacauuuugcuaggaugucaaauagucacaguucuaaguaguuggaaacaaaauugacgcauguuaaucuaugcaaagagaaaggaaaggaugaggugauguauugacucaagguucauucuugcugcaauugaacauccucaagaguugggauggaaauggugauuuuuacauguguccuggaaagauauuaaaguaauucaaaucuuccccaaaggggaaaggaagagagugauacugaccuuuuuaagucauagaccaaagucugcuguagaacaaauaugggaggacaaagaaucgcaaauucuucaaaugacuauuaucaguauuauuaacaugcgaugccacagguaugaaagucuugccuuauuucacaauuuuaaaagguagcugugcagauguggaucaacauuuguuuaaaauaaaguauuaauacuuuaaagucaaauaagauauaguguuuacauucuuuagguccugaggggcagggggaucugugauauaacaaaauagcaaaagcgguaauuuccuuaauguuauuuuucugauugguaauuauuuuuaacaguacuuaauuauucuaugucgugagacacuaaaaucaaaaacgggaaucucauuuagacuuuaauuuuuuugagauuaucggcggcacaaucacuuuguagaaacuguaaaaaauaaaaguaucuccuagucccuuaauuuuuucauaaauauuucuggcuuuugaguaguguauuuauauuguauaucauacuuucaacuguagacaauuaugaugcuaauuuauuguuucuugguuucaccuuuguauaagauauagccaagacugaagaaaccaaauauauguguuuacuguagcaugucuucaaauuaguggaacuuaguucagggacauagaagagucuuaaugaauuaaaaucauucacuugauuaaaugucuguaaaucuucauca

SEQ ID NO: 12875 - RNA, 2201 nt, Homo sapiens
uuccugucucacucuugcucugcagcacaguagaggcuguuuaguucaucacaaaggaagugcaucagcacuccugaagaugcuacucuaagggcaccuuugaguugugggccaggaaggcauuccauaguaagacgaaggaaaggccaaguuccuauuguuagcgucacuaugcuucugguuuuauaguuuccuaaguuauugccacaggucauggaucuguggcgcucaaauguucgcucacaagguucacagcacauucuuugcaguugcaccacccagcuaggaggggcgaaaccaauggagcauuuuaggcagagcucauuuccgcccacaucaaaaguaagagagaaguuuguggagagcuacauuugagcccuccauuagcuguuuuacaucuuguaggccaaggugacacuuucuacacuaugugcuggugagauaccacauggacaaaauguuguagaggacccagccugaaaaaugcucaggcuuuaagucugagcaaucuccaccacaucucuacuccacaucccaccccuccuggaauuuuaagucaggagacacauugugagugcauggacaaaauaaagaaaagaaagagagagagaagagggagggagggggagagagagaaaaaguauaucaauuaaaaguuugcugaaagagucaugacauaaagaagaugaaagaaaaaaacaaauuagauuguuaccaagcuguacauucuuuguugagggagaauagagaugaauugguagcagagaggaagaaaaaggaagcauuuuaagaugcaaaacaggagaaaucagacuuaagcaagaauggagaaauaacuacauuuauccacaucagcuguaucuuaccaguuugacuacucuaaaugcuuggggauaaucugggaguuuuucacugcuccccuccugcugacagucccaaacauauugaugaggcauuuuuaauagcuuucaccucuggcuccuacuacagcuucaugucuuuuuccuugguucuuauccucaucguggugucaugauuauuguccucucagucaagcccauccugugcuacugacugaaugauuuuuauuaaaaauaaauuuuccccuaugccucuccugcuuacaaugccuuaugauccuugauugcucacagauugaaauccaaaucuuugaggaucccauucaagaucuuucagugccugaguauagcucgucucuccaaauucuucuucugcauauuaugugccugcuaaagaaaguacuuacaguuguucaaaugagauguuucuuuuggaaaccucccugcauuccuaccugcuaacccccuauuuggaaguuaauuguugucuucccccacucagcucacagguguccccugugcaccuucuacugcccacucaagcauaguugaucacuuccuccuuuaggucucaaugccaugacaauuuaaucacacuccauuuucauuauuuuuuauaagucuguuucacuacuugguacugagcuucugcuuguagaaugugcacuuuguucuuacuuauuuuuguguucuuggguccuauugccagugccuugaauauacuagauauaagucuaaaaauauuuguuaaagaauaaguaaaugaauauuucaguggaagaaacucuuuucccauguggggacuuugcacuuucugucacaaaauuugacuuaaucuaacuuaggcaaagauguaauuuauuggcuaagagaaaacguuuagggauauaacuagauuagacauacuagauugaguaugcaaacaauaucauauuucucuacaucccuuaguucccauucccaugguugaauuuaagcugcuuuggcuuuagacuuagacuuucuaugguagcaagggaagacucaaaccccagccuuuccaauuuucaguccagcaaacacacauguacacacacacacacacacacacacacacacacacacacacccaacaacaaaaaacagaagugagaaucucuuucugcaaaaugccacuuaaaauugcccagacuacaaugacuacaauugggguauauguccauuguagaaccaauuuuucuggucagguaaaugcuguauccuuaugggcuuagaccugugccccaccucuauaaacaacuuuucuggaauuacagggaaugagaguggcagaggaggauguauucaaaggguuaccagaag

SEQ ID NO: 12876 - RNA, 433 nt, Homo sapiens
ugugguuguccaucauaauuagcuacuggaguuaucuucucccugcuuuuuuacuaccucucucaaagcuaagaacucagagcauaagcuugaaauagaaucugaaacugcauaaacucagagaugguuccuauagguaaagugaaauugagacaucccagugccagaaucauuguuaagguaucauugaagcaguccacugggcaccaugcccuugaacuggagaaaaagcugcuccuuggugacuuaggucaucaagugagaccuaagucucacacccuggugagaagaggguguuuuccagauugucuuuauagagaacugagauugcuugacuaugaccuucuuuccauaaccucccucacuagaaacucuuucagggagggaaggaggggguaguguuccucuuuccuuucacccuucccccaggcua

SEQ ID NO: 12877 - RNA, 4739 nt, Homo sapiens
gccccagcgccgggugcuccgccucccaaggccggcggcggcauggcggccaggcagaucugggcacggacgggugccgcgcucugcaggcaaccuuccgccgccccgccgccagcaccucucuggguaagagcuggguuccgacagcagcucagcuuaacccucugcccugcuaacgagggaaacugcggcggcuccgcgcccagcacgcccgguaggccggagagagcggcgaggccuucggugagcgaagaguuaaccgcggcggagcgacagaucgcggagcugcacgcugccgccugcgcggugagacucccuccugcccgccccgccccgccgcggccgccccgggcucggcgcgccugcgcaucccgggccucuccggacccggaggccgcccggcagaggcaaagguugcuggauaccggugcgguccugccucgggcgacauucgcgcacgcacacgaacuuccagccccgacauuuucgcgggaaaccugugucugucuugaguaugagugugauuuguuuuccgaucagcguccgagcuaaacuccggucgcagugugggacccacuaccacucuuuugugguguauguguguguguguugcggaaggggguguuaaggaauugauggagaagguggagggacugagaagucacaacaaaaauguguuguguguuuuucugcauugucaguugaacacuuagcaauccagugauucuuagagugagaaaaaaagacauugacacauuuauuuuaauuuuuccauugccuucuuguccuuucucuuaacucuuaacggagcagagggaacuacaaucuggcauuuguagacacucagcuguuuucuccuguuuugcggauuugacaauugucuguuaguaccaguaucuaaacuucucucccuuuacgccuucuaacacagucugcgugaguuuaaaggcagcaugguuaccuuuacaaaagaaacagugagaaaaaaagagaaacugacuauaauaaagauagaaaagcaguaugaaaugaacccauuuaauaagcuaugugugugugccuccaguacuugaugggacuaauauuauaugguaugacuugagccaaagggguagagaagaaaaucccggagguugccuaaaauugacuuauuuaaauaaugacaguuaguaggcccugagaauccacugucggucugacccauucaagugcugaaacugaauaaagacucauuaggaagugacuggcagcuuuugauuguucuuguuuaugcucuccuuuuaaaaauaauguauauaauuuguucucauacuucgcaauauagauaugguggauauuaaagaaaagugucauucuccuuagagcaaacaccaguaucaugugaagaaauuuucaaucagucuagggaaggaaaggaacuuuuucucacucgggaaauucacauuuguuucaucagugucaguaucacagguuaaaugacuauccaggugaccauaaguaagcccaguaaauaacaagcugcuuguuuuucuuuuucgacaaaucugagcccccucacuaugguccuucuuccagccucaaagcagauagcucucuuaccuuucuccggguaccgaugcgcaucacugagcaucuugcucuccagucaaacugucagcacccuugcuucaucuuugucuguggccaccauuacgugaggcucauuuacugaggacaaauuaaguuugugugggcagccagcaagcucagaggugcucaaucaacauggaaagcuguagagcaggggcaugcgcaggagcaaucuguuaggcuuccagguugccagauaauugcccucagaagacucccagaagcuaugaaaaguaaaaagaagccugcuacagaguuccuaguguuuuuuuguuuuucuuccaagucuccaaacacgagcuucguaaauaaauaaagaagugaggcccugacaaucggucauucuaagguagugcugagugcuccugauuucauguaaucugcuucuguggucucccuggacuugggaagucucucucagaccagccuugggacuugcucggauuucugcugcccuguccugcucuagcuuugcugggaugccuuagagugaggcuagauuucaacuguacccguccuuuugcuacacacuuuucucaugaaacauauuggguuaaaaccucaaccagaauaaaauauucugccauuaaaugagacacugaagaaguuguuggugguucauacaaaaauguguuugucagaagacaugcaaguuucauguguauuuuaaugaaaaaaacucuguacaagauugaugcacugaguuacugcgugguaaaaagguuauacaaaaaguccaugggaguuccucuacaaaaacccaaggcuaaguaauaucaccccaaagacccaaauccacagaaaagauuauguuauuuacuuuucccuucccacaaaguacuugagacaccguuuuaagucauguuugaauguagauagaauauacuuccuugacauuugaaauaguacaauaaaaguuucuuuugaucaaacuugugaaagcugugaguguuaauauguuaaaacaauacuuuuuucacuuaaaaauacaacuaauaacacaccagcaaaaaaaaaaauaguauaaaaugugcaaugaaguaacacaugaagguaaagaaaguguucaauaauagcaaagguaauacuuuucuauaaggaccguugguuuugauuagcgccuuuucuguaaguuuaaaucauuauccacauauuuuaaguacugaaauuccaacugcaacuucugagugaaaguucauuuucagccucuuaagcucuuaaaaucauuuaaaucaccuguuauuaagcuuguuaccuagaaaccaaaugaaaaauaucagagcaguggcuacauaguuauuagguacagaggaguucuuguuuuuccaucaacuucucauuuuucucaaacuguauauuuucuccuuaugucacauaaaguuggauuguguauaaugcuggagugcauuuggucuuuaauugcaagugccacuaaaacugcugggaagaaguuuaauauuguuuaaaauuuuucugcaguauuuuauguguagacauuauggugaagagauaugaugaauauugagauuaaugaauuguuucauuuuauugcacuucaggcuggccagcuaaacuauguggauccagcuacuggcuauguggugcucacacagauugcccacuugcaaagaggugaauguuguggcucugcgugcagacaugugaguagcaauucuugcauuacagcagcaguuugcggugcuucuguaacuucguaaauaccuauuauuugaacaacaagucaaauaaaaaaccaaauagaccuggagugaacuuuucacaagcuacuuuagccaacgacaaugaaguccuuaguaccaacauaggacuuuuaaaguuaauggaauuuuguaaaguuucacugugagcaucaguuccuugaaaugcugugauuugaaauucaugggagcucuuuauuacaaggaaacuuuucaugggguuucaaauaaguuguuuucauuaggcaaguacaaagagggcaggaaaagaaaucuagaauguugcagaugagaucccucuucuuuauuaguugaauaaauagaaacucgcccagcauugagagguagguuuccuucagauaaugauuuuuucuuuucuucuuuccuuccuucccucccucccuuuuuuccugucuucuuuccaucucucucucucucauucuguuccccaccccccgccaccaccuuccucucucugguccuuucuguggcucuuuuccagucuguguuugaaauaacugugaaacuagauuauacugcauguagugccuguacauuuccuaaaauguuuauuucaauagauaccucucuauguucacuaauuaagauaaacaaaccucuccuuccuuauuauaagcaaaaaauaaaugggaaugaauccuucacuauuacuuuuuaaaggcauaguagugagguaaauuguuauagggucaagauuauaaacaguaacaaccucuguuuacagaacacuuuguauguuuuggugcaagaagguguaauuuccuuuaacuagccacucuauaauuaaagaauagacacuaaaugcauguauuaacuguagccaggauuaaaaauuaaaccuuccguuuuauguauguuccugugcccuuagcuguuucuaaucaaaugcauaagagcuuuuuguaaauugaggauuugaggauuuucuaaaaguggauuuuuugacaguaaaauucuuaaauuuggaaggaugaauuuaggaaaugguucuuggacccuaauuaggaucauuugccugagguugccaauauuuuucucuuagucugcaggaccugauaguucaaaugaucuauauaaaauuguuaacagucucuuuuugucaccaugagaagugugcuuuuucaagaugauuguuaaauaauuuaauaauaauuuguuuuauuucuucugcaguguccauauggucaagucaauguuaaagauccaucuaaaaagaagcaauucaauucauauuuuuauguuugacaagaauuucaucucuguucccuaacugugcuuguauuuuuuaaaaaauaaagccccaauucagaauugcuggauuauuaguacuugaacacuaguuuaauccuaaauacauauauuaaaagaaca

SEQ ID NO: 12878 - RNA, 274118 nt, Homo sapiens
cuggagugacgcaagagccaggggcaucaacuugagcucugaauuuguaguaugaaaugaaaggaacccaaguccguguguauguguguggaaaacacugcaggucgagguacuuuuccagguacuucgcccuuugugggguugcagccccgacgcccuggaaucuggacuggacccagaaaggaagccgguuugguucaugcugaggacacagggggcaccuugccuuucuggcuagguggcaaagcgguacgugggccaucccagcaggcacuagcgcucccccugcacccucuggccgcccgggcgcggggaccuggcccccgccuccuccacagucuccgacuugcgagccgcacggcccaggugaagccgcugggcgcguccccgcgcgccccuucccccucccggcgacuuccugauuugcaagaaggugcaggagccgcagcgggcggccccggucgcaggaacugagaggccucagcuuugguggcggcuaccggcggagacgggggcggcggccacgccaccgcugcugucacagaaaggcucugguggguggggugggaggcggggaagugccgggggcgcagccgacaugggcccgccgccacggcugcugugagcagccucuuucccuguguggccgccggcgugggcggggacggcgcgacccucgcgcggccgggcugcgggcuuccaggccagcgcgcgggggccggacggacagccccacaccgacauguaaccauggacugcaggaccaagugagugggggggcccgggcgcgucgggggcgggcgucccucggcggccccucccaggccagcucggcuccuccgcgccuccgcgcucaaccggcuccccgggcggccgagguuggccgggcgggcugggggugcgguccggcccccaagccucuggccggccggcgggacggcgcuaggccgcaaagccugcccgcccugcguccccggcccuccgugguuggcgcggcuccucccggagaggccacuagcgccuugucgacgcccgccuuucgggggacaggggaggccgggcggccccugacaccgccgcugagggguucucgugcuucccccgagugugucagaugugacucuccuggggcugccugugugcgugugguguccgggagggagucagcguugagguuaagagguuauuauuccgagugcucucugagcauuaaauauaaccgguguuuucuuaaguccguuuguuacuuuugucuuggauguuuucuuaugauucugcuuauaaaauuagauuggucucugguguuucuuuaugcagcaacuguagaugcaugguucuugcaaaacgguauccaauuagaggguacuuuuaugugugugcuaaaguauuuaucaacgacuacuuugcucaggagauuagguaaaaagcaauuuuaauaacgguggugauuuuguuucuagguaucuuagaggcaugaguuuuauauuuuucuucugaaacuuaacuuuggaaagaauuccuuuuuacuucgcuuacccacccuuuacuaucuccuucucaaaaaguuuaaaauaaugccauguauauuuguauuauugugaaaggccguuugaauuucacagaaguaaaacugagucaauauuuaacuuuuacaccuaagagaaauucuaaagaauauuagggaaagagggaaauuauguaauagaauuauuuucuucaguguguuugacaucauggugggcaggguaagugaguaaaaauaguaugcuucuugacauuaauuguuuuaagagggaggaagucaucugagcccagauuauucccauugaaacaaguuaauagcggaaaggcuaaaaaaauguauauuugcauguuaauuuauaugucuugucacuuccuauguuuccagauucauaucuuauaagaaaagcuuccaaaaaaagaaaugcuuuuuuuuaaagucagagcuggcauucguuucuugaaggaaguacauauuaaauacagccaauguacaaaggcacuaaggucuuguuagcaggaauaacugagauauuaacacauuggccguugugguaacagacuuaaucuuuuaccuuaugauggaacgagagauuuaaacagcaauguuaugaagaaaaagugucucaguauauuucaguucacuuuuugaaauuuaaccaauguugcuuugaaauuuugcaaauauggcaaguuaguaaaaaagucaauaacuucugaauuaagcaaaguaaacuuacaguuucuagugggaaaaucuaacauggaagcagauggcugguuucuccaaagauaauggauaaaaagaaggcuuuuuauguugcuagccuuagagcuaugaauaguuugcuacuuuaaauaugcauaaguacaguaaauacauuuuaagaaaaguauaugcaacguaucacauucauggagcauuaucaauguuuuauggugaucuagaacuuggcagguggaaccauguauucaucauuuacacuuauauugcaaguccuuuggagacagccugagaaccugugucaaacucuguuggcaggguauaaugacacuuagggacacucuggcuuuuaaauuugauccaauaagauaaaaccaauacuuugcauuuuuguagcacuuaguacuuaaugaaguacuugcacauauguuauuugauuuauaauccucacuauuauucugugaaguggacaaggcaccucauagguaagggagaacagucucagcguuuaaaugcuuugccccaaguuucagaauuccuaagucucagcucuuuuaaguugcucaauugagaaaacaguuucauuguuauuucuacuauacuguaguaauacagucacgugaaauguauugagacaaaaacaagauuaguuuuagaauuaagaaaauacaaguuucauggagauguuuauuugucauaggaaauuaauuuaaacuuuuuccuuuuagggcaaauccagacagaaccuuugacuugguguugaaagugaaaugucaugccucugaaaaugaagguaugugucuucuguguucuguuauuugacaaggucucuuuuuuuugggacaagaucucauucuguuccucaggcugugcaguggcaugaucagggcucaccacaaccucuccuucccggguucaggugauccucccaccucagccucccgaguagcuggagcuaccaaugcacaccaccaugcucagcuaauuuuuguauauuuuuuuguggagacaggguucaccacguugcccaggcuggucuugaacuccugggcucaagugauccacccaccuugcccucccaaauuguugggauuacaggcgugagccacugugccuggccuguucuguuaauucuuaaaauaauugauugaaucugucaaagcaaguguuaauauuguggacugcuggaacaugguaguaauaggaaaauaauacuacuaaauguguauucugcauugagugucucaaguugcugguaauaaaauagguguuaagucuuugcccugggauuguaaaaaucaugaauguuaucagugcagcuugaauuucagguguguuguuaagcccauauaacuuacaacucagcuucaccauucguugguaaaguuaucauuaguuuuggugaaagggcgaaucuuuucauuuucuuucauuuauguuuggaaauuuagugucuuuuuuuaaacauuagugcacauucuccugcuaguaccaauggaaacuacaccacuucccuucugauguuuccagaacgcagaaugcagacugaguagccccuucuguuggauuuacuccaauagcacagcacuuuugcagggagguaaacgauagugugaaauuacuuggaaggguuucagcugucaguuccguacaauuuccugaaaagaugagagcauaauacuuuaaugucaugauuuucaucauuucccuccacuuuugucauauuguguauugugcauaugugugguaggcggcaggguuagcagacaagaauaaggaauucuuuucuugccuauuuucuuuuaauguguucuugcaugguaugucuuucuagauacuuaaaguauaugucuuuacuugcugugugcuuagacccuggauagcaugaugauuaagcauagggguuucguggagacugauuggccauccuaaagccuuggaggaaagucugcugacaauuuuagcuucagaaacuauccagcaauuaccuacucuuaaguaauuuggagcugcacaccuuaaaauagagaagcccaacccaguuguggugaaaugggcauggcuaauuuuaguaugaagucacauauuguuggcuccaccagcccuacuacuguacuccuggucuaucugaacugcagcuguggucagguuugucuauuggcaaggagugauccuagguuguagggagccuuuucuaguugaugaaguuaucuuuuauuguccuguauguaguaaaguuuguccauuugcauuauuuugagccccaaccggguccucuuugaagaauggauauauuagguagaauggauacucaaauggauacauuauguuuucagcuccaauuuaauucuauucuauagugguuuaugauauaaguuaaucuaaaaaauaucuaccacaacauuaccgaaggugcgugaaguaacgcucaucugauauugcuuguaaaggcguggcacgguggcucacgccuauaaucccagcacuuuuggaggccgagguggacagaucaucugaggccaggaguucgagaccagccugaccaauauggugaaaccccaucucuacuaaaaauaccaaaauuaugcaggcaugguggccuaugccugugaucccagcuacuggggaggcugaggcacgagaaucaguugaacugggguuguggagguugcagugcgccgagauagcaccaccacacuccagccuuggugaccaagugagacucugucucaaaaaaaaaaaaaaaucuauauagauauauagauauauuuauagauacauauauuuauagauauauauuuauagauauauauuuauauauauuuauagauauauauuuacauauauauuuauauauauauuuauagauauauauuuauauauuuauagauauauauuuauauauauuuauagauauauauauuuauauauauuuauagauauauauuuauauauuuauagauauauauuuauagauauguauauuuauagauauauauuuauagauauauauuuauagauauauauuuuuauauauauuuauagauauauauacacacacacacacacaacaggcuaauuucacuuggaaaauauggauucucuaauuuuaaauguguauuaaagugaucuuguuaaaagaucaauuugccuuauauaacacccaaucuaugcaugugucagagagauuguggucuucuuauaaaggcuuuugagugguuuacucccuucuuccucuuuuugcucuuuuccacuuuucaugagcuaguuauuccaguuuguaucuucuacuucugcccugcuuuaauauuacaccuugucuuuuugcuguuguuauuuaaaucacuacuuuuuagaaacaucuucauuuguauuuuaacaguuuauaucuagccugguaaaguuguaaauaugauaaaugguuaaaguaaauaauguuggcuucuuuguagguugcaaauaauccauucuauauggcuaaauggcagaaaauucuaaagauauuuuaaaaaacuaaacucagccauguaagcagcaguaaccuuucuucuuuuauuaugacuuaaauaguaugaauauggcuaauauuuuaggaucuaacaaguaauaacuauaaucaguaacuauaauaaauaacaaaugauaaauuaguagcuauaaauaauaaaaucaauaacuauaagagggcuauaaaaguaaauuuuuuugccaaauugagagauuuauguuucuguaauauuuuaucaauguucuacuuuacagcuaaaucuuaaauagaaaaauauaugaaaaauauuuuaaaaguuauuggaauccucauauuuaacuguuaguaccuauuuguuuuaaugaggcucugauaugugcauuaucagcuuguuuaagguacgauaauuuuuuuuuugcuaacauuaaaugaucaugggugaaauucuuaaauaguaauagauuggaaaacaaaauguauaaauuaggaugcuuuggaguacaaacauaagauugguuuaaauaauagagaaacuagagaaacuugauauaguucauacaagaagucgucaaacaucgauauaguucauacaagaagucgucaaacauccaggugcuuucugcuucucauuucugccacucacaguaauggugucauuggagggcuuagauuucuugcgguuauaagacugucaguggaaguuggaacucugcuuuuuuguuugugacucugggggugacagacacuggcuuuacaugucucuauuuagagccagaaaguuucuuuuuucaaauccccuagaaagccuuuccuuagauccugguagccuaaguuggcaugcaccugaccacuccugaaauuaucauuggugggguagagguaaagggguugguggcaagacuauugugauugauuuauuuaaauuggcaaugaauagauguugagaaaucaauuaaaaugcuuuuguuaaagaacuuuuagaauauauaauuuuuuguugacugaucaaauagaaaauguauuuagaguaaauuugguuuauacuaagauuggugacauuauguuaagguauuuggcaugcuucucuuguucauuuuucauagguaagucuaaauguuuucauuuauccugaauagcuuagauaaguaucuucagagacagguuguuaauuaaauuuuaguuaacagugugaaaugacauuagcuuuuaaaauauaacuugauaaagcuccucugguaagauugugaucuuuaucuggucuacugcuauuuggacuuguuucagaggcauuauauugauuuuuuuuuuuuugagaacaacacauuucagaacauucuggaaaauagcuuguuaguuucauauggagugcucuacaaaucuaaaaaaaugccauaagagggguugguaguauuucccuauaguguccccuauguguuaguagaauuuguucugguggugucugacagauuaguuguggcauuuuuuuuuuuaauggagguuucccuggcagaacaaccucccaguaacuucugcuccagcuguccaaaagugaagugccaaaauuuagaucuuaaugcucuuccugguagaucuccaagauaauugcuaguguucuuauucuuuuuguugucugucuuccuuuuagcaggcagggaaguacagccagcagugauggccucuccucaauucuguuaacagaagucauuguuaccauacuguccccaccuuccccaaagugacuuaagacuucagggaaaugaaaaguaacuuuucgucaauaaaagauuggguaugccucuaagcauuucucuucugggaaguggccuugguacucuagcuuucucuuuuuuaauuuuguugauaguuuauuccaaguaguaauaguagcaguaguaguaggaggaggaggaggaggaggaaagggaggaggaggaggaagagaaggaggaggaggagcaggaggaagaggaggaggagaaggaggaggacgaggaggaggacgacgaagaggaggaggaggaaaaggagguggaggagcagcagcagcagcugcagcagcuaauauguuguacuuauucugugcugggcaaaauucuggauauuuuucauguacuauuuaagccucacaaaaaucuuaugauauaggaaaugcuuguuuccauuuggcacaugaagaaacugaagaacagagaaaugaugaaacuugcgcaggguagucuguccagagucuguauuuuaacuacugcuguguugccucccauugcauagugacuucacguguauaggugguuuuaucaugcgaggaaauauuugaguauaaacuguaugugguacaaaucauuuuuuccaaaugggaauacaguguguucccuaaaauuaaugaauccaauauaauuccaccuaaaacaauuacugaguuuuuucuuugugguugcagagccuaacucaucccauuucccucccugucacuuuucauuuuuaggauuugcaucuucauauuuagugaaucuuugaucuaauaguucuggcuauuuaauaguaguuuuaaaacaucuuuagcacgucuuguuuucuuuauuccuuucuuuuuaccuagaacaguuucucuuaggaacaaauucuucuuugcuaccagcuuucuacuuugaucugccuauccaacccagucucaaauuaucaauuuuucuuaucugcaacuuauguuaacaguuuaacugccuuucacuuuuuuguuaaauuagagccuuaagccaaagaauucuuaguguccuccaugcccugcacaagaaagguaucucuaaacuuacuuuuugcauuugauaacuuuuugucuauagugauacuaucuacacuagacucuacaacauuuugcuucugcuugguauuuuagcacuuauuguacuauuauagauauguuuaauauggucauuuagagaaauacugaugugucuaaauguauguuugcccugcuugagguaaguucuucaugaaccagaacuuauuaauuuguauucuuaagaaaaaacuuaacacaucugacauguuuaaugaauauuuacagaaugaauaaaagaaacuggggcugggugcaguggcucacaccuguaauuccagcacuuugggaggcagaggcagguagaucauuugaggucaggaguuugagaccagccuggccaacauagugaaucccugucucuacuaaaaauacaaaauuuagcgggguguggugucaagagccuguagucccaacuacuugagaggcugaggcaggagaaucacuugaacccaggaggcggagagagauugcagugagcugagauugugucacugcauuccagucuaggugacagagggagacucuaucucuaaaaaauaaaaaauaaaaauaaauuggaucuagcuuaaugcuuggccauugaauaaaugaauguugauuacauuaauccacagagagcugcuuguagaaaugauuuuaaaugugugcugguaugacaguacaggggcauuagaaauagaaguccauauaugucuuggaaugggcuguuuuggaauaccccauccucaaacucuuuucauucagugcuuaugucuccuuuccucucuucauagcaaaauauuuauaagaacaguugcuauauauguuugugaauuuaccuuaaaacucaucuauaaccauucauacauacuaaaacccaacaaaacucuaacauuuggaaaauagaaccuugaggaaucauacagauaauaaaguaguuuaggagguauugcauuauuguccaacauggaaaaagucugaguaaaaugugguuaccaugauaguuguuuuugcuguaacuuuguguucauuuaagaacucugagucucucaauucagaugcacuaggauaaauuagaguaaugcaaacuguauaagcuaaauuguugaagaaaaugaaacugugaccaggcaugguggcugauaccuguaaucccaacauuuugggaggaagaggugggagaaucccuugaggucagaagaucaagaccaggcugggcaacauagcgaggcucccaucucuauuaaaaaauaaaauaaaaugaaacuguuuuuucuuuugcacugcuagccaggaacaaaauguaaugugauucuucagaaccauguccuuggguuaugcccuucuugauuuauauagaaaauaguugagaauauauguacuuuuauauguggcuuggugcauuacauccuccuucacauagcugccugcaaguguaaaaagcaaaucaaauuucacuguucaguauuuguugauuauuacuuucauagguguguugcaaauuuuacauuuuaauaguuugguuaucacuuucucauuaggugcuuucauuuguuuacauguucuuuauuuuugccgcuuuaaucuaaggugaccucuugguuuuugauguucaugauuuccacuguaaaaugucagaggcugcuuggccucugcugcagauuucacagugguaugcuuuaagacuguuguuuugucacugcuguguugccacagugcaaguuuguucagguuuuuucuuauaacuuuguuuucuugacuuucaaggugauauguuccugaugugcuuuugauaauauucucucauuuucagauuuuucuuaggcucagauaauauauucuuuuucucuaaauuuucauguuuuauuugcaaguuaggggauaauaauuuacuguguacaguauacauuuuaaaguguucauauaauacuagcaauagacauguuuagagugcuuuacgcagauggccaugguacuucagauaacaaugagaauaucacauuugagcucuuggauuuuuaaucauuuccaaaauaauacuucuuccuuggaaauaagcuuaauguuuaacauugaaaaacuuuucccacuuucaaacucuugauuuaucucaaguaguaauuuaauuuuaucuauagaaaguaaugucuugguucacguuucugugauaggucagucacuggccuugugggggaacuugcuaaaaggugauccugacuugaccuuuuaaaaguauuuauuuaggagacugugguacuaauucuuaugacacugaauaagagaagaguagaauaacagaacuugaguuuccuuaaagagcacuuaguauaaucccauggaguauggagggaauugcuuugaugccuuuuacaauuccuggauccccucugcugucaccuuguaggugccauuaucaucaugcugccuggugacugguaaaaauucucacaaugagcauuauauaggccugcuccacuaagauuaccccucuucucaccacuuuucaacuaacaauuccuuuuaaguacaccgguguuacuuaaaguguguaucugauuaauuaacagugaggugugaacaacugauagccuucagggaaacauuuauuuuuauuuuuauuuuuuauuauguauuuuuuaagggaacauuuuaauuuuaaagaaaaccuuguaaacucaaaucaauuaaaaagaagcaguuuuuauaauggaaagaucuguugacuaagggucaaauguaucuguaacugccaaauccugguuucauuuuaccauuuuuccaccauacguguugauacucuuguaauugugauuaacaacuuuaguaaguguauaaguauauuuagucagaguauuaauucagugaauuucauaaagacuuguuuuuauugcuuaaaguuccuaguuaaugagcuaaagcuauaaugucaugguuacaggaccuuauuuuucaauuuauuuucucugauuaggcuuccaguuagauguucuacauaaauaguaauagaaacuauuuauuugguauuuauaauaugucagaaaaugugccaagagccuacaucuuccauuugucuucacuucagcuauaaaauuuacugacuguuauucuuuucaaagcauaaggaaauugaggcaaguucaacaacuugcccaaagcacacagacuuaagaguaagacuaggauuugaacuugucucuaugguacuagagccugagcucuuaacaauuaugcugugcuaccuuuagaacaauagcagugaaaucuucugcagcaacuuuaaaaagccacucguuuuagaaaaccccugacugauucuaggcuugaccagaauuguugugauauucuuaacagacaucagaagaagagcuuaaacaccauagaaaguauucagcccucucauuccuucagugaauguuucugagugccaguuaugcgucaugcacagaugaaaugcaauugagauggcauucuugaaggggaagcgucaauuucaagucaauaauuguaagaguaguaaaggcugugguagagguuguauagugcauauagcacugaaguacgaagaaggcaccuaauucagcucauugcuuagggaacaguagaggaguggggagaucuugcggguaguugugagauaauagagggagagacaauugguugucaggugguuaucuuuuucuaaaguuaacuggaguuuuacuucauauucaaaaucuugugugaauaauuaagaguaaagaauauauugcuuuugguauaaauaguugcaucugaugaagaagauaaagaaucucucugcuacaguguaacuugccuuggcaggggauuguugcauuuaauuuuguuuacucagagccuaaaacagugucugacucauaguaugugcucaguaaauauuuguuggauuguuaaacugauaaagguacugagauggcuuuuaaagaaaaggaauggaaauuguguaggguauuaugggcuuaauaauuuuuguuaaauuccuuucuuuuaaaagaaguauaauuacaguauuaaacagguaagauuuguuaaagugaagcuucagaaauaaaaaaauauauauaaaaagaagugacaaaauuauagcucacugcagccuugaacugggcuccagggauccucccgccucagucuucugaguagccaguacuacaggcguaugucaccaugucuggcuaauuuuuacauuuuuuguacagauggggucucacucuguuguggaggcuggucuugagcuccugaccucaaguaauccuccugccuuggccucccaaagugcugggauuacaggugugagccaccgccaagcuggcagaugucuuuacaagguggugauuuuaucuuuuuuccagaagagggauugcuggguccuguaguaguucagcagaagaauggauaaagaaaaugugguguguauacauauaugcaauggaauauuauucagccuuacaacgggggagauaaugccgugugcuacaacauggaugggccuggaguacauuaugcuaaaugaaauaugucagacccaggaagaacaaguugcaugaucucacuuauauguagaauauauauuuuuaaaugcucggauacacagagaaugaaacagugguuaccaugggugggguggggguagaggaaaugaggcaagguaggucaaaagacacaaaauagcagauauauagaaugaacaagucuagaaauccaauauacaauaugaggaccaaaguuaauaaaauuguauuguauuagggauuguuguuaaauacauggauuuuagcugcuccuguugcaaagagguaaguaugugagaugauagaugcguuaauuggcuucacuauagcaaccauuuuacuaucuauauguauuucaucauauugagcaccucaaauaaacacaguacaauuuuauuuaaaaagcuugguggcgggcaccuguagucucagcuacucaggaggcugaggcaggaggauggcgugaacccgcgaggcagagcuugcagugagccaagauugugccacugcacucuagccugggcgacagagcgagacuccgucucaaaaaaaaaaaaaaugcugacuaauaagccuuuuggugucugucucguggaaguuauagucuaucuugagcuaggucuuuauuguccugauuuauguuguuuauuggauuucaggcuuuuaaggacaaguaccucuuugaaucucuuguagauuuugggaagguaucuuacacgagaaugguguucaaugauuacuugcuauaaguuauauuguuauuacagugaaauuaguaaaagauuguucugauuaucaauuccuacugaagauuucuuaaaucuuaaaaaaaauugaauguaaaggacuuugaaagcuugcagauuuuugucaucacaagcaacgggcacuuuauuuaaaaaaaacuuuuuuuuuuuuuuuaaauagagcuguugaaaaaccacaaacuguaacuuuguaggcagaacugguaaagaucaagauagagccuuuuccuuuuucaguuccuucuuaauuaucacucgaaucugaagaaaagcacacaacaaccaguuuaguucaucugauagccuucugcagauauauaugauuccagaaauuacucauuaaaauaauaauuuuaucuugguuugguagcagaaaugcaccagcaugaggguguguuuaguauacaaauuuacuauuaauuagaauuaagcaguccuuuaaaauuuuaucacguggguaguuauaaaaacuuagaugacuuuuauuuucuuaagauuaucaucaaauuaauuauaaguuauuugaaauuaacuuacauguuuauacaggaaacaugguucaaaugaaagccaaauaaguucaaauguguuuuaauacacgggaacaucauauguccucaaggucuaugcauuaaaauuauaggugcucuuaaacuugcauggaagugguucagaaaggauucuuuuuuuuucuucuucaagauuacaguguauuuuagauaugauauuuggaagaggaaguaauauaauauuuagaaaauauuuuugaaggucuucaucauuuuuacucauauuaaaagagcaauuucuguuuaauaauuauaagcaguuaaugaaguuaauuuuuuugguuuuuagaaaauaaugucuuuaaaauuuuuuuguucuuauuacuucaagacuugagaacuaaguuuuggagucuuaguuuuacuaugaaaugugugauuuuguugaugaauaccugcagaguaaucacugacaauaaggagcagcacaauuucaucaagauuauguguugguucuuucacuguguacagguuuagacauguuagagaagaaauaauaagcuaagaacuguuacguacaaaaauacuagcuuccaacuuuuaaugauuacuguaguguuuguuagggauguugacuguauacccuaaacguggaaauauugaaauggaaugcuaguugaaagacaaaauuuuaauuuguaaauauuugucucauuuuagcuuaauaguugaagacauaaaugagcccgcaguauaauguuuaagaugucauuguucuaaauuuugccuuugauagagcugauauagcuguuuaaaauucauuauaaagcccauuacuaaacccauugacuaauaauuuacucuucuugggggauuauaaaaucuguggguaauuuuuuuuuuuuuuuuuuugagacaaggucucacucuguugcccaggcugaagugcagugacgugaucuuggcucacugcaacuuccaccucuugggcccagcaugaucuucccaccucagccucccgaguagcugggauuacagguacacaccaccaugcccagcuaauuuuuguagagauggggcuuugcuauuuugcccagacuggucuugaacuccugagcucaagcgaccugccuaccuuagcuuccaaaagugcugggauuauaggugugagccacuaugacuggccaguaauuuuuugauucauuucucucaguaauuguccagauuaacaaugaccauuuuguuuauaaauggauauggagagaaagagaggagauggcauucauaucaaauuuucuaccugaaaccuugcaucacuuacugcuacuuucuuaugauauacucaaaauauugaucaaagcauuaaaaauguuugaagucacugaacucuucuggaaugccuuccaaaucaugaagauuagaauugcuuucuagucaucuuauacauuuuaagauggcuuacacuuuaccuuuucaggguaucuuaguucuucaaaaacguauaauuuacauuguguuuaauauauaugacagacuaaacauauaauuuaaauuuauuuuaaaacaauuuuaaguaugauuaaagucgaucuuuuuaagguauggcugaauuggucaaaacacaaaaauuauuuauguauugcuguuaagggauuuuucaaucucauucugaguuaaaaauuuaaaagcuggguuugaggagaguagauugagggugcuuuugccuaguuuauggggaagagaugaauaagcuggugcucucuaagagguaucuuccucccgcaugcuuuuuuuuuuuuuuuuuuuuuuuugagacggagucuugcucaaucacccaggccagagugcaguggugcgaucccagcucacugcaaccuccaccucccggguucacgccauucuccugccucagccuccugaguagcugggacuacaggcgcccaccaccaugcccagcuaacuuuuuuuuuuguauuuuuaguagagacggaguuucaccaaagauggccugcugguucuuugcaccaccucaugccaccugcaugaagauggugcagauacuuucauuuuggaauuuguauuuuugccuuguuucacuuuuaucuugaauauauuugguguuuuuuuuucauuuauuauauauuuaauauuuuuauguuacuuuaaaauguuuuagcuuaauucuuuaguuccuaauuuuacuuuuaauuguauuuugcuucuuuuuauuauuuuauauuaauuucuuuuauuugguuuuuuaaauuuuuuaaagaaguauuuaaggccagguaugguggcucacaccuguaaucccagcaauuugggaggcugagguggguggaucacaugaggccaggaguuccagcaaccugggcaacgugugaaacuccaucuccaccaaaaaauacaaaaguuagcuggguguaguggugugcaccuguaguccccagcuauuugggaggcugaggcaggagaauugcuugaaccuagaagguggauguugcauugagccgagaucacaccacuguacugcagccugggcgacagagagagacuccaucuuaaaaaaaaaaaaaaaaaaaaaaaaaaauuaaugaaguacucuauucuuugggaaaaguugugcuuuuucuuauucuaauuagugugccuuuugaaccuuuuuccuuuuuagugagaaacaaggagagagaauuucauaagauguagcagacacauuuuaauaaaacuaauacuuaugcuuuaauggacugugaauaaguaauuaaaucucuguuucaaggugaacaggaguaauggguuugaugccacgauuuucuaaaagccuaaacucuggaauccucuuaaagauaagacagauauuuuaccugauagacaucaugguggaaugggaagauacuggaccgagaguugaaacauaguucuugguacuggcuucaucacuuguuagaugucugacuuugaucaaguccuuuaaauucuauuacuuucauuuuucacauuuguaaaauauuugcacugcauaucucuaauuguuaugagagucaaauacauaauagcaugaaaaugcuucauaaauugcaccauguagauagaaacuuuuauuugguuucuguguugugguuguuagccguaugaaaaaagguaugaucacuucaacagaaauuguuaguaaaaaacuuuccuccuauuuugauguaugugaucaaucuggaagacaggaaugcuaaagaaaggucacauaguaacuuccaaguccccucuuuaauauugcagaagugucaggaacaaggaggauagaagacacguauuuugguauuuugcgcugugauuagugaauuucacuuugaaaaggauauuuagcagagaauaaguuuguaguaccgaaucugacagcauccauauaaauauuuggugagguccagagaggucaaacaggaguugaaaauuacaaugugacuuuucuuuagcgcuccuuucuuccaaauuuuucacauguacaacuucagcaacaaaguuagaauuccauauauguguaaguuuucaaacuucuaagagcuaauauugauaagcuagaaaguuguuagaauagaaauaacacugggcuuauauccuugaaggaaugaugaugagcuaaaauuaaggauaauauuacaaaaguguaggguucucaaaggaaauauuaguugagagguauagugcaauugguugugaggucuguguaaacaaauacuaaguauugcaacuucugaaugauuaaaaaauacagaaaauucaaggcuaucuugguaaugacauuauucccauuuauuugaauuccuguauaacuuucuugagugaaugcugaauuuaaguccagaaauuauccuugaagcaagauucuguuauaucauugauauaaaucuccuuuuuauagguaauuuaauaauguugaugaaguuuauauuuugucagacaaauuuauguaagacccuucuguagauuccugaguucucaauaacaguguuucuuaauuuuauuuauaacacauagaaaaugacaauauuuguaugguacuucugggcaaauggacuucaugcaaugauaggagguaaauggccuggggucugcuaggguugaggggaucaauauguucuuauuucuucuuacccauuagagaggcacaggcugggauguucucuuuaugguuucuuuggugagacuggcuuuuuauucacugcuuuuguucacuguuguuuuaugcuacuagguaggauggcagaacucuagaguuagauuggaguuagaaauuggguuggaguuccaguugaaccacucugagccuguuucuuugucuuaaaaugagaaaaguuaugauccuccuuuucuuucuucuguaaaccuaugaugaucaauagagauaauaaauuauaugaauaugcuuuuaaauagaagguuauuuuuaauauaauuuaagcaaacugcagguacaucucuuuuguaacuugcaagaagaaauagauucuuuuguuuuauauacauauaugugucuguguauauauauaguguguauauauauauauaaauauauuuaacauauaauggcauagugucacaguauaucagugaggacuucugacuccaaagcuaggagagaggauugcaaaauuuaacacuggcaauaaaaauuaaggauuaugagagauguauuacauuuaugcaaauauuucuuucccuuucaggcauaguauuuucuuuaauaaugauuaacucuaauuauggguucugauaauuauuacacacaaguaucuaauguucaucuguuuuaaugaauuuuuuuaaauaaaaaggauaaugaauaaaauuuauuauuaguuuauuauuagugacccaugcuuuucugaaagucuggcuguuuaugccauuguuuucccuaaauaguaaaucuaauuguuuaaugggggcauauuuuuuuuuuuuuuuuuuuuuuuuuuuugagauggagacuugcucuguugcccagucuggagugcaguggugcgaucuuggcucacugcaacugcugccuccuggauucaaaaagauucuucugccucagccuccugaauagcugggauuacaggcgcaugccaccacacccagcuaauuuuuguguuuuuaguagagaugugguuucgcuuuguuggccgggcuggucuugaacuccugaccucaagugaucugccugccuccuccucccagacugcugggauuacaggccugagccaccaugcccagccuaauaaaagcauauucuaauuguuggaaaaacauuuaggaacaaacagcgucuggccugguaggcuaaaauccacagaggaacaggugaauguauuaauucuaucaaucaguuaguuaaucaaaauauucuguuccuuaauucuuccuuccuagacuauguguaggauaauucuuggcauucuuaaugaagaacuagccugaugccauuggugaaaaagauuuuuugguuuuacuauacauuguguauauuucccuauacuuuuaaauguacagauuuuuuauucucuaugugacuacuuuguaacuacugauauggguuggcucuguguucccacccaaaucucaucuuguugcucccauaauucccacauguugugggagggacccgcugggagaugauugaauccuggggaugggucuuuccugugcuguucuugugauaguaaaugggucucacaggaucugaugguuuuaaaaacgggaguucucugcacaagcuugcucuuugccugcugccauccacagaagaugugaguugcucuaccuugccuuccaccgugguugugaggccuccccagccauguggaacuguuaaguccaauaaaccucuuucuuuuguaaauugcccagucucggguauguguuuaucagcagugugaaaacagacuaauacaacuacuucuucauuuauuugauuuuuuaaaaaauggaaauucuuauuaguuuaagcucauuuuauuuccuuauugucugcauauauuucuucacauauuuucucuuuacuaguuuucuucccauuuuuaaaaguccgaucuuuuuuuucuuuuguuuuggcauccuguaccauuguauuuuuuuuuucuguugggcaguauacuacucuuaaguguauacuaccaauauuaauaauuuagauacuuccacuacuacuaauuuagaaaguauguugagaaaguauuuuucauaugaauuauuuauuugauucucauaccuaucuuuugguaggcuauauacucguauuccuauuuuauguuugaggaaacuggagcacagaaaagugaagugaccaggcugauacauauaacuggcagacuugaaccaagauuucaacucuaaaacccacacuuuuuccaguaaaccucaauuuuguaucagauaaguauaguaacuugagagacuugccuggaauuacagauucaagugaacgauuucuuuagguagaaugaaguuuuucuuugcuaggagaaauuggaaguuaggguagccaaauacugucaguaugugugucuguauauguaugccuauguauguauaugaguguaaaugccuuuauguuuuaucaaaaaacuccaggcccauugcaaaagauucaaauagaagaagaaaauaacaugaagagacuaaaauucuaucacccagagaauauaauggguaauauuuuguugaacaaucuguuacacaucucuauaugaguauauuugcaugaauaugcauuuuccguaaacugguucaucuguucaugguauccuauuaucuaaccauuaccaauugauaauuuguuaugaacaucuucucaugucugaaaauagauuuacuguaucaguuuuuuuuuuuuuuuuuuuuuuuuuuuuugagacagagucucgcauuguugcccaggcuagagugcggcguagcacgaucuuggcuuacugcagccuuugccuccuggguucaagugguucucauuccucagccaccugaguaagugggauuacaggugugcaccaccacaucuggcugauuuuucaccauguugcccaggcuggaacuccuggccucaagugaucugccugccucggccugacaaaguguugggauuacaggugugagccacugugccuggccuacuuuaucaguuuuaauaguuaccuggaauuuuauuauaugggccgacuguguauguaucucauuuauacuuguauuauuaucuacuucaaauaaguucuugaguaucauuguuggacuuuugauauguauuggcagauugccuuuccgaaaagauauauagucuuaucaauaguuagagagccucuguguaccacaguucuccacaauacuggguauuaauccucuuuuuaaaaauauuaacaauguauuuuauuuaauuccauauauccaaaacauaauuuuaauagucaauauugaaauauuauuaaaauaauuuacagguuuuuuuuagucuuuuaaguccuauauguauuuuaaaaauagaauuuauuuuauuuauuuuauuuuauuuuauuguuuuuuugauuuagaaucuugcucuguugccaggcuggagugcaguggcacgaucucggcucacugcaaccuccgccucccggguuuaagcgauucuucugucucagccuccugaguagcugggacuacagaugugcgccaccacacccaguuuuuuuuguauuuuuaguagagacgggauuucaccauguuggccaggcuggucucgaacuccugacuucaggcgaucugccugccugggccuuccaaaguguugggauuauaggcgugagccaccgcgcguggccaucgacuuuauuuuuaaagcaguuuuugguucauagcaaaauugcauguaaagaguuuucccauauaucacuugcccugacaucugcacagcuuuccucacuaucaacaucccccaccagagugguaaauucauuacaagcaaugaaucuacauugacacuuaauuaucacccaaagccauaguuuagggaucacuuaucauguuguauauuauauggguuugacaaaaguauaaugacacguaucccccauuauaguaucaaacagaaauaguuuuauugcccuaaauauucucugugcuucaccuuuucaucccuucuuaccuccaacccuugaucuuuuuacugucucuacaguuugccuuuuccagagauauuucccuuuuuuaauuuuugaaagcauuuuugccugucuugcuuuacuuuauauuucgauuaauuagaaaaguuggccaguauuucauguuggcauuaauaauucuuuggugcauuuuauauuuuugucuuuugcacguuugauaaaggcuuuaauuuuaucuguagcaaccaauuauuuaucgcauauugauauuuuuccaauuuaacauuuaucuuuuaauuuuguuuuauguucuuuauucagaaguuuaaauuuuuuuguagucaaauuagucuuugaacuuggaaccaacccaaauguccgucaaugauagacuggauuaagaaaauguggcacauauacaccauggaauaguacacagccauaaaaaaggaugaguucauguccuuugcagggacauggaugaagcuggaaaccaucauucugagcaaacuaucacaaagacagaaaaccaaacacugcauguucucacucauagagugaacugaacaaugagaacacuuggacacaggguggggaacaucacacaccggggccugucguggggucggggagggggaaggauaacauuaggugauauaccuaaaugaugaguuaacgggugcagcacaccaauauggcacauguauacauauguaacaaaccugcauguuguguacauguacccuagaacuuaaaguauaauaauaauaaagaaaaaaaauuagucuuugaaaaaaauuucuauuuugguguuuuugccaaagagcuacuaaacucagggaaaaucagaaguuaguguuuucaauauauuucugauaaaauugcuuuauuacaauuacaucuucaauguauauagaaacuuaauuuaguugaauuauacugauacuguuguuuuaaacguuugauagaauucacccaugaaguuaccuaggcccaaauguuucuugugggaaggauuuuaauuaugaauucaaauucuuuagcagauaaaugauuaaucagacuuuuggauucugcuugugucaguuuugguaauuuucaaggaauuugaaauuuaaacaaaauucaggaauuuuauuuaauugugaaagguauuggcacaaaaccauucauaauauuuaucuuuuuaauuuucauaagaucugcagugauaagcccccuuuucuuccaauauuaauaauucgcauaucaccucucuuuuuuuauuagucuuguuuaggaguuuaucaauuucauuaauauuuucagagagccaauagaguauuuuguucaugucuccauuuucuguuuucauugauuucugcuuucuuccuccucuucuccuucuccuccuccuucucuuccuucuucuccuccuucuacuucuucuucuucuucuucuccuucuccuccuccuccccccuuccuccuccuccuccuucuucucuuucuucuccuucuuuuccuucuccccuccuccuccuccuccucccuccuccuccuccuccuucuuccccugccuucccuucccuuccccuccccuccccugucucuguuucccaggcuggaguguaguggcacgaucuuggcucacugcaaccuccgccuccuggguucaagugauucuccugccucagccuccugaguagcugggauuagaggcacaugcuaccacgcccugcuaauuuuuguauuuuuaguagagacaagauuucaccauguugaccaggcuagucucgaacuccugaccucaagugauccacccaccucggccucccaaagugcugggcuuacaggugugagccaccgcgccuggcugacauuuauuauuuucuucuacuuuggauuuaauuuuuucuagcuucuuaauguggaaguuuagaguguuaauuuuuaaaccuuucuuuuuuucuaauguaaucauaaauguguaaauugacuuuuaagcaguguuuuagcuguguccuacaaauuuggauauaguguguuuucauaguuauguaguugaaaauauuuucuaguuucacuugugacuucuuucuugauccguggguuauuuagaaaugaagugcuuacuuuccagauauuugagauucuuugugauauauuuuuauuaguuauuuuucauuugauuuaggucagagaacauacucuguaugacuucaauccuuggaaauaugagauuuguuuuauggcccacgagguggucuaucuugguuaaaauucagugugcacuuauauagaauauauauucugcaguuguuggauguauuguuuaaaugccaguuagauaaaguugauugauagugcuuuucgaaccuuuuauguuuuuauuuuuuggaucuguuucuuucacuuacugggagaagaguguuaaaauuuccaacuguaauuguggguuucuugguucccuccuuuagugcugucagguuuugcuucaugcauuuugaagcucuguuguaauaagcauacacauuuacaacuauuaugucuucuuuaugaacuaaccauuuuaacauaugaaauuucucucugucucucugucucugucucuuuuucucugacagagaaauuucauauguuaaaaggguuaguucaaaagguuguuucuuuauugugguuuucagaaauuugcuugugaugcuuuuugucuuuacuuuuauaugaauagaacugcucugccuuccucauaauuaguguuugcaugaaauucuuuuuccauucuuguuuucuaaauugucuuaugucuaaacuaugucuauaucuuuaucuaucuaucuaucuaucuaucuaucuaucuaucuaucuagguuugcuuuucuauccagucuaacaaucauugccuuuaauuagaauguuugauacauuuguauucaguguaauuauugauaugguuagguuuaaauucauuaucuuauuuguuuuaugguuguacuuuugguuuuuguuuggauuguuguuaccuuuuugcuuccuucucuucuagauuaauguauuuuucuuuuuuuuaguauuuuaugcuuuucucuucucuuggcuuuguuuuuaguagcucuaaggauuacauuguacuugaugauuaugucauaucuauugugaucauaucuacagugaauuaaaauuaugccacugugaguauaagagccuuccaagaguucacuuauauuuuacuccuuuccuuccuuugugcuauugcugucauacacuauuuuuucuauaugaaagaaaauccuggccaggccugguggcucacgccuauagucucagcaguuugggaagcugaggugggaggauugcuugagaccaggaguuugagaccagccuggccaaaauagcgagaccucaucucaacaaaccauaaaagaauuagcuggguguggugguguggaccuguagucccagcuacucuggaggcuuaggggaaggauuccuugagcccaggagcuccaggcugcagugggcccugagggugcuacuguauuccagccugggcgacagagcaagauccugucucaaaaacaaacaaacaaacaaacaacaacaaaaaaacccaaaaaacuucacuauaaauugaaauuauuaaguaagagaauccccauaauuauuuuuguuuagacaaucaguuccuuuuuuaaaaaguuaagaaaugaaaaaaaaaaucuuauguaccuacuauuuaccauuucuugcauucuuccuuuauguaaauuugaaguaugaucuggccucauuuucuuuuagccuggaguauuaauuguacaucaagucugcuggugacacauucucucagauuuuaucugaaaaugucuuuauuauaucuuaauuuuugaaggauaauuuacuugggaauagauuucuaguuuuuuucuuucagcauuuuuaauaauguucuguugucuucuggcuugcauaguuuuugaugauaccuaagcagaaguuuuuaaucauuaucuaugugauaucuuuuuuuuuccuuugucugcuuuuaagguuuucccuuuuuauugugguuuucaaaaauuugguuguuaugugcuagguuuaguuuucuuuguauuuauccugacugggacuuuuugagcuucuugggucuauaaauuuauauauauguacauacauauucagaaaaguuuugaacauuauuuuauugaagcuguuuuucuguuuauccuccuuuauucuuuuucccuuggggacacaguucauguguguuagacugauaguguuucaugagucacagggacucuguuuuauuuuucucaguauuuuuuguuucugugucucgguuuguacaguuucaauuauucuguacuuagguucucuaaucuuuuauucuacaguauccaaucugcuguuaagcccauacagugaauguuuuugucucaaauaauguauuuuuuaaauuguagauuuucguuuugaaucuuuuuaauagauucuguuuuucuacugaggaucucuaucuguuaauucauucuaucuuuuccuuuaaauacuuagauguaguuuuaauagcuuguuuuaauuucuuguuuugccauaacaaauuaccauaaacauaguggcuuaaaauaauauaaauuuauuaucuuacaguuuuggaaauuagaaggcugaaaugguacucacugagcaaaaaccaagaugucagcagggcuguguuucuuucuggaagcucuaggaaaguguuuucuuuccuuuuucagcuucuaaggggcugccugccuuccuuggcucuuggccuccuucugucuucaaagcccacaauagccgaugagucuuuuuccuaguuugucccucugauacugacacuucugcuuugucuucaacaucuaaggaucuuugugauuguaccacuuggauaaucuaggauaugcucccuauuuuaaggucagcugauuggcaaccuuaacugcaucugcaaucuuaauucuccuauguuauauaauacagucacagguucuaggcauuaggauauagauaucuuugagaggccacuguucugccuacugcauaacucuuuuuaaaaauucuucuuugguaauucuaauaucuguuucauuuuggauuuguuucuguuuacuuuucaugcccccacccccccaccccuacuucccugauauuuuguugauuccuugcaugucugauaauuuuuuguuacacgcugaauauuuuggauaucauauuauugaccguuugaaauuuaucuuuuuuaacuaaguaucacauuuuguuuuguugggcaaucaaauuuuugauggaccaauuagaucuuuucaauguuuguuuuuaaucuuuaggugggucuagaguauuuuaccucuaaggcuaaaguagccuuacuccuaagcugugugucaacaacuguguagaguuugagauuuuauucuauuuacgugcuaacugguuagccucuuaugguuucauugaugcuaucagaagacaugaguuuccaugaucagaaauagaggacuuuauuaucuauggcacaagugacaugagcaucaauaauuugugucaguuuuccuugccccugaaucacaggaguggggugugaaugcacccaggugguugccugcaaaugcaguuggauacguuauagaagaggaacccugaguguaggaaacccaaguagcauguagugugcaguaagcaugccugcuuuuugcuguuggaggcagauacuuuaggcaaaucuuguuuuauuacacuuugcuuuguugugcuuuuuagguauugcauuuuuuaaaaacugaagguuuguagcagcccugcuuugagcaagucuacuggugccauuuuuuuuuaacagcaugugcucacuuuguguuucugugucacauuuugguaacucucccaauauuuaaaacauuuucugacggggucuuaagauggcugccaggugaccgcuuccugacagacgaaaagauguggagugggcugcuaccuccuggccuaaaugaaagugauguugagugaaacucugaagaugaagcuacauugcagaacucuggacuuaacucacaagaagauaaagaggaugggagcaucagaaaaacagaaaucauagauucucgauagaugaacccaaaacugaaacagagucgaauguaaaugccuaugaagaguguccuucuggaauuccccuagauauguagaauauauuucaagaauugcauaaaaaacauucugaacagaaaaacgcaaccucaagauucagagggaaaaaaagaaaacgcuccagaaaagauaaauugaggaaugaaaaagaaucucacagugaacaguucucaaaugaaacccaguggaaggagcuuacucaguauuuuggagucaaugauugauuugaacgccauguuaaaaggaaaaauguugagaaaucaggccuugaagagaggauagaccaggcuguggagggguggaauauugagaagacugaggaacucagaaaaaccagcuagcuacucgagagcuugguguaaagauugccaaagcaguugccugccacaacuuuguaaaagccaaaaaggagguugaaaauucacaggcugcccccaaaaagaagaaacuugcauggggguuugaagcaaagaagagaugggaaacccaaagugacaugggauaugcauaacuugccagagugcuucaagacauuuguggacucaaaugcucaauuuacugagaacguuuuccagccuguguuaaauaugucagaaaauugauagcacuagaacaaaaauaagcauaaaauuugggaguuugauuaucagcucuuuucaaucuuucucuaagggcuuugucguacugaagugaauaaaaugaagcauucucauauuuguauaagaaauguaagaaaaaauauagaaaaauaggauagaauuuuguuuauuuauuuguauagacccaugguauaaaaucaguuuugcuguuuuucguucauuugguuuaguguagucagugaucuucucauacuuucuuucuuucuuuuuuugagacagucucugucacccaggcuagagugcgguagcaugauuuuggcucacugcaaccauugccuccuggguucaagugauucucaugccucagccucccgaguagcugggauuacaggcaagugccaccaugcccagcuaauuucuuuuuguauuuuuaguagagacggguuuugcuguguugguuagguuggucuugaacuccuggccugauaugauccaucugccuuggccucccaaagugcugggauuacaggcaugagcaaacaugcuggccuuguacuuucuuaucuguauccaguguaacuacacguuuucugguacuguguuuuuaagauuaacaguuguuuauaauggauuagucguaaaugccaaaaaguuucaauugacacugucuuuacaaaugacuugaccuuaauguuauaaaaggaguuacuaauuuuuuuauuggaagcaguagacuugauauuucagaauugcauaguaaaagcaauuuacuaauuuuuuuuguacuuucagauaaacuguuacaauaaagaaaggggcagaauguaguauuuggaagaugauuuaaauucagcaaugccuaaaaaugucuuccuaaguaucuuucucagccaugccauucuuuaaauuaugggaugguucuuagaagugaaaaugguguaauuguauuaagcagacaguuauaacucaagauaauauaacuuugaaccuucuaaaaauuuucauuauuauuauauauauuauauauauauauauauauauauaauauauauauggugaucuguuaucagugaucuuugauguuauuguuguaauuguuuugugguaccaugaaccaugcccauauaauauggcaaacuugauugauaaauguauguguucuaacaagagagauggggcaccccagaccagcuguugccccaucucucucccucuccuggggcucacuauucccugagacacaacaacauugaaauuaggccaauugauaacccuacaauggccucuaaguguccaagugaaaggaagacucacauguauuucacuugaaauauaaugcuagaagugauaaagcuuagugaggaaggcauuuaaaaagcugagauaggcugaaagccaggccuuuugcacccgacuaacuguuugugucagguugugaaugcaaagggaaaguucuugaaggaaaugaaaagugccacuccagugcacacacaaaugauaaggaagcaaaacacccuuauugcugagguggagaaaguuuuaguggucuggauggaaccauccacaaaccauccacaacauugcuuuaagucacagccuaauccagagcaaggucuuaacucucuucaauuuugugaaggcugagagagauguggaagcagcagaagaaaaauuugaagcuagcagagguugguucaugagauaaggaaagaagccaucucuguaacaugaaaguguauauggugaagcagcaagugcugauguagaagcuguagcaaguuauccagaagaucuagcuaagaucauugaugaagguggcuacauuaaacaacugauuuucaguguagaugaaacagccuuauauuaaaagaagaugccauguaaggcuuucugagcuagaaagaagucaguuacugccuucugaguuucaaaguacaggcugacucuuguuaugggcuaauguagcuagugacuugaaguugaagccagugcucauuuaucaauucagaaaucccagggcccuuacaaauuaugcuaaaucuacucugccugugcucuauaaauggaauaacaaagccugaaugacagcacaucuguuuguagcauggcuuaucgaauauucuagggccacuguuaagaccuacugcuuagaaaaaaagauuucuuuuaaaauauuguugcucauugacaauguaccuguuuaccaagagcucugauggagauauacaagaagacaaaaguuuuaaugcuugcuaacacaauauccauucugcagcccauggauccaagaguaauuuugacuuucaaguuuuauaucauuaagucuaaauguaagaaauacauuuugaaaggcuauagaugcccuagauacugauuccucugauggaucuuggcaaagcacauugaaaaaucucuuuggugaauggaaaggauucaccauucuagaugucauuaagaauauuucaugauucaugggaggaggucaaaauaucgacauuaacagaaguuugaaacaaaucgauuccaacguucaugaaugacuuuggagggauuuaagacuucaguggcguaaguaacacagaugugguggauauaacaagagagcuagaauuagaaguaaauccuuaauaugugacugaauugcugcuaucuuaugauaaaacuuugauguaugaggaguugcuucuuacggaugagcaaagaaugugauuucuuaagauggaaucuacuggugaagaugcucugaacauuguugagaugacaaccaaggguuuagaauauuacauaaacuuagaugauaaagcagggaaggguuugagaggacugacuccaauuuuuuuuucugugauggggucuugcuauguugcccaggcuggccuugaacaccugggcucaagcaguccuacugccucagccuccguagcagcuaggacuucaggccugcacuauuguaaccagcuuagauugacacuacuuuugaaagauguucuacuguggauaaaaugcuaucaaaccacaucuuaugguacaaagaaaucuuuugugaaaggaagaaugaauugauguggcaaacuuaauuguugccuuauuuuaagaaauuccacagccauccuagccuucagcaacccccaggcugaucaguuagcagccaucaacacugaggcagacccuccaccaaaaaaaagauuacaacuugcugaaggcucagaagauuguuagcauuucuuaaagcaauaacauauuuuuaaauuaggguuuuuuacauuuuuaaagacauaaugcuauugcacacuuaauagacuacaguauagugugaacauaacuuuuauaugcacuaggaaaccacaaaauuugugugacuugcuuuauugugauacucauuuuauugaguugaucuggaacugaaccugcaauaucuucaagguauaucuguauuucugucuuccaaggcuauaagguaaugugcgcucugcuugggauggagacuguuuucuaaggguguuugauuuaaucuuguuaauaucauguuaauaacuuaaaacuuuguuaaugauuacuucccuugucagucagucauccuggaaaagauagucuggaauaaaacccagucaucuaucugggcucuaaagaagugaagugaagugagagaccccuggaauugucuccuaacagugugaccuuucugaggugucucaguugaauuccucacauguccaugguuuuaucugcuuguucugucucuugguucuaugugaccaccagaaucuccauucagcuauucacugccagacauugucaagagugucacccugcacauaugcaaccuaguguuuggccagagacuuaauaugacccuuauacagauuucugaugcuccuuguauuugauauuaucuuccacaaauuuugcuucaucuccagacuuuauucucuuuuuccgcugcucagaaagacuguaguuuuuugugugcuacaguucugaaagugccuucagacagaaagccagggagauuguagugcuuuuuuucccagagaccacagucuugcuuuuccuguugcucaacuuuuaaaaauauuuguuucaaauauuuuguacaguuuuacuuuauuuuacauuguuuauagugggccagcugguuugugccuguuacugccucaugaccaaaagugaagucuccuaucacuuuaauuugcauuauuuaugaauauacaguauuaugccagcuagacugcaagauugguaaagucagagauguuaucuuuucuucuuuuaaaaauuauuuagaguauuauauaaguggguacucaguaaaugugucuuguuccacaaagcacacaguagaaauaugagacuaaaguauaaaaauucugucccuugauauuauuguuaugguaaugaugagaauuaggauguuauaugacagauuaguuugugguuauuuaccucuagguaaacauaugccuacaguugauaacauaaagcauuuuaugaacugaguuuuugaaagaaaaaauuacuaaagaaauuagauugcuauguuagaugguaucgaccaagacuugaaauagugccauuguauuauauuuaacauuucuccuuguaauguaaauuuguguacuaauuuacggauugaaagggauuuuacauauauuauuuuaaauuaauuuugauuuucucagcaacucucuauguuagguucaguagcuauccucauuuuauugagcaaauuaaagcucagugaaguucuuccauacuuaagauuccaaaguuauaaaguggaagagcugagacugcaaaucgaaucucuaaaugaaguuuaauguucuuucugccuuucugcauaccauagguguggguugccacguuuauuuuaguucuuuuuuuucuuuuugaguguauguaguuuaugcccauuuuauucauucuguguauaggauuaugaaacugaaauuuuaaauucuuuaccuggugagauuguauagauaccaauguuuuaaguuuugugccuguuaaauauuugaaacuacuuuuagaaguuuuauuaaauaguaaaucuuugguaauggcauaaaagguauguuuuuguguuacuuuauaauuacuuuaaauugucaauuugauaauuagguucaaacgauugugcagaaauguguuaaagauuguguauugacauucucacauuaggcuuguucuacuuugaagauuaauauucuaacauuagaauuuuaaaaguauauuuguaguuuaaaacugcuuuaaugauuauuugcucuauaaauaugcauaaauaaggauggcaucauuguaaucgcuuuaaacccuuuuuuggguaauacauccuuaguuggguugaguuggaagugaugaucuuuggaauaugcacaugaauuaauugguuacucuaucuugggauaugucagaaguacuacugcuucagugagaggacucuggcaggagauguuauuuuuuaccagccagcgguguuuaucuugauuugaaggaagcaagcuuuaucaacauagaggauaaugauuuacuugucuuauccuuucucuuuguagccuagagaaauuccagaaaauagucuuuuuuucuuuuuuaggaagaaaauauagucuucauaugaaaagcuuugugugcuuuucugaucaaaauacagaaggauuuuuaucuuuugaucuacuaaauuuacuuaucaacauagguguuagcuuugcuuuucacuccuuccuucaaaauuguaggacagaaauuuggaagucaggaaagcaagugaaugugacaaaugcuuauuuaucuugcaaaagugcuucauaaguauagucuuuucuucagcuuguccuucauaccauugauaaacuggacuuuaaagaacuuauuaaugaagguggcaauuuaguucugccugaaccaacaacuaguuauaugaucuugcauaaaucauuuuuccuuucuugacucaaguuccuucagguaaacaaaagcuauagacuauccaaaagccccuuguaauuuaaacauucugucauuuuaauuguauuauuguuuaguucuucaacuacauuaucaacucacugaagcaaggauuucaucuuccuuuugauaguuuucaaaauauauuguguagcauauucgauacaguaauagaaauuugucuacaaccucaauucucaaaccuugacuuucugagacucagucuuccccauauagggaucucuugcucauaauuccuuuuuuauucaucccucugccuuuucaaaucauucaaauaaaagacuugccagggacccacaaggcuccauauaacuggcucaaaucccccuuguuuacauuucuaaccucauccuuucccacuuuucucccuugcucucuuaacugcagccacacuggcuucuugcuaucccuggaacaacaucaagcaugcuccuucaaggguuugcauuuuuuguuuacuucuaauacacuuucccaagauaucugcacaaguaauuucuuuaccuuuuucaaguuuuugcucauugucagugagucucacuuuaaccaacuuaacagaauuaaaaucgcacucuccuuccuuuugcgcucauaauuagguuauaugccugcccagccccaaaucaaacacaaguucagggcuguagugauugucuuugcugaugcaaaauuauauuugauagugcaaaauuuucauaggguaacugaaaggaacuguuaagaauaucuuagcacauuacauauucuaauuuagagguaaaggucugauuucuuagaaauugguggaagcauuuuaagacucaauuauguuuuauuaagaugaaaucauuugcuuauuuuccaucuguauaucuucuuuggugaaaugucuguucagcucuuucucuuauauuuucuuuauuggguugguuucuuauuacugaguuuugaaagauuuuaauauauccaggauacaaugacuuuguuggauuugcauuuuuuucucccaucuguauuuugucuuuucaugcuuuuaacuaacauugucuuucacagagaauaguccuuucuuuugaucaguuuaucaguuuuguuuuuauuuucauuuagaguucauuuagauuuucauuuccuuuugauuucuucuuugaccguuggguuauuuagaaguauguuauuuaaguuacaaauauuuggggauuuuccugugauguuucuguuauauuuugauaauguaauuccagagaauaucaugguauggcuugaauccuuuuaaaucaguuaggacuugcuuuauggugcauuauaugauuucuucucguauaugucccauaugcacuuaagguuuuguuuuagauuacaguuaaguuauuuggaaacaguuugaacauuugaggcuugcuuuuaagcuuugguaggugaaaccagagucaucuucaguccagugcugauuuugucccacugcuaagguguuacccucugaguacuguacaggauacucuuguugauuaugagguuuucccacucuggguggugugaaugucagcugauccugggauuucccccccauuucuuuugggugauucuuuccucagugucugguaguuuccucauaugugugcacugaucaucagcacuaaagucuuggguggguugguggugaaccuucugcagcucuccagagcucuauuccugugcagcuucgucucuguucucuuuguggagucuagaugcuuuggccuuccaaccucaucucaggaagaccacugggcucugccuggguuucucccaccuugugccacauccuggaaacuccagauauuaagaccaauuguaaggcuuaccuuguuuguuuuaucucugucagggaucacuguccugcauuuacuaaugucugaaaauuguuuaauguauuuuuuuagauuuuuaguuguuagagagagagcaaauacaguuuguacuuucucuuggcuggaagcagauguccuguuuauggauguaaaagugcugcuuuaacauucugcaucuaugguuagaagaaaagcuaugguaacuaaguacauggguaaauaauguuugggaauauaguuaccauggaaguucugaggaucuucugucaucuuucugccaaaaagugauucugcaucagcaucuuccauguuguguuucacaguuaauaacccaagucuucuaugagaaagaaacuggccagauuaggucauguguuugacuuaucagcucuggccugaggucacauucaccaauuguggaugcaacuacugaaaacccacccuggguauaagauguaguucccagaaacgagggaauuguugugaccuggcugucauucucuauguggauuuaauguugauauuuuuuggcuuugaaaggaaaauacuucuaugucuaaaugagaaaaauagcaccuuaaauucaaaauucagcauugguucaaaaucauuugucaugaaagcuucuuuuccaguuauaauauuagauacuccccuuuguccuguuauauaacagaggguacucaugcaugcuaauucauacuggaucagugacagagaggagaagaaauguaauaaacaggugucagagaaaucuguguaaauacaguugaaggggaaaguaaauagggacaauaaauuauaggaaauuaggaggcaaucaaaaccugcgggaagaaaaugagcuggguuaucugcuuccaggucagauaucuauguuacccucuccuuucuaauaaaauuucagcauaauacuggaaauuuuaucuuagaacuaaguaaugcuuuauuuccucaaggugauuggaaaacacaguucuaccagacuaaagggagauguguauuguaacucaacaggaagacauagcuuuacuuguuuuucuuuuuuugaagcagaauucuaaguauuuauuuuuaaauucaccaauuuuuacauaauuagaaucuugaggcuucccuaccuguaguaaauuagauccuggauaccuaugugaauguuuuucuugucuagcuaagaaaaggccuaaaaaugaauaagaaucauuguugcauucucaccguaaugauuaaguaggagaaucuccuauaaugcuuaguagauagaggcaaacaagucuaauagagugcaaaaaaucuccuuguuuucaggggccuguggaguuuugucauaccuccaagauggaauguuuaauguugcuagacagauguccacaaguguuuagaaagagcugcuauucaguguuugucaguaugugauuuagagcuauagaugauuuauugagaagucaggauccugggacauacuuugauuauuuuaaggauggaggugggaguguaaucuacauuuuggaaaaaguuucccaggugauuguuaugcaucugaaaguuugaagccauugucuaaaggaauagggcuaugguggugcuuagauccaaccacuucgacauagggcagaugauuuucccacuauucuguuggagauguugcugucagguuuauuggugugcugccuuauagcugauuguaggaaaggagcagugucucugauaugcccuaugugugcaauuggaagaacugggauagaguuaggaauggaugagggcuuaucaaagaugaaguaugauuuagacucagaauaggcuuuuuuaugugcaauuagucagucuucagugauuuucaagagacauagcaauaguuuugaugucuugcauaaaugcuaguauugagaaaucucauuuaugaaguagucucaaagagacauucaaaagaauagaugcuuggguguguacucagcagucgcaaauaaaaaggaagcuguuuucagaaugagugguauaacaaaaaucugaauagcagucuaagagaaaggcaagcaagaucaguagagccuuggggcuaaugaauagacauuccaguacaacaggaaugcaguaugggcauuuguaaggaaagguuacaguaacaaauuuaucacagauuaucucagggaugauuuuuaugacauacauagaauuuauuauuuuaauuuaaaacauaagaggcugugcaugguggcucacaccucuaauccuagugcuuugugaggccaaggugugaggauugcuucaggccaggaauucaagaccaguuuggacaacauagugagacccugucuguacaaauuauuauuauuuuuuaauuagcugggugugguggcacacgccuguagucuuagcuauuugggaggcugaggcagccucaacugaggcugcaguaagcuaugauugugccucuguacuccaaccugagcaagagagcaagauccugucucgauagauagauagauagagagacagacagacagguagaaagaauugggcaaaccauuuaaucccaagucucaaaaugaguagaucuuauguuaucucugacucaaaauuuuugcuauucaaguucaauaaaaguuggaaucugcagcuuaaaauugagcuugaaaucaaaagaguggguuguuuugcaguauuccaaccuauauuuucuuuuuuuuuuuuuaaguccaauauuuauuuaaaaaucuaaucugccaguuuagcguuuuccaccaacucgagaacugaaacuuucacgggcuucacaaucauuuacuuaggugcugccuuuguaggugccuuaacagcagccauugcaguguuuuuagauacuuugcuuagccuuuuuugcuuccuuagcagcccugauaccuuguucucguugagccuuucuaacuucagguuucugauuccucuuggccauuauaucagcaggagaggcaccuguaauagcccccugcaauuugacugcucggcaaguucuuuucuuuugaauuucuuccaauugucccuuuuugugcuucuuucuguagaggacaguccagcuuaucugccgaggauucccccuggaaaaguacgccgauucgcauuuugcauuaagaaacuggaaaacuuuccugucgguccuggcguagcgccucccguguccgggguagaccuuguaccggcugaaaccgcauagcucgaccuucauggcggcagcuccacgggaggagaaaagauggccccaaccuguauuuucgaguaauacccuuuagaauucauaaaagucuaagaacacuuuguaaauggaauguuucauaguucacacuaaaguaaacauaaacuguuaagcaaaacuuuagaucacuucuucuaacaaaggaaauguacccgagaacccaugagaaguagcuucagaguauuuuuuuuuaacagugaauucucugaggucuuggacuuuuaaauuuuauuuaguuuaauugccaaaagccaagguggagcuguguagcauucugaggaaauaaaaccacuugaagcagagguauaguagaauaaagccauucugccuccaguauuuggguggauguauuugguacuguaaucauuuuacagauugcuaauucauugauguaaaagauacucaaugguaggcauguuggacccauucaauauuguuuuuuguaccuuucuguuaacuuuuguauuauucauauauaauauagauuuaaccaaaucuauuuucuuaaaauugcauauuauuguuuuaugaaauguucuuuuaaauuuuguuaaaauuuuguccgcuuuuucuacagaaguaggaaugaaauauuuaacauuuucugccaguucuuacuuauccacuguguuccagagucuuuaauuuaaauauuuuuguuugccaggcuuagauuuucaugugucuauuaaaagaguaggaacauacuccuccaugccagacaucugcuauguauaagcauugauuauuuucccccuuaugaauaaauguauuucuuuuguuaaguuuguuguagguuaaaaaaaaagcauauuuauguuucuccuaaaauuugggaaaucaauuuauauuacucuauggaguauguaacaaaugauguauucuuuaauucugaauccuguauacaguaguuacacccuuaucuuucauuaauugcugucuguuuguaggguuuugaacuauucugauuauuuugcaaaguuuuuuuuuuuaaauuacgaauguaauguauugcagucaauuuugaaagaaggaaaaagauuuuucuuuuuauaccaauaacacaaaacaucuauuuuuguguauuccuuuuuagauuucaauaugagcuuauuaaaugugguuguaaucauauauaguuuucacuuaauuuucaauauuuguuguugcuauugguuuaaauuacaaaauauuucauaaacugcagcaguccccaaagccccuuguaaauauucaugaacucaaccauaacuuaauauacuugagagaauuaucuuucacuaccaucauaugacugaauuuaaauuuaucuaauguguuuaacuuuuuacagguuaaaaaauuuacagauaguuuuuauaagaaugguuugguuuauauacucuuuucauuucuaaguuuuaaucaguuaucuacuuuuuaguuuacuguuucucuucuguucaauauuuuaaaacuuauucaggaauaugaaaagauaugacaguuuuauuuugacuucugcauuuugauuggguccuucagugaaaaauacaguagcagaauuucuaaugauaaauauuuaauguaaauacugcaaauaaaauauaauuucuuguaauuuuuugaauguaucuuuuaguugcacagauuuuuaaaugcaagagauuagaauaucauaaauaagccuguguauuauuuuaagagcacguauagaggaagggguuguauguugguaaaauacauuuacugacccaugugugaauuggugaccaggauuguuaaagcauugaguucuaaaaguuuuucucuuaucuuuauguucaacaauagaaaguuuuaccguauggucaaauaacaucuucaucagguucucaacaggauaccuuaguuaauuuucagcugagugcuugacaggauuuucucuuuggcuagcugguuggaugagagucuagacacugagaggccaggcuuucguggggccucacaauaucauuauugugcauguugaguaggagcagcuuccucugauguaggggcuccaugcccaaacaacgaagacaaagacagagcuuuuguucucgaagagaagagcuaauccgacugcugcacacugugaaaaaccuuuuaugagagaggaaaaaaaacuuuccuggaaggugaaggguuagcaguuuaaccucugaccguaaaauaagcugguaagggggaaaaaguguuggguaagguagaagaauaacaggagaaacauucaucaagguuuguaugcuguguuuauaaaaacagguuaagcaaauaacugucagggguggauacuugaggucuaauaauacaugcauauuucuaauuuuuuuuugugcuuauucuuaaacauagguguuuaaacuucauaauuugaagaguguauauugcagaccacacuauaaaugcaggaaacaguagaugucuaguauuuacucuuuuuccuaaaaagcuccauuauagacuucugucaaguucugaauauuuauuuucuuguugugugaguacaaaaucuugauccuuuuucuucauuguuuuuuuccccaauuuccuuguuuaauaugaucauguuugucuauagaaauaaagaaguaggacacugcauaucugcgguacauaauuaagacucuuuccaauuugguauuuggcauuuugauaccuauucuguugauacauaggucuggugggcaguguuauuauacaacuccuuggaggagaugguugcaucuuaguguacaaagaauccggaggcucugucugaucuuauauuggcauugucaauaccaagaauguaguuacaguccauuuagaggugauggaaguuaaguugcuaguaacugugucaucugucugcuuuuauuuaccaaccuggacuaauugcuucuccucuugucagucacauaucaaucuugagcaauaauuaagguuuuaugcacuugggcuucuugcuuggauguauuaauguauguaacuuauuccugagaauaacuaugcauauggggaagcagcagcuuauauuguauuauuugagucauauucuaaggaucagucugccauggugucuuuuaacuaacuuaauguuucuucuauuauuccgauucccuuugguaacaauacacauuucuuccuguaguuacccaguuucacuuuuaccaugacagaaaaugaggaaaggagauagagaaggugacagagaggagagauugugcuggccauugagugauaaugagguaagggcaaagagauaaguauagaaaauagaaguugagagugaguugaaggaaagaagaacacgugaaacacauaggugggccaguuaggaauggguggugagcuguugugcagcacucuuaaguuuugaacuaauaauuaguugaccauaaauguaaaaauuucuuaaggaauuacucuuuuaagacagaaguauagaaggauggcauuacaaaacaagugaccagacuugggaagguccugggugaggggagguaaauuuauaugaagagaaagaaagagccaguaauaaccuaccauuuugcuuaaugcauuaccucuguucacuauggucaaauuucugcaucaguaucucagcauuuuuuccaucucgccuuacaaugaugaauaaagugauagcgaauagugauagugaaugcauauaaugauauagugaauauauguaaucuccacucauccuaucaacaucucucaagguggguacugcuauuaucacuacuuuacauuggagaaaagugaggcacagagugcuguguagcuugagaaagaucauguauagcaagcuuguccaaccuauggccugcaggcugcauguggccaggacagcuuugaauguggccaaaaaauucauaaacuuucuuacagcauuuuaaaaguuuuuccuuuuuuuugcucaucagcuauuuuuaguauauuuuauguggggccugagaugauucuccuucuuccacuguggcccagggaagccaaaagauuggacgccccugguguauaaugagugaaugacaaugcauggcaugucuauaugaaguuugacuucaguauccagccacguaacuaccaugccgugaaugcuuuaagaauucacugaagauauaauuauauacuacugaaaguuuuagacuucaaaugauaaucccccaacucuuuuauuguuuuacuuccuuacuacuuuuuuuuaggacaaccuaaaugggaauuaauugcucacuuuccuagaggauagacuaguauuagaauauacaacaaauauaagcauauuuuuggucugaggucaugaauuucaaauuuauucuuuuucuuucaguuuguuuuccugcuauaguuucucagccaauaauuauuuuucuaaaugugugauucuguuuguuguuccaaaggacauaauucuucucuuuaugaguucuuugcuaaucuguuuuaauccuuuuggaugucucauuuucucauuguuucuuacaaguugugauguaaauacucucaagaaguuaccagaauaaaguagugucugcuauuccucgaaacuuucuaguagccaguauccucccagauuucaguuguccuuuauguugaaucaugaaguugucauaugguaauaucaacauuaugggcucuaguaagcuaauuuuuaaagugaucaacccuauucugagauuguauuuucuuuugauagugugccuauaaaauucagacaucucaaaaaugucaaauaauauacauauauaauuuauauauguaccaauucugauuaaacaacuugugucuaacuuauuuuuuuaaaaguucuuaaggucaaggaaacagguuuaauaauguccauguucauuuucuuuuaaaauguuaaccuuagaaucugcaaaauuaggauuaauuuuccugcauuuaguguggcacauuugaaaaaaauuagauaaaaacuauuuucagucuaaaagccaccguaacagauuaaaaaauucaaguagcccuuuacuuuaaacaugugauuaaccguaaagaauuuuuucuuuuccaauuuaaguucccaugucauaauacagagauaaaaaauaauggcccccugacacaccuuauuuggcucacaugguauucaugaaauguuuaauuauuuuucccaacuuaaaaauuaggugauuuuguuuucauaaauauucuggauuuucuugaaaaaucaaaaguaucugucaacacugggcccacauuccacauggauggagcugaauaaugguugcuuuuuugggaaggggaaugggaucuauuuuuuacuacauguccuuuuauagucugucuuuuguaggcucacucuacucauuuuuauuaccuauauauccuaaaggcauuuaaccuugaaaucuccccuuugucuuuucuaccuguaaaaagggacuauauuuguguaauauauaagguauaaauaauuauaccuugacuuuuucucagguuuuaaagaaaaucuuaauuagaaaacaaguuuuauaccauacauaaaaacauuauuuuaaucuguuuuuaaaauucuuugugauauaccucuggcucucaaaguguagucuaggggucuguggcgguucccuggaguacuucaggaguucugugaggucagaacuuuuuucguaguagugaggcauuauuagccuuuuucguucccauuucucacaaguauaugguagauuuuugcauaggcuucaggacaugaugaaguuauaacucugaugacuaaugaaguguguacuugaagauuuuugugcuuuacuaauuuuuaaguuuugauuuuuaauacauaaaugucauuuacuauaacucaccuaaacaaaaguucuuugacgaccucagugauauuugagagaauaaaucaguccugagaccaaaaagcuugagagguacugugcuguacauuaugggggcuaacuaaaaacacgucaguggcaaaugcccaaggauaauuuguauaauuacuauuuauucuacaugauuacuauuuaauugccuauuucuuucuugaaguauggggcuuucuuaauuaguaauagcuuuacucugcucauuugcuuguuaucuuuagugaaaauauguagugaaaauaagggcagaucacuucccucucuuugguguuaaggauuacuugauuuauuauauuaccuuuaaaucagaauugaucagguuuauguuaggguaagccagcuacuuguuaaaauaagcacauuaaaauaagcaaauaaaguuuaugacauuuacugugaaaaauugauaugauagggaauaauuuuauuugcauuauauauauccauugaauggaaagaauggaaaauauacucaauaaaaaacugaaaaagcugccuuuaugaaguguacauuaaaauuugaaacaugauucuggcuuuuaggagcuuuguuuaaaugaggagacacaaauaagaugguuugguagcgaugguuauugucuggaagugggauagucugugugguuguaguauuuugggaaggucucauagcauagaucaggaauaauguauugauuuuagagagacagagaaaagugaacauaggauuucagaagggggugcagcauguguuggaguauaaguaaauccuugaaauugggaauaaauuuuauuuaugugaaaagacacugggauugaguagaaaauuugcauuggaguuggugggaaauacauuuagauagguaggauggaauuggguaggaagugcagaauuuugcaacacugguuuuaguauauggaguuauguuaaaauuuuaaaguucuauaugaggcauuaaauauuaacacaguuugaugaguuggguuuuguuaagcaguagugagccacugaauauuguucugugaagggaggaauaauaagaacucuuaagauuaauuuaguggcagugaguugagaagagcugaguggcaagaagacuaauuaggcaauaagaauuuagaguaagaugaauauggaagaggaggaauggaugacaacugcauuucgaagaaauaacuaacaugguuaggcagcugauuagacguagaggaugaaggcgugugaaggcugauucugaaacuuuuagcauuggugucuggguuccauagguagagugagagggauaugauucaguguuggacacuagucaaggggauguuguaaucaagucauugggaaaauugaauuugagauauagaauuuuugcuucauuuaugcuuaugaauaucuacaaaaacacuuaguuuuagauaucacauuauauauuauguucuuguuuuuaguccaguuuaaaacaauauuugaaacuugaaaaauggcagaagguuuuuaaaaggcuugagaaaaauuucuuuacagaaagauuuguggcaguaguuuucaaccagaacagcacauaagaaucaccuggggaguuuuuaaacaauuguagaugugucuagaaugguauuggguggggugaagggucacuuuuuaaaaauuuaaaugaucuuccuuagauaaucuaaugaacagaaaggguugagaacugcuauguagauauauaggaaauaauuugugaacaaugggaaauagaauuucaguaaaaguuuuugaauuuguuuuaaauuauauguaggggcgauccauuuuuuuuuuucacagcucuucaacaagagagaaaagaguuaaauuaucuucugagauauuuaguuggacauugggaagaacuuucaacuauuaguuuacacuuuaggagggaagcugggagauuuggagcagucccuguauauguguagaauauaaaaggaugugucuuuuuuuaguggaacauaaaggagccugccauguagggagaggaaacaaggucucuugugauccuucuuaccgcugaucuaagauauauggcaauuuuguguaaugucacaugacaaauuaucuuugugaacuuguguuugcucuugaauucugcuuaguagaauccaguccaauuggccucaaaaucagaucacuguuuucuauuagaaauacauagcauuuuuaauauaauucccaguaacuugauaauuauauguuuucuuuuucuuuuucuuuuuuuuuuuuugagaaggagucucacucugucucccaggcuggagugcaguggcgcgaucuuggcucacugcaagcuccgccucccggguucacgccauuuuccugccucagccucccaaguagcugggacuacaggugccugccaccacgccuggcucauuguuuguauuuuuaguagagaugggguuucacuguguuagccaggauggucucaaucuccugaccucaugguccaccuuccuugcccucccaaagugcugggauuacaggugugagccacugcgcccggcgcuaauuauguuuuaagaaaaaugggugaaaauuacuguaggacuuaauuauuaguaagcauguucagacuaauaguuuucugccccuucaaggaaaugauucuuuuugccaguaucacaguguuguauuuaccagucauaaucuugaccucaaagguuaaugauauuuauccauuauuaguuuaaggaaauucuggauaugaucagggaagauuuuagcaauaaaacaacauauuuaauuagaaacagaauaaaauauucacaucucuacuuucauuugcuuuucauucuacaucaacagagaccugugaacugaaauguaauagcuauguuguguucauuuuauuauuauaguuuuauguuaacaaguuucuuaguuuuuacuaugaacauuugaaagguguuccccacaaguccuuagauuucucuaacaugaagguauagaugacaucacaucacauugauauuuagaaucaguuuuuuuccagcuugauaaccucuugaguaccuucugggucucgaucccauuuugagguauucauucucuuuuaguauuucuguggcccuccagggguaucucauaaguacugaggaauugcuugucuaccucaacuacuaugcuucaugccuuugcucuuaaugucucacugcgauuauuuccauaucacugaugcaaucauuugucuagaccuuguuuuagugcuucaccuaggauuaugcuucugacuuuggugggugcugacagugauauucacccucaucuuagcccauuguuugaaguauauccuauuucauuauugcugcacuuggcuccuggacugccauucauaaugauguugcuagucacaggucuuugcaguuuuaaugucaugugauccuucacagccuggguugcgguucugcaaagugaguagggagggcuucucaucaucuauguugaaguucugcagaucuagaacucauuuaguuguauaaaacacgauucuuuucuuuccagaguauuuacaugccagcaagaucacuggguccacgucagguucauaaaacacccacuauaaucuacugggagaguuuccauuggacucuuggacccuuauugcccuugccaugaauucugucucaagaggguagaucaucuuguaaauuuuauguuaucugcuuccuucccugauauuuuaccacaaauugucuauauauauguguauguguguguauauccauauguguguauauauauguguguguguguguauauguauauauauauaucugagucauucauauauauaugaaugauguaaguucuuuuccuaagagguucauuuuaaauauuaucuguagcaucauaacuggguucauuauuuuauuaccuuucaguuuauacucaacacagaagccagggugauccuguuaaaauaugucagagcaugucuccucucuauucaaaugcugcuguggcucccuuucccagaguguaagcagguuccuuuuuaucacucucaaggcccuuuauguucugcuuguucccccuuaacucucugaccucaccuugucucauuauuuucauuuaucacucuuuuagauuuuuuuucauaugaacaaauauaacuuuuuuuuucaaggcuauagucuuuuucagaguuguauaguguuucauagaauaauaaugguauaaucauuuucauauugaugggcauauagguuaucuugcaaaacuuugcuaauuguaaacagugcuucaguaaacauuguuuuauauauauguuugcauauaagaaauauauaauuucuugcauuuuauaaaaaagaauuuuucuguuacaauuucuuuagcugcuccuuuagaaagggucuauucuugguaaaucuuucaguuuugucuuucugaaaauguauuuauuuucccuacauuccuguuugcacaguucuuaaguuguagaguauauuauuccacugucuucuggcuuccauugcugcuauugagaagucugcugucgauguaauaauguauguaguuuucuacuuaccucuuuucucucuaggaugcuuugaaagguauccauaucuuuuuauacuuugcaauuucauugugaugugucuagucaugucugucuugagaucuugcuuagguuuguugucauuuccaaaucuaaagaugugucuuuuaucaguuuuggaaaaucagccuuuauuucuucuaauauuauuuucuucccucuuccauuauacacagucugguaucuuuggucugaucuuuuagaaauuuaaauagauuuauuuuauucuggucuccauuuuucuuaaccucuuuucucauuuauuuugccucuuuauggcucaaucuguuuuaauaucauuugugucugacuuaguucacuauuucugucuucaguuuuauaagauaugcuguucuauucauugagcuuuuaauuucauagauuauauuuuuauauuuuuaaaaguucuaguuuucaaaauuugcuaguucauguuuugaguuauguuauuguauaacauuuuaaauauccuuacaauauaugcuguuucagguaauuuuaauaucugaagccugugugggaggaacaaaaaaaauuaguaucuuaauuccauucuuugugucugaugguuauaaucacagguguuuagauuuucuguaguaauuuugaauuacccauuuauguuaggcaagaccugaguugaucaaguguuucuucuucaagagggcauuuguacuuuccuuuugucaugugccugaggugccaucucuuuagggugacaggauccauuccuaggcuuuguagauacaaagauaaauaagaguuauugcauuuacaguaaguuucuuagugacuuuauuauauucauuagaaucuuaaauuuauucuacauuuacuuuuauuguaacuugaaaauauccugaaagaaaggucaugcaugguuuaauuugguucuuugauguuuuguuuuaauguauuuuucauuuuaaaauuaauuuuaaaauauuuuuagcaguuauucuuaauguagcuuacacauguuuuuauguuagugaacuuuaagucauuuuuguaguuaguaugauucuauucaugaauuuuagcuuauucucaagucauuggaacugugucuguuauauccaggaguauuagaaguuuacuguacuucagaccaucuuuauaucaagcaagaaagcuuugaagcauuugcacaucuacccaaaauuacuuuuugguguaauaugaacaugauuuuaaaugccaugaauaaaaugaagcuguuuuaugagcaguucaguuaauuuuacauucugaaguuucacauuaagacuguuucuugacaauauuuuacuucaaagaguuaaguauaaugaguguugugaauaaaaauauaugucuucuuuuauuuaaccauauacuugcuuuuuuauaauucuuauaauuauaaaaauuauaaagaauuauaacaaacaacagucucaugcuaacuuaaagcauggccucuuaccuucuuuccuccuuaaaggaaucauaauaaaagcuauugcuuuaggauaugaucuuaaagcaacuuuaagaucuuagcugacucaaagguauauuagguucuguaugacagaucaucuuucuacaagcaaccuauuaacuuuuuuucccuguguucuuauaaaaacguuuguguuggcuuuuaaugauuaguaucugaaaaaugucaaaacauuugauucucaguuguaaguuccuugcgauagauuaaucaagauugaacaucugugguacagcauuucuuucccuucuuuauuguugauguuuuuuuuaaaacucucaugaagggcccuugggacagauggccccucacuguugaugguucgauuaccaugaucacccacagcuucagaggagugcgaagaaaagaaauugcuuucuuugucaagguguuuucaauucaauucucacccauuagcccuguuugguuaaguuuggaauuacucuaucaggagauugaugaggguuuucauuuuauuauaauaggucuuguuuaaaaggaauggauguagcaaaauguuauaucuaacaugcuaugaguuauauuuucuuaagguucuuugaaguuccauuuucauuaccuuaguuagaauuugcuaauauuugcucaaaagagagcuuccuuguuuuaaguugugaugcugauuuuacaucuuucuagaaauauuuagaaagguuagaauuauccauuauccaaauuguuuuuuuaagguuugaguuucaaaaacaccaaaauuauuuuaaagugcuaguuugauuuuccaggauggcuuauucgaaugaagauaaucacaguggaucauuacauuaaauuuuauuuccaccauugcuuaugugcauuuuuagaauggugaacaaauggacauauuuucaaaauugcuuaguuuuaauuuuaaauguaugcauuauguaaaauaacaaauagaagugugaucucuauuuuugcaagugauuauaaaguaaaagaucuugaaauaauguuuucauuucugugaggucuuugugugaaucaaacuuacaugauuaaaugaagaauuauuuuaauuucagauugagaagguauugauuugaguauuauuaguaauuaaucuccuugucuagguuucuucacauacaaauuuccaaguauuguucaaaggaagucuguaagauuuaggccauuguuuuacaaaauacaaauauuuggcuuggugagaaugucuuccuauagauaacuaagaaacuuuuagacuuguggauguucuuuaaauuacugucuaaugaaugcacaguaaaaucaaagaucaaccaaguauagcaaauugcagcagcauauuuuagaaaggauguuauauaagaagcaaggauaccugaauccuagucuuggcuucaauaguuacuagcuccagacacaggauacaguguaacuuugggugauuaaaaaaaaagaauauuuaauguccuuucucauucagaaaauacaaaguuucuauccauauauaaugaaccuuuucuugaaauaccaaauaaguaaauaaaagaggccuuauuauuauuauuacuauauuuugcauucacagauagucuuucuguuguccauauuggaacuaauugcuuaaauucaugaaagaaagcauuguaagacauuacagcaagaaaaauuuucucacaugucugaguuggaaaaguacaaaaggacaucuaucuuguuuagauauggacuaccaauauguauguauacagcauacagcauauaaaguuagagggaauaauaggcaguauaucuuguguacacauaacuauaguccuccauaauuguuccuuaaaucaugugguuccagugucacaaaacauucaauuuugaaauaaaauucuuucauugggauauggaacuagaauuauaguaucaguaguauuuggguuuuaaaaacauuuuggugguauuuuucuugcuaaaauuauuuucugcuguaagugguauaguugauguuuguuucuagcccuaugaagauauauuuguugucauaucaagucuauauguaauaaaggaaaauauaaauuauuuauugucauauuuuaaagaauauuuauauuuuuuauaaauauauaaaaaugucaugcauacugguucuucacucuagaauguucuccccugcccacuuuauggcccagauuauccuuugcuugucuuacuuguguaauuuauguccuuuccuuuugaaggaaauauuaaauuucuuaacaugugacgcauaaugcuaaucauugugagagauacauaguccaugcuguuaguucucaaagugugguccugagaccaguagcaucaguaucaccugagagcuuuuuagaaaugcaguuucucggccaggcacgguggcucaagccuguaaucccagcacuuugggaggccgaggcaggcggaucacgaggucaggagaucgagaccauuugggcuaacauggugaaaccugucucuacuaaaaauaaaaaaaaauuagcugggugugguggugggugccuguagucccagcuacucaggagacugaggcaggagaauggcaugaacccgggagguggggcuugcagugagcagagauugugccacugcacuccagccugggcaacggagugagacuccgucucaaaaaaaaaaaaaaaaaaaaaaugccguuucucaggcccaccucagaaguuuugugugugggacccagcagucuguuuguguagauauuuuuguugaaguuugagaacuacugaauuagaccuuuaagaagaugauaaaauuaaauauugucaucuauagguuaacuucaaaauaauuuguacaaacaucugcuuauauauguuuuaucaagauuagauguagucugaauuuaagacuuuccagcaaugaauuuguuuuuauuuucacuguugcuuauagucuuaagguuuauaguacagucuaucauacuauucuuuuuugaguggaucagugaagcuuuuuauuacuacuuugucaaaaugagugauaucuuucuaucaugcaguaaaucuguguuuugccggagucugugccaaggaaaaauggcaaaagugucgaucuucugaaucucuggcuucaccaaagucauuuguggcccuaaaugauugagugaauuguuuccuuaaaccguuuuuuuuaaucaggcugaauauaaaauuaugguaagucugaguauguuggcucgcaccuguaauccuagcacuuugggaggcggaggcaguacgaucaccugagcccacgaguucaagaccagccuggguaacauagcgagaccucaucuuuacaaaaaagaaaaaaaaaauuaguugggcaugguggugcaugccuauagucccagcuacuugggagacugagauggaagggauugcuugaggcugggagagugaggcugcagugagccaugcucaugccacuguacucuacccugggugacagagugagacccugucucaaaaaaaauuacaauaauuaaugaguuugaaaauuauuuuggaagauguaauaaaauaucauuuuaaccauaauuauuaaauuacaugcuuaucaaacuuuuucaaaaauagcacacgucaaaaaagguauuuauauaguacacuuggauaaauagaugagacucuuuuaagaacaaccuagagagucugagggagaaagagacaaggaaauugauuugcuauuuuucaaaaccuacuucugaucauacacagaaagcauuguguuauucauaaguagaagacccagacuucagcuaugugauuucauaauucuacuuccauuuauuuaugucaucuuauuucugaauccuacagucuucaguuauauguuguagaccuuuaacugaaacuaugcuguuuuaaaauacauuuguaucauuugguauaauauauaauauuaauggacuuuucagaaaauaugacuuccuuuuuauuagcuuuagauacguaauucagaucugcagccacucuuuuagauuaucuucccauccaccugacuaacagaaaccucaccccgacagaauccaccaauugagagaaaugccacuuugcugccauuaaaugccauguuggauaucuaccuauauugagaacucugccugaaaugguuauuucauaccuccuccuuaaagcuccaacagcuuuuuuguguguuuuagcagaaagcuuugcuuuagagaacuaccuacuacauagaaaaauauuagcaguuuuuuuucacaaaacucauauuuuugcacuacagauuuacuuggcuuuaugucuuuccucuucucuuuuuccuauaacaauggaaaacguacuucagcuucugucuuaggcuccucucacugucuugaucugaauuccaaccuuccugucuucucagggaucuuguauuccuucuuugcuggcucucugcuagcucaugaauucccauagccuuuuaaacauguucaagucuguaccagucaaaagaaaaaaacaaauaucucuagcuuaagcuuucugucuaccuuuacuuuccucuacuuuguguauccuuucuuaaguaaauugccucuguacauacugccucucuuucaucauacucacucauuccauaaucuuaaaucggccaccuccuuccuacccuuccacugaggcucaucuuacugugguguuaugucuuuuaauauaguugccauucuucagucaucaucucucaauguguugcagcauuuguuugaggauuucuuuuagauacacccucuucucuugacuuucauaauaacacacacucuagcugcauucucccuuucugguuguucuuucuaacuugauuuauacuacugucugcuucaguggcuucccuugccaauccagcuuuaucucuagacauugucucccucuuagucuacauucagauauguuagaugauuuuucaguuucuaaaagguauucugcuuucuuuuaaccuucaagaugucaugcauauugguucuucacucuagaauguucuccccugcccacuuuauggcccagauuauucuuugcuugucuaacuugugucaguuuauguccuuuccuuuugaaguccuuuagugacucucuaaauuauauuuccuuauuaugugcuccugcaguaccccuucuucuaguaucauaaaaaugcauuaaguuuuauuacauuauauauauagaugcuccucuucucuguaagugguagacccuguuuuguuuaguucaccauuauguguccacaggugaaagaauaaaaaucauacauuaccaaaaaauuacacauuuucuuuaaugauuuuugcucauuucauugcuucauuaggaacuuuuuuuuuuuuuuuacauuuuuaagccagugaauuuucaaguugaguucaaauguuccuacaggauaccucacuuaaaagaauauuuuguacaaaaacgaaauugcccuuugacguuucucucugugaauguuguagggcauuguaacgcagggacuuuuccucuuucuuuagcacugcauagauuuuugaaugaaauaaauugaacuuaaguuaaaugggccacaaaaauuugugaauuauuggaaauuauuuaaaacauaugcuccucacaucucaauaaagaaagcuguaaccucagacauuaccuagcuacgugaguaaaucacacuucucauuguuuugaccucaauuucuucauacauauucuucuacaguguggguauauuaggcacugaaacccguaaucaagaaaaauacuaauauuguauauuauacuuuuccaaaaguauguagucucugaacugagauuuuacaaaugcauaaauuugaagauacuguacauuuaaucaucuuugaauuccacagaauuaaguaaauauuauccuuuugugcaaauuggagcucuuuuacugcauacucuuuuuguaguguaguagaaucacacugguauucuaaguuauuuuaauuuuguuuucaguuaagggccaggaaaugugaaauauuugauugggaaaauaaaauauugcugacuuuaucuuacuuuacauuuuaaaaaagccuuaauagugaauuuggaauccuuauguugaugaugugcaaaucauacuuuaaauauucaucuucuaaaguuacugauuuaauaaaaauuuguauuuuuuucuuacuaugcuguaacauuaucucuuauuaaacuaagagauuaaauauauuuaugucaaaaucaaguauucuuccuuuuauauuuauuugguuucuagaauguuggcaguaaaauuuuuuucuuuaauuacgauauggagucuccuuugauuuacugguaggcauuggaaaaaagagaaacacaguguauaucagucauaacuggcaacgaugauucccaccagcaguucucauccuuucacccauaaaaucagcauaaaauugaccuaacauugccagaucagauugaguaucuggaaaguaauccucagggaacagaaaauucagucuuugugcauaaaguuguugaaucggauuauuuuuuucagagcccuuuuguuucuuccuuugcaguacuucugaaaaguugcuacaaagaugugucagauguggucuaaaucuaaucacauaggcaguaacuaaguuaauccauuucaaaauauggaugcacaugauuauaauaauuuuuugcgugcugaaggguaaaauucauuuaaugaaaagagcugggauauuuucuacuuugugcuuaaaccaauagaugcaguuuucauguacuuauuuguucucucuccgaaaaaacagaguauacagaaaaaaaaugguagugaggaaaagucaggcagcaaaacauauuuagguaaaugcuacaaacagcaagggcaaacuguaagcuauucaauaacauaaguauacuuauuuaagacauaguuguaagaaaguugucacaaacaucuucucaaauaguaauuacaaaguugagguuacuuaaaagggagauuuuaaauauucacauugaaacccuguaauuucauuauucaugagaaagaacuguucuguauuucugcaugaggauuuguuuauguagcuguuaguaauuguauuacuuuaugaagauaaaaacuuucauuuaauauuuuaugaaaacucugucauaugccuuuguuuuaugagauucaaauuuuagcagcuaccauuuugguaaaacugccauauaaauauaugucuauuuuuuuuaauugggaauauaauuauccacaagauauuuauguuugaguguuuuuaggugauguguaaugcauuccacauucauuuuagaaauguaugcauuuuguuuuacaugaggauauaaucauuuaauauuaccuucauaaauuuguaauguauuauucuuauauaagauguuuuaaauuauugauuuuuauuauuuauauggaaacuuuuuaguccuuaauaaauaaaaaguuuaauugucgaaagcuuacuuuuuucuuuuuaauuuaaaauaccugaaaaaaauucuguggaacuuaaguauaaacacaagaggagccagcucaugcuaaaaauguugcuagacauuuauugaguuuuauaauuaaaaauuuugaaauauauauguauccuuagguuguguuuuuuagaaaaugguaugaaauauuggaaauaauggaaucaagcuguaaguuuucacugauugguacaugaaguguuaucuuugauccacaaguccuuuuacuuggcguggaguucaaacccugucauaugggugguacuuguuacacacauuagucuuaucuugggcuuucaaguuuuguuuuuuuuuugcccagaagaaauaauccauuauacacuaucccuuuaaaacacauuugaaguauucagaaguuuauuuuugacagaauuaaacaauaaguauauggcuaaaauauuuauuagugcuuacuaaacuaagaucuuagcauuuuagugugcuaaguagaagagaaauacugugagaaacaaagaaaaugaaaaacuggugugaauauuuauaaacaauauugauuuauauauauuaauuacuagauaaaacaugcuagaaaaauuucugugaaaugcccugcaaauaucaauuguauuuuaaaugaacugcuuuauaucuacuuaccaacuuaucuauuacugcaaauaugagauuuaaaaacugauauaaggcaaauauuauuacaguuuuuguaaaucuuaauuggaauuuuaaauggauauuuaagguguauuuuggucuagucucugagagcuauaauauauuuuauuacauacuugauacauuuguauuuuucuuuucaaaggaauaccaguauuuuaaaaguguaguuaaaauagaaaauucagaguuuaaaaucuuaaaaucuaaaguaugucaauaaaaagugaguugcuaaaagaaauacaguaaugauuuuuaauaaccugaccaaguuauuaauaucauuuauuucuauuuugaaggucauuacauuucuuaaaaaaucaaaauauuuaauuauagaaaggaagagaagugaaugucaucaacuauaaauguuuaaagaaaaauuuaaauguuguaauuaaaguagcuuugacaauuuuaagaguguuuaaccaagacuguuccuuuaaauguguucuuuugcugcuguuuaauuauacaugucaauuauuuacagauccugugguauuguggaaauucccagaggacuuuggagaccagguugguaccacauaauuuuuuaaaaaauuuaaaguugaaguauuaugauuguugcuacuauuacugcugcuguugcuaguauaacuacuagugaacauggauugcuaaaauuauuuucucuugaucaacugugagacaaaaaugcaugugugcggaauauauggaagaaucuuuuaaaguuaccaaguagaugggugaugaaggaguccuuauauugaaacucauaggagcuagauguuuaaacuuucaacuuauuuuauacuuguuuaauuuaucuauagacuauauauuugaaaacauuaaaaacaauaaaaaguugacaauaugaaaucuuuguuaaauauacucuuauucuuucuguguacuuagaaguaagcguuacugccauaaauaagugaucaguucucuccuugucacaguaguaucugagucauuuacauauagaaguugaauuaucacuuuuuuuauuuuaaaauaguucuuaccuauagcuuuacuuucuuuaaaaaauauggcaugcaagacuacuggaugaauuuauuccauuugcauuuuauguuauagucuucuguaguuccucaaauauuuaguaugaccaaaaugaugcaguaguuuuacaugauauauguaaauagaaaaaucauuuaaacuuuauguuauagauuuaucauuuugauguugcuuuauauguaauauaugguaaauaauacagauuuaaggauuuuuuugccaauuuuuugcuuuuuaaaaauugauaaggcuggguacaguggcucacgccuguaauccuagcacuuugggaggcugaggcgggcagaucaugaggucaggaguucgagaccagccugacuaacauggugaaaccucgucucugcuaaaaauacaaaacagccgugugugguggcgugcgccuguaaucucagcuacuugggaggcugaggcaggagaaucacuugaaccugggaaguggagguugcagugagccgagaucgugccugggcaaccaaugugagacuccgucccaaaaaaaaaaaaaagauauauaauuauacauauauaugggugauauuuauuauugguguauauguauauaauauauguauauauuauaugcauauaauauauuauauaauauauuauauauuauauauaacaauaguuauauauaauauauuauaauaauauaauauaauauauuauauauaauauauuauauauaauauauuauaauauaauaauauuauaauauaauauaauaauauaauauaauuauuuuuuuuuuaauuuuuuuuuuuuauuauacucuaaguuuuagaguacaugugcacauugugcagguuaguuacauauguauacaugugccaugcuggugcgcugcacccacuaacgugucaucuagcauuagguauaucucccaaugcuaucccuccccccucccccgaccccaccacaguccccagagugugauauuccccuuccuguguccaugugaucucauuguucaauucccaccuaugagugagaauaugcgguguuugguuuuuuguucuugcgauaguuuacugagaaugaugguuuccaauuucauccacgucccuacaaaggacaugaacucaucauuuuuuauggcugcauaguauuccaugguguauaugugccacauuuucuuaauccagucuaucauuguuggacauuuggguugguuccaagucuuugcuauugugaauagugccgcaauaaacauacgugugcaugugucuuuuuagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugauaucucauagugguuuugauuugcauuucucugauggccagugaugaugagcauuucuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcgaaaauuuucucccauguuguagguugccuguucacucugaugguaguuucuuuugcugugcagaagcucuugaguuuaauuagaucccauuugucaauuuuggcuuuuguugccauugcuuuugguguuuuggacaugaaguccuugcccacuccuauguccugaaugguaaugccuagguuuucuucuaggguuuuuaugguuuuaggucuaacguuuaaaucuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucagauaguuguagauaugcggcauuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggcgaugcgggcucuuuuuugguuccauaugaacuuuagaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguguccucuuuuauuuccuugagcagugguuuguaguucuccuugaagagguccuucacauccuuuguaaguuggauuccuagguauuuuauucucuuugaagcaauugugaaugggaguucacucaugauuuggcucucuguuugucuguuguugguguauaagaaugcuugugauuuuuguacauugauuuuguauccugagacuuugcugaaguugcuuaucagcuuaaggagauuuugggcugagacgaugggguuuucuagauaaacaaucaugucgucugcaaacagggacaauuugacuuccucuuuuccuaauugaauacccuuuauuuccuucugcugccugauugcccuggccagaacuuccaacacuauguugaauaggagcggugagagagggcaucccugucuugugccaguuuucaaagggaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuuggcuguguuuauaugcuggauuacauuuauugauuugcguauauugaaccagccuugcaucccagggaugaagcccacuugaucaugguggauaagcuuuuugaugugcugcuggauucgguuugccaguauuuuauugaggauuuuugcaucaguguucaucaaggauauuggucuaaaauucucuuuuuugguugugucucugcccggcuuugguaucagaaugaugcuggccucauaaaaugaguuagggaggauucccucuuuuucuauugauuggaauaguuucagaaggaaugguaccaguuccuccuuguaccucugguagaauucggcugugaauccaucugguccuggacucuuuuugguugguaaacuauugauuauugccacaauuucagagccuguuauuggucuauucagagauucaacuucuuccugguuuagucuugggagaguguaugugucgaggaauguauccauuucuucuagauuuucuaguuuauuugcguagagguguuuguaguauucucugaugguaguuuguauuucugugggaucgguggugauauccccuuuaucauuuuuuauugugucuauuugauucuucucucuuuuuuucuuuauuagucuugcuagcggucuaucaauuuuguugauccuuucaaaaaaaccagcuccuggauucauugauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuuguaggcauuuagugcuauaaauuucccucuacacacugcuuugaaugcgucccagagauucugguauguggugucuuuguucucguugguuucaaagaacaucuuuauuucugccuucauuucguuauguacccaguagucauucaggagcagguuguugaguuuccauguaguugagcggcuuugagugagauucuuaaucuugaguucuaguuugauugcacuguggucugagagauaguuuguuauaauuucuguucuuuuacauuugcugaggagagcuuuacuuccaacuauguggucaauuuuggaauaggugugguguggugcugaaaaaaauguauauucuguugauuugggguggagaguucuguagaugucuauuaggucugcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuaugaaucugggugcuccuguauugggugcauaaauauuuaggauaguuagcuccucuuguugaauugaucccuuuaccauuauguaauggccuucuuugucucuuuugaucuuuguugguuuaaagucuguuuuaucagagacuaggauugcaaccccugccuuuuuuuguuuuccauuggcuugguagaucuuccgccauccuuuuauuuugagccuaugugugucucugcacgugagauggguuuccugaauacagcacacugauggguguugacucuuuauccaacuugccagucugugucuuuuaauugcagaauuuaguccauuuauauuuaaaguuaauauuguuaugugugaauuugauccugucauuaugauguuagcuggugauuuugcucauuaguugaugcaguuucuuccuagucucgauggucuuuacauuuuggcaugauuuugcagcggcugguaccgguuguuccuuuccauguuuagcgcuuccuucaggagcucuuuuagggcaggccugguggugacaaaaucucucagcauuugcuugucuauaaaguauuuuauuucuccuucacuuaugaagcuuaguuuggcuggauaugaaauucuggauugaaaauucuuuucuuuaagaauguugaauauuggcccccacucucuucuggcuuguaggguuucugccgagagauccgcuguuagucugaugggcuucccuuugaggguaacccgaccuuucucucuggcugcccuuaacauuuuuuccuucauuucaacuuuggugaaucugacaauuaugugucuuggaguugcucuucucgaggaguaucuuuguggcguucucugaauuuccugaaucugaacguuggccugccuugcuagauuggggaaguucuccuggauaauauccugcagaguguuuuccaacuugguuccauucuccccaucacuuucagguacaccaaucagacguagauuuggucuuuucacauagucccauauuucuuggaggcuuugcucauuucuuuuuauucuuuuuucucuaaacuucccuucucgcuucauuucauucauuucaucuuccauugcugauacccuuucuuccaguugauugcaucggcuccugaggcuucugcauucuucacguaguucucgagccuugguuuucagcuccaucagcuccuuuaagcacuucucuguauugguuauucuaguuauacauucuucuaaauuuuuuucaaaguuuucaacuucuuugccuuugguuugaauguccucccguagcucagaguaauuugaucgucugaagccuucuucucucagcucgucaaaaucauucuccauccagcuuuguucuguugcuggugaggaacugcguuccuuuggaggaggagaggcgcucugcguuuuagaguuuccaguuuuucuguucuguuuuuuccccaucuuugugguuuuaucuacuuuuggucuuugaugauggugauguacagauggguuuucgguguagauguccuuucugguuguuaguuuuccuucuaacagacaggacccucagcugcaggucuguuggaauacccugcugugugaggugucagugugccccugcuggggggugccucccaguuaggcugcucgggggucaggggucagggacccacuugaggaggcagucugcccguucucagaucuccagcugcgugcugggagaaccacugcucucuucaaagcugucagacagggacacuuaagucugcagagguuacugcugucuuuuuguuugucugugcccugcccccagagguggagccuacagaggcaggcaggccuccuugagcuguggugggcuccacccaguucgagcuucccggcugcuuuguuuaccuaagcaagccugggcaauggcgggcgccccucccccagccucguugccgccuugcaguuugaucucagacugcugugcuagcaaucagcgcgauuccgugggcguaggacccucugagccaggugugggauauagucucguggugcgccguuucuuaagccggucugaaaagcgcaauauucgggugggagugaccugauuuuccgggugcggccgucaccccuuucuuugacuuggaaagggaacucccugaccccuugcgcuucccaggugaggcaaugccucgcccugcuucggcucgcgcacggugcgcacacacacuggccugcgcccacugucuggcacucccuagugagaugaacccgguaccucagauggaaaugcagaaaucacccgucuucugcgucgcucacgcugggagcuguagaccggagcuguuccuauucggccaucuuggcuccucccucugauuuuaauauaauaauuauauuauauuauauuauauuauuauauuauauauguauauaauauauguauauuauauaauauauguauuauauuauauauguauauauauguauauaauauauguauauaaauauaugcauauaauuacacauauauaugggugauaaugauauagauauuauacauauaugugauauuuugauacauguauacaauauguaaugaucaaaucaggguaaucagcauauccaucaccucaaacuuuuaucauuucuuucacugggauuauucaaaaucugcucuucuagcuauuugaaaauaugugauaaauucuuguuaauuauaaucacccuacaguguuauagaacacuagaacaccauuccuccuaucuaucuagcugucauuuuggauccauuaacuaaccucuggcuaucagccccaagccccugccugcccuucucagccucuaguaaccacuauucuacucuacuucuaugagaucaauuuuuuaagcuuccaauaugagugagaacaugagacaucugucuuucugugccugacuuauuucacuuaacauaauauccuccaagcccaucuguguugccaugaaugacaggauuuuguucuuuuuuuauaguugaauaguauuccauuuuguauguauaccauauuuuuuaauccauucauuuguuuauggacacuuagguugauuccauaucuuggcucuuguguugcaauaaacauguaucucuuugguauacugauuuucuuucguuuggauauauacccaguagugggauugcuggaucauaugauaguucuguuuuuaguuuuuugaggaacuuccauacuauuuuuuauauaauugcuaugcuaauuuacauucccaccaacaguguguggaguuccccuuucucugccuccuugccagcauuuguuaguuuuugucucuuugaugauaacuauuguaacuggggugagaugauaacucuuugugguuuugauuugcauuucccugaugauuagugaugcugagauuguuugaugugccuguuggccauuuuuaugucuuuucuugagagaugucuauucagcucauuugcccauuuuaaaauuguauuguuuguguuuuugcuguuguuugaguuccuuguauauucuggaucuuaauaauuugucagaugauuaguuuacguauacauucucccauucuguugguugucucuucagucuguugguuguuccuuuggcugugccgaagcuuuuuaguuugauauaaucucauuugucuauuucugcuucuguugccugugcuuuuaagguuuucuuuaugaaaucuuugcccaacgcaacauccugaaguguuuauccuauguuuuguccuacuagcuucacgcauuauuccagguuuuauauuauacaaauuuaaguuuugauagaaauaaguacuuuuugcuggaugccugaugagcagguuccuuucuuaugucuucaaauaaaugggauaagacagucuugucacuguuaaauucagaauacacaaacuuagcuauaauuuaaguccacagauggaguucucaccauuugcaaacaugaaagcugauaaaaguauguguuuaaagcaguucauucagaaauaagccuacagacaugugauuuugaauaaacaugaaagaauacuuuuuuagaugugaaagucaaucugacuuagaaauuacacucaaaaagucugauaaaugggcgugauaaauauuaauuacgucuaguacaaccuuugaccaugguuucacauaaaaagaggguauagaauuauaauuugauuuuagcuuuuuagauuuauaaauaucuuaaguauguaaaagaacucccuacagugaagacaugacuugggaauaagaaguuugcguuuguucucaaauagcuuguaguuagacuagagccuugcucacucauuuuaccauuccaauauauauauauauauauuuuagucuucucaauucugucuugucuguucaaccaauuacaaaccuccuauuccuguucaggucuuuuuuuuuuuuuuuuaaauuucuaccuuuuacuuuauaaacugccucugagcauuuuuagggguucugaagacugcuaacuuuggguucacaugagagugauaauguacuugucagguccagcuuggauuuuuuucauuuggggcuuaauuguuguucuguuucugaaauugugagaucacugggacaucaauaagcccucauaugcuuagugaaauacagaagcgcuuaaccauguaaugguggugaacauucauaacucuuaggauucuaguuuacaacaauucuuauagccuucuugaagguuagagcugaaaggaacuuuagauaccauuuuguguaucuaugucauuuuacaucuaaagaaaucaagcuuuacaugggaaucuagucaagggccuugaauaauuguuuugcuauauacuuuuuagggaauuuauugaauuguacagaagagacaaguacucuguguauauuucuuaacccuuuucccuuuuacugcuuuucucuaccaacugcauucuccuuaacuagccuuuucucuggaugugcggcuaccucaguaauuauaaucuuaaaaagcucuuuguuucacucuuaccaugcacugggcacuauacuaggugcuuuaugugcauacuucauuuuauuuuuaaauccucccagggcuaauaggagauaguauuauaccugaacugagucuuaaguaagaaacuuaccugaggucacagugcuuguaagaggcagagcuaagauuugaagacauguuugucugacucaaaagcguuuacucuuaaauuuuuagcuuuauuuuuuuuuuucugcuuggaauguugucucaaacuuaccucacuuauuuuagcucccuuaaaaaagauuauuguaauaauuuuucucuugguaucuuuagaauuuaaaagcaauauguaauuuaguccaaagaaauaauaucaauccauuuuucauaacauggaguuguuaguacccguaggcacugguuuauuauacgcuucucgcaguauguuuuccuucuuuuggcaauugaggaaccagugggacaacugacauggcauuucaggagcuuugauuauauauuuuuucuuuuuuugauacaguggaggguuuuguacaggagaguauugggagauaaaacuauaaaaguaaaugagcuagguuuuggcacaguuugccuugcuaaagaguugguccuucaagugggagagauuucaguauggauugguuuugguagaaacuagaggcgaggaaauuaguuugguaguuauuuuaguaguucagugaaaaguaagaaggaucugaaauagucaguuacauuaggaauggaaaagaguauaagugugagggaaaaaagagauugcaugaaaacaauuuuuauuuuuuauugauugauugaggcaguuucuuaaccuguugcacaggcuggagugcaguagugcccucaugacuggcucccagacugaagcgauccucccaucucaaccucaagcaauccucccaccccagccaccaaaguggcuaggacuacaggcauguaccaccacuucuggcuaauguuuuuuauuuuuuguagagauggggucucacccuauugcccaggcuggucgugaacuccuggguucaagugauuuuuuccaccuuggucucccagaguccugggauuacaggcaugagucugaccaaaaaguuuauuuuugagggacuggagagagauggagaaaacuaaagaagagaggaugaguuugauuuuuaucauuucaagaaauguugaacaauuuucuaugugagugaagagaggaggcaucagagauuugaaaagaauggagaauguuugcaaccuaagaaaauaaaaaagugugaauauucaaauuugagaauugccagagguaggaauaacuuuguuauuguaggcaaaaaaauuaaucaguaagccagggaagcaaacccaucaaaauugauugaaguuuauuuuaacaauuuuuguagcuucuuuuuagaaucagauauuaucaaacaagacaaaaaucacauuuuauucccuugugugcucauguucaagaccaaacacuuuaagacaucucagaggucugcaaagucaaaaugaugaugaugaaaaguaauaccauaaucauuuaugguauuuguguuaacauccaacagauucaugauugcuauuauauggauccauaccucuuaaaaaauguuucaaguuuaauuucuaauauaauacauuucaauaguuauacaugaacaacagcucuccagggucccuaauaagucccaauaaagaaaaggaguauagagguguuuuuuuuuuguucuuucuuucuuuuuucuuuuuuuuguaaaagcaaagcugaagugggccgagugcuguggcucacguguauaaucccagcacuuuggaggccuaggcaggcagaucacuugaagucaggaguuugagaccaaccuggccaacuggugaaacccugucucuacuaaaaacaaaacaauuagccgggccugguggugcaggccuguaaucccagcuacuugggagacugaggcaggagaauuacuugaaccagggaggcggagguugcagugagcugagaugcugcuacugcacuccagcccaggcgacagagugagacccuaucucaaaaauaaaaacaaaacaacaaaaaaagcaaagcugaagugaacugcugauuuagggcaaaauaauucuuucucuuuaaaaaacaaaaguauauacucaguuguuucuuugacacuguugccccuaguuuagucuuaaacacucauaguauuauaauuacaacuuuuaaucuaaguaacuaaugucuuacaggaaaacaacaacaacaacaacacuugagggguagaugauugagaacuuucagucauacacaagcauuuuaacagacugccagagcugcccauaucucuuuuauguuuuaguaaaauaggaaaagugaacacauuuguuaacauaacucaauugccuuuugauggcauacaaaaauaagaagaaaaaguauauagacaaauugugcuuaguaauuaauguuuuagcauucugaggaauuauccauugauuaagucaauuuaauaucaauuccacauuuugguuaccuaaagauuuuggaaauuauauucaaguagauguacuacauaauauaaucacugcugacauaaaguuuuccagaauagugauuaaguuugguuaaauagaaauuuacauguuauauaaccuuaacgugucauaguugcuuauuaguucaauaacuuguauacauuuggaaaaaacauacccaaguagaauaaaauguguacuugcucuguccuuaacauuauuaaaucagagaagacauggcuauuuuuauuaagccaaaguuauaaaacuugaguuuucuaaagauuuaccuuaauaaugugaauuugaauccucuaauaauuauuuugaaagucuagcucauuugaaauauuagaaguucaacuuccuauuuuauagauguuuugggaauauucuguuuguguacauuucucucuagaaguuagucagaacagugucuuuaauuuaugaggcuuuauaaucuacuuuauugauagacuccagagauagggaaacauuucauacuaacacaagagcaaaggucuuuaugaaauauagacauacggucucacaagcaucaauauuuuuggugguguuuuuaguuauacuguguauaauaaacagagugaauagauauguagaaaaauuguaagaauuauaaaaguaaugcuauauuuuuaagguauuuuaaguuauauuuuugauuguuacucuuaaauuagagaugaaaaauuuuaccaaauuuuaaacaaaugaacauagccuaggcaauuagcauguagcucuaguugucuuaagaauuuaaaauuacucguagaguacuuugaaaggugcuugucuggcacaauaaagcuguaaagaagacgaugugguucuugcccuccagaagucuguuaggagaaggaagauuggacugggaaucagaugugagcuguucuggcuuuucuccuuuuucuuucuucuuucuucuucuaucuucuuucuuaaaaaaaaaaagccggggaagggggggauacaaguacagaaccugcagguuuguuacauaggcauacaugugccagggugguuugcugcaucuauucaccuguccgcuaaguuccuuccccucaccccuggcccccgaaugggcccugguguguguugucccccuuucuguauccauguauucucauuguucaacucccacuuauaagugagaaaauacgguguuugguuuucuguuccuguguuaguuugcugaggaagauggcuuccagcuucauccaugucccugcaaaggacauuaucucauuccuuuguauggcaguauaguauuccaugguguauauguaccacauuuucuuuauccagucuaucauugaugggcauuuggguugguuccaugucuuugcuauuguaaauagugcugcaacaaacaaauguguacgugugucuuuauaguagaaugauuuauauuccuuuggguauaugcuuaguagugggauugcugggucaaaugguuauuucugguucuagauccuugaggaaucaccacacugucuucuacaaugguugaacuaauuuacauucccaccaacaaagcauuccuguuucuccacagccucgccagcaucuauuguuuccugacuuuuuaauaauuaccaugcugacugucgugagaugguaucccauugugguuuugauuugcauuucuguggugaucagugauguuaagcuuuuucucguuuguuggcugcauaaaugucuucuuuugaguagugucuguugauauccuuugccuacuuuuugaugggguuguuuuuucuuguaaauuuguuuaaguuccuuguaaauucuggauauuagacguuugccagauagguggauugcaaaaauuuucucccauucuguagguugccuguucauucugaugauaguuucuuuuucuguuaguuuaauuacaucucauuuaucaauuuuggcuuuuguugaaguuguuuuugucaugaagucuuugcccaugucuguguccugaaugauauugccuagguuuucuucuagaguuuuuaugguuuuugguuuuacauuuaaaucuuuaauccaucuugaguuaauuuuuguauaagguguaaggcagugguccaguuucaguuuucugcauauggcuagccaguuuuccuagcuccugaauaggagauccuuuccccauugcuuguuuuugucagguuugccaaagaucagaugguuguaggugugugguguuauuucugaggucucuuuucuguuccauuggucuauauguuuguuuugguaccaguaccaugcuguuuugguuacuguagccuuguaauacagucugaagucagguagcgugaugccuccaacuuuguucuuuuuacuuaggguuuuacuuuuuacuuggcucuauggagucuccuuugauuccguaugaaauuuaaaauaguuuuuuucuaauucuaugaagaauuuaaugguaguuugauggaaauaacauugaaucuauaaauuacuuuggacaguauggccaucuucaugauauugauucuuccuauucaugaggauggaaugcuuuuccguuuguuuguguccucucuuauuuccuugagcagugguuuguaguucuccuugaagagguccuucacgucccuuguuagcuguauuccugaguauuuuauucucuuuguagugauugugaaugggaguucauucaugauuuauuugguucucugcuugguuauuucuaguuuauuugcauagagguguuuauauuauucucugaugguaguuuguaaaggaauacuuugugauauuugcacauugauuuuguauccugagacuuugcugaaguugcuuaucaguuuaaggaguuuuuaggcugagaugaugggguuuucuaaauauaaaaucauguugucuguaaacagacacaguaguuugacuuccucucuuccuauuugaguucccuuuauuucuuugucuugccugauugcccuggccagaacauccaauacuguguugaauaggaguagugagagagggcauccuugucuuguaccaguuuucaaagggaauguuuccagcuuuugcccauucagugauauuagcuguggguuugucauaaauaacucuuauuauuuuggaauauguuucaucaauauuuauuuuauugagaguuuuuaaccugaagggaugucaaauuuuaucaaaggccuuuucugcaucuauugaaauaaucgugugguuuuuguuuuuggcuccauuuaugugauggauuacauuuauugauuugcauauguugaaccagccuugcaucccagggaugaagcucacuugaucaugguggauguuuuaugaugugcugcuggauucgauuugccaguauuuuuugaggauuuuucgcauugguguucauuggggauauuggccugaaguuuucccuuuuuuugugugucucuuccugauuuugguaucaggauuaugcuggcuucauuaaaugaguuagggaggugucccuccuuuucaguuauuugaaauaguuucagaaggaaugguaccagcuccucuuuguauuucugguagaauucagcugugaauccaucugguccugggcuuuuuuugguugguaggcuauuaauuacugccucaauuucagaacuuguuauugguguauucagggauucgacuucuucgugguuuaguccugggaguguguauguguccaggaauuuauccauuucuucuagauuuucuaguuuauuugcauagagguguuuauauuauucucugaugguaguuuguauuucugugggaucaguggugauauccccauuaucauuuuucauugugucuguaugauucuucucccuucuuuauuagucuagcuaauggucuguuuuguuaauuuaaagaaaaaaacagcuucuggguucauugauuuuuuuuuuuuggugaguuuuucaugugucuaucuccuucaauucuucucugaucuuaguuauuucuugucuucugcuagcuuuuggauuaguuugaucuugcuucucuagcucuuuuaauugugauguuagggcaucaauuugagaucuuucuagcuuucugauguggccauuuagugcuauaaauuuuccucuuaacacugcuuucgcuauguaccagagauucugguauguugucucuuuguucucauugguuucaaagaacuucuugauuucugccugauucauuauguacccaggagucauucaggagcagguuguucaauuuccauguaauugugggguuucgagugaaugucuuaaucuugaguucuaauuugauugcacuguggucugagagacuguuuugauuucuguucuuuugcauuugcugaggaauguuuuacuuccaauuauguggucaauuuuagaauaagugugauguggcacugagaagaauguauauucuguugauuugggguagacaguucuguagacaucuaccagguccacuugauccagagcugaguucacauccugaacauccuuguuaauuuucugucuuguugaucugucuaauacugacagugggguauuaaagucucccacuauuauugugugggagucuaagucucuuuguaggucucuaagaacuuguuguaugaaucugggugcuccuauauugggugcauauauauuuagaauaguuaacucuucuuguugaauuguucccuuuaccauuauguaaugcccuucuuugucuuuuuugaucuuuguugguuuaaagucuauuuugucagagacuaggacuacaaucccugcuuuuuuuucuuuccauuugcuugguaaauuuuccuccaucccuuuauuuugauccuauauguaucuuugcaugugagaugggucuccugaauauagcacaccagugggucuugacuauccaauuuguguucuggcucuacuucuaauuggagugcaagacugagauucaugaggaaaugcugguguuuaggaggaguacauagaaggugaucuuuaagccuuauuuuuugaucacugaguuuuguccuuuaguugguccucuuuuuagggugagaguggaggacacugccauauaguucagauaauugagugugauacccuauuguagcagaaagacagaaugaugaaauuaauucaugauuugaaguuguaguagagugauagagauguuggaauguuguuucuuuuauuuaauugaagauuuacauaaauuuuugguaauauagacaugaguuugaauccuaacccugucaguuauauggguuuugccauaaaaaaaaauccccugcuaucagugacaugauaguucacaggauucauuguaggaguuaaggucugucugaagcacuguggaagauauucagcaaaugagagggcauggucagacuuccuucacacacuaucccugucuucuuagguuuuguuucuuuuccuuuuuuuuuuuuuuuuguggaauuucuguuuuuacuuuuccauucuguuucuucuuuugugugguccaguucuguuaauuaaaacucaguuugaaaauuaauccuucuuugaaggcuuuccugagccuccaaggcaaccugucuguacuuccguagcuucuuauauguaccucuaauuuuaacuauauuuucauuuuuuuuuuuuuugcaugucucugucucuccuaggcuguauguauguuucuugaaggaaaaggggcagaacuuucucauuuuucaaucuccacaucuaguagaguggcuggaacauaagauaugaauaaguguuuuugaacggcuaguugaaugagugacaagucagaggaaguugaauaaacucaugauaacuuaucuuaauuuucuuggaaaaauaauaggcaagguaauuuaagaaggauggauuuaagagugguguuucaccuuaaauuuggaaagauuucaaacugguguuaugacacauaucguaggaauucaacaaaguuugaaugaaaugauguaacuuagcagagggguuagguagcaugaagauuuaauagguccuugacuguucaugauaguaccugacuuguuuguucucuccucugucccucauuucuguaggaggugaaauuaaauuucaguauauacugacaaccuaguaugugcuuccaugauaaauaaugaaaaugcauuaagaaaugcuuuuagaaaagugcauauguuacaugauuauuuuaaauuauaacaauaauaaaaauuccauuaauuaaucaaaucuugguagaaauuaucuggaaacaguuuaaaguauaacuguaagaaugaauaguaguaaaaauuauguauuauacaaaaacagcagagaauuuuaaauuuuacccuucagcugcaucuucauaggaaugaauggcaggcagccagcuacuuagcugacauuaaauccagucuacucaguacuauauacaguuuuguuuuuauauuuaauaaugacuaaugggucauuauugaauauaaaaaggaugggucauuauugaauaaaaaaaggaugcagguaggaguuaaggucugcauaguuuaggaagaaugccuguuuuauuaguaaacaauuuuuuuauacauucauaauuuaaaaaauuuuguauuauuuaaaagguauuugguaggaaugauuaguuuuucauuauuugaaauugagacacauugaguauucuauaauuuugcuucuugcaucaucauaaagaagauauaaauuauucagaaauaauuuauuaaauucuaauacucugaaaauaaauauuuaaaugaucguggauuucuaaaaauuggauauuuuuugguuguuugggcuugauucugucauuuuuaacuaccagucaauuacaugagacagaaauaauuucauugcauucuauaucaacuauuguuuuuucaaauguaaagaaugaaaugucuugaaccaauuuuugauauguaauaguaaauucccuauaaauguuauauauaaacuccuuuuucuaacccugugaauauuauauauaaacucguauuucuaaaacaaauugauuucuuaauguuuaauuaaauaaaaauuuauaaauuuuguagagaugauggguaaauguaagauaauuauaauuauauuauggcuguuuacuugguuucauauuccaaaaauuuuauuaguuauauauuucaguaaugcuaaaauagcaauuauuuccuaucggcuucuuuguacauacaaccacuauagugguauaaccacuauaccaauauacuauugguauauucuuaugacuaaaaaagaugaaucagaacgaaacauuauaaggggcaaacguggaaaaauguauaaaaguaaaucuaaaaucaucaucauaaacauaucuuuguaucuaucuaucuuauguagacuagauuuuuauuucuuuagcaggcgcaguuuaggaagcucaaggcaaaacauaaucacauucuuauuuuaccugcaugcuuauuuuauauucucuacugcuaaaauuuuaaaauuuuaaugcaaacagggaaacuaauuuggaaaaacauagugauauuuuaugaacuuugcuuuauaguugaaguauuugcuggaauauuucaucuagcagacucccauugaaaagaauauuuuugcguacauuuuagauaauaaaauuguauuugaaaaccccuguacaaaugaccuuauuuuucuguugaagggugaacagauuuuuacuuuaaugaguucuuagaggugagguuuuuauaucuauuuuuauggcagugaaauuuacauucuaacuauauaaaugauucaagccagaccuggaaggucugauguuaugcagcaaucuauagaaauuaaauaaugauaaaugauucugauugaaagaaauaaaucugguuucccaaaagcuuacucuuuauuaagcuguaaacauuugucaaaagugaaacuggaauuuaguucuauaaagaguucugaaucuuugagagaaauagaguggagaaauuauuuuuucaagguuaccuaacauaggcugaugaauuagaagcaauucuccugaagucgggagaaaaaacauaaauauaacaugacaugaaaaucucucuucuaguucaaaguuuugcauuucaaauuuaucuuuaguuugaaaagaaguuaaaguuaguuaacugugaagugaaacaaauaauggaaacaacaagaguagcauuuaaaauguuacucgguagaaaauaaagucuugcaaaauuggcauaaacucauuauuaacucauaaaauauguuacuuugaaauaauuuuguuuauuauaacuguauauugcuuuaaaaugacuuuuaggggaauuuuucuaauuuuuuuuuagcaaaauaaggcuaaguugaguggguuauaaaaugaauaauuauccaugaauugccaucucaccuuucucuuuggugugauuucuauuuuuccuucccccuuucacauuauuaauagauaaacgauuuaaaggaaguauugucagguuacuuauuaauauuuaaaauuuaagccugaaauacacuuuaggauaagaaguagguaugaagguacuucauuauuaaaauuuuuaaguuuaaaauuauuguguacuagcugaaaauauugaacuugaucaacauauguuaccagcuagccucuucuccacccgaucuuuuguuaucuuguuauuguuauaaggcuuaaugacaguuguaggccauaguucuggauguggggguuauucuacccuggggagaagaggaggaaacagcaguguggauuauggaaauauggacugaucuaaaaagagaccucuuguaaaagaauggagcucaaagaaaagcuaggagaaacugaugaaaagaugauggaauaugaugugaaaaugauaauuugaaaucuuucauucccagcugccauguuuuggagaaaaggaaugcauuuguauauuaagagacagcuaaaagaguccagaugaaugguauuacuuauuagauauauuuucauuuugauucagauaaauuaugugcauuuuaauagaccuuuacauauuuagacauuuuaaaucuuaaagacauaauguuagguaugauauuucauaaaaauauuuuaaguaguauacaauauuugcuuaauauuugggcaccuuuaaaugaaccuaauuucaaaaauuaacuucaugguuguuaaauuuaagcauuuuaacuaacugugauggugaauguuuuauuuaaaguaugaauuauuuuguuaccuuuuaacaauuauuuaaacacacagucacauguuuacuuauguuuauuuuucuagauaagugacaauauugcagcuuaucuuggugaauuaguacuaagugguaacauacagcuauauccuuagccuauuugaccagacaacaaugcaaucuaguggucauuuuuguaaaaugcagacacagaguucaugugguuuuaacuaguuauugauguguuaauaaaggaaagguuguucccugauucuaaaguuugcaaaagguuagauuagggaaaaguuagcaugaaaauguaaaaauaaggcauaugguaagaggaucauauuuugagggaagaugauguuuuuaauuuuggaugugccagguauucuaauaggaauaucuucuaaguagaaggaaaccucugacuggaguucaggaagaggaugaugguauggaauuuacuucuguggaugaacuuaccaggcaaaguuuagggaaagaaaagaaucuccaagaacaacugcuuuuauaggccccaaccuaugucuuuaaauccauacugaaaaauauaauuugauaaucauacccuaugacccuuguaaauauuuugguuuuuaagagguaaacaauauauuucacuuccuccuuuugauauaaccagcuaggauuauuuaauauguuuugcauugcaaauuguaauagucugaaguuuuacaugauugucuguggaguuauuauuuauaggauauggggcauuaaggaggaagauuaacaucagauaacuccaauuugagccauagggaauggaagaaguaacaaaauauuaaauuaagcacaagaacuuguucaaauaacugcuaauuucaugugguuggagugugggauuuauggaacuugauacugaggcuacaaagguaguuuggucagauuaugaagaacuuuguauacuaugcuaacugcuuuggcauugacuaauaggaaauaaccauaaaaugguauauauuuaggaggcuuccacaucacaucuauauuuuaaagagguaacuuuagauuuaggugcuuugaauuggauaaaaggagccuguuggagacauagagacuaguuagaaggcuacgguaauuguuuaguagaacuguugagaaccucaacuagagaaagcuuaaagagaaagugggaaagggaauggauuugagauuuuuuuuuuuuuauuguggaggcacagauacaugagaucuacucuauaaacaaauuguuaaguuuaugguacaguauuguuaacuauaagcacaguguuguauaucagaccucuagaacuuauucauguuauauaacugaacuuuguaccuguugaacagcaacuugccauuucucucuacucacggacccuggcuggcaaccagcauucuacuuucugcuucugugaguuugacuauuuuugaugucucauuuaaguggaaucaugcaguauuugucuuuuugagacuggcuuauuucacuuaguguaauguucuccagauucauucauguuguggcaaaugacaggauuuucuuucuuuuuuuaaggcugaguaauuuuccauuguauguauauaacacauuuucacuauccauucaucuguugauggacauguaggauguuuccacaucuuugcuauucugaguaaugcuacagagaacauggaagagcaaauaucccuuuaugauccugauuucaguuauuuuggauaaauacccaggagugggaaugcuggaucaugugguaguucuauuuuuaauuuuuugggaaacuguuuuccauagcugcuguagcauuugauauucccaccaacaguauacaagggugccaauuuucuacacucucuccaacacuuaucuuuguuuguuuguuuauuugguuguugauaaugggcauucucacaggugugaaaugauauccaacugugauuugcauuuccuucauaauuagugauguugagcauguuuucauauaacucuuagccauucguaugacuucuuuggagaaaugucuguuuaaguccuuugaucaauuuuugaucaggucuuuuuuuuuuuuuuugcuguuaaguuauaggaguuccuuauaugcuuuggauaguaacccuuuaucauauguaugguuugcaaauauuuucuuagauguuauagguugccuuucacucuucaggauguuuucuuugaggugcagaagauuuuuaguuugauguaauuccacuugucuauuuuugccuuaguugccugugcauauguuuauaaacauccguaucauauauccaugauugguguuguagccaagaaauuauugcgaagaccaaugucaugaaaguuuuuccauguuuucuucuaagagcuuuacacuuuucacgucuuauguuuaagucuauuuuuuucauuaaaauauauuuuaauggguuucaaaguucuaugacagauuuuuuuuuggucagguuauuuccauuaagaaguaauuauuuuaaagacuaacaacuuaagaacucucacacaaaaaaaacccaaaaauguuccauaaaauguucuccuuuccuucggaagguuuuauaaugcauugcuaucauuaaucaguuuuuuacuauuaaacuuaaaauggccuauucaggcaaauacuucugggacuguucuucaaccacugaauaaaacuagggugcagguauuagggauaauauucauuuagccuccugaacuuuccaggcagacuugcugaccuucccaacucuagcagcccucuuguccacugcuuugaagacacccacagcaacugucugucucauauuaugaacaguaaaaugaccaagagggagauggucagagaagcucucaacacuccagcaaccaucugaacgauggcagcaucacuagauuucaagaauuuagggucaccuuccagcuucuuaccagaguggcaaucaaucuugcuucaaucaagcaaacuugcaagcaacauaagcugugugacagucaaguauaggaggauaaccagaaccuauuuggccugguuggcucaagauaaucaugugagcagugcagucagcugcuuccauuggugagucauuuuugcugucaccagcaacauugccaugacgaguaucuuugacagacacauucuugacaucgaagcccacauuauccuuaggaagagcuucacucaaagcuuuuuggugcauuucaacagacucuacuucaguuguaguguuaacuggugcaaaaguagaccacaugcuggguuugagaauagcagucuccacuagccccaaagggacaaugccaauaucaccaauuuguagacaucagguaggggcagacacaagagcuugucaacugaaugaauugaugguaggaugcaauucagagcuuuaagcagcaugguuucacugguaucgccaucuuuacaggugucuuuccaucucuugagccaagguauguuagcacuugacuccagcauauugucaccauucuaacauugauggcagggacuguuucuuguucacugcugcaccucagugccaagcauagugccugguagguaauagacuccuuaaguuuuguugaauuaauaaaggauggauuaaaauaaaaaagaaauuggcacaaaugcuacuguagcagguccguagccaguuuucuuaauaugggugcugauuuccuuaaugauuuucucauaucucuucuggcuguagggugacucgguggaaucuguuuuguuaacaugaacaguugguuguuuuacaaucaauguggaagccagagggauaugcucaugagucugcucauucuuggagauaccaaguucagauucaucagcaccagcagcaacaguaaggauagcacagucaauuugauauugacaugauuugucucugugucuccacccaaaucucaucuugaguuguaccucccauaauucccacauguugugggagggaccuggugagagauaauugaauugugggggcagucucccccauacuguguucaugguagugaguaagucucacgagauuugaugguuuuauaacagguucuccuuucacuuuauucucuuucucucuuugccugcugccauguaagacaugacuuuguuccucccucgccuucuaacaugauuaugagaccuccccagccauaugggacugugaguccauuaaaccuccuuuucuuuauaaauuacccagucucagguaugucuuuaucagcagugugaaaauggacuaauauaauaaauguuucuguaaucauguuuuugguaaauucucuguguccuggggcaucaaugauagucacauaguaguauuugguggucucagauucccauguggagauaucaguggugauaccaugcucaaacucagcuuucaauuuauccaagacccaggcauaccugaaggaccccuuucccaucucagcagucuuguccucacauuuuuuaaugguucuuuggucaauuccaccacauuuauagacuggauggcaaguaguaauggacuugaaugaaucuacauguccagugaugaugauguugauaugagucuuuuucuuucccauuuucgguuugauuuagggguaguuuucaugacaccuguauucugguggcaaacccuuugccaaaaagcugcuuaggucuuuuguccauuuugaauagauuuuuguguauaguguaagauaagggucaaauuucauucuuuuacauguagacauccaguuuucccaaguguuuguugaagagacuauccuugccucauuguguguuccugguacccuuguugaaaauuaguugaacauauuugcauggguuuauuucugagcucucuauuuuguuccauugguuauaugucugucuuucugccaguaccguacuguuuuaauuacuguagcuuuguaauauacuuugaaaucaggaaauaugaagccuccaccuuuguucuucuuucucaagauuguuuuagcuauuugggguccuuugugguuccauaugaauuuuagguuuguuuuuucuauuuccaugaaaaaugccauugggauuuugauagggauugcauugaaucuguagauugcuuuauguauuauggcuaugguaaugauguugaagucuuccaauucaugaacaugggaugucuuuuuauuuauuugugucucuuaaaauuuauuucaucaguguuuuauaguuuuucauuugcaaaucuuucauuuccuuggucaauguuauuccuaaguauuuuauucuuuuugaucuuauaguaaaugagauuguuuucuuaauuugcuuuucaaauaguuugauguuacuguauacagacacagcugauuuuguauguugauuuuuauauccuacaacaaauuuuucugaauuuguuuaguaugucuaauaaauuuuugaugcacucuuuaggguuuucuacauauaaggucaugucaucugugaacagaaauaauuuuacuuuucccuuucuaauuuggaugcccuuuauuucuuuuuauugccgaauugcucugacugugacuuccaguacuauauugaauagaggugguaagaauaggcauuuuggcuuuguuucugaucuuaaggaaagacuuccaguuuuucacuauuaagucuaauguuaacugugaguuuuucauauauggccuucauuauuuugagauagucucacccuguuuguaguuuguugagauuuuuuauuaugaaaaaguguugaauuuugucaaaugccuuucugcaucuauuaagagaucuugaagaaagugaagaguaaagaguuacugaaauuucuugcuuagaagauuagauaaauggugaugcuacuaauuaagggaaaguagaaauuuuugaagaagauaaauagauaagucuuagacauaauguguuuuauuucuucaaacauucugguuaaaauaucaaaguaacaguuguugcaaauggaaaaaauaugcagcucugaggagacauuggaagcaucgauaauacuuagaaaaaccuuaccuaaugcugccccaagcacuuuacucuuguaaauucaucuaauuaucacuguaacaccacaaaguagcuauuaguuguuaucuuauuuuauagaugagaaagcugaggcacagagaggccaugucacucgccugagguuccacggcuuuuaaguggcagaacauugauuugagucaaugcauucugaacucuguguucauguucucaacuauuuauacuauucugcuucagaaauaaagacucccauuuacuaagcauuuuaacaugcuagacauuguauugaacauuauuuguaucauaucaauuaucuaauccucaauacagcucuuuuauuucacagaauaggaaauugaagcaaagagaggaaaaguugcaugaacgauuuuacacagcuguuaggucguugaacuggauucugaaccuagcauucuggcuggagagcccaagcuuuuaucaguuguguauagcagugagaguagauuccccauggaaagguaagagcugaauacagaguccagagggaacaccaauaugaagaaggaguugugaagcggccugaaaagaaaugacaaagauaggaagagaguuacaaaaaaaaaaaaagagacagauaucuaggaagauacuuuucagugggaggagauuagucuaacaucuugguuuucuuagauuaaggagcagaguacuuucaucuuugaauccuaguuucauacauaguacauuucuuaguacauuucuuaauaaacacauguuaaagucauugagcgaggugucacacauuguagaaaaguuaaauaugauaaagaauggaaaagggcuacuaaauguagaaacuagagauuacuaguggcagcaggcugagaaaacucaguagcaaaaugugguagagacuuguugaauguauuaugcuuucaaggacauuuucagugaaaggaauaacuauuuuaguuauucuuuuuagcugaucuaagguuaagucuaacuuuacagaauuuaccuuaaucugcuuuuauaaauuagucauuccuguuuuauuuugucccuuauuuaugauauauuuccguaaaauguaagaauaaguagaaggcaugauauaauuuauucaggagaauuauuuauuuuuaacugagaaagcuuauuaaggaauuuuauuuauaguuccucccuuauugaguaaaauccucuguaagagacuuaggaaauuguguuuucucuuuaaguucucuugugccaaagcagacuagacuggagugaucaaaacucauugcuauuuggugagggcucuuugauggcuuucuguuauguaaaaacaacugguauucauauuucaguuuaucguagaaagcauucuacaugauaagaacuaagaacaaaauuggcaucuucacuuauaaacucagcaagaggccaaagauuacaucagcaggaagugugaacuaaauuuuuauuccaagagguuggucuucuauaauggauaagguaguauaaguuugcaaaauauuagcucccaauauuucuauuuggaauuucaagaaacacucaauuaaaaaaaaaacacuuaggacuucagauuuuaaauuuuggggcuggucugagugcaguaguucuuacaacuaauugaucacuaucaguuaacauuucuuuguuccuucucuacuuccacuacuucguuugacuagccuuaaaaaaugaauacauaaauaacauuaaugggcaugugcauuuuuguagaagaaaaaucuuguguaauuuaagauaaccuaaaaauacagaacauaauuaggaucuccuagauuccugauuuuuuuuuaguacaccuugcugacuaaauaaaaccugaauauaauuuuauuuuacuugcuaaguacuuaguuccugcuuuaaguugaaggaguuauaagaagucuaacaaaguuuacugaauaaaauugcugaaaguauaacaacugaccccagguugucucccuuccaaguuacuugucuuuaucugaccaccagguauagacagcuuugucuuauuuacagauucccaauccugagcuuaagaugaaauagucugucaaccauauauuucucuauuauuauugaccuugcuuaaucucauccugccuguuauucuaguauuauuuauuuguucugauaugacucuuguucucaauaugacauauaauuugcuucaguuuuuguuuuguuuuguuuuguuuuuugagauggagucucacacugucacccagguuaaagugcaguggugcgaucucggcucacugcaaccucugcccccuggguucaagcgauucuccugccucagccucccgaguagcugggauuaccggcacccacugccacacccagcuaauuuuuuguauuuuuaguagagacgggguuuuaccauguugcccaggcuggucucgaacucuugaccucgugauucaccugccucagccuuccagagugcugggauuacaggcaugagccacugugccugguccagauuuuaaauaaaaugccucaaauuuaauuacuugguguuuugcucaucugugagaaucaguuuaagcucuuauuuauaagucuauuacuugaaaagaguuaaauauauguuuuuacuguaaaucugauauucuuaguaguaacagauaagcagagauauaaguagcaucuuuuuuuggccucacgguauaauuucaagggaauagaacaaucuauggcagauaagacucacauuuguuaugacauauugucucaucuccuaccauucuuucauaccccaucccuuuauuuuuuauacaccagauuaaaccuugguucugaaguauuuauugcauaaucuuaacucuucauauauauggauaauauacauuguauaaggaucaaggaggcaucacauuuaggcaucugcugauuaucgauugcaaucucgaugaaaacaauguaaaaaaauacauaggguuggggcauaaugguuugaagcuucaggcuuuguuuucaaauccuaacucuauuauuugcuagcuguuugacuuuggacaagcuacuuagccucucagucgcucuauuuaauuuuuuuucacacauaaaagggaaugaaacauggguuguuguaagguuaaaugggauaauguaugcuaagugcuuaggucagaacuuggcacagaguaagcauuuauuuuaucuugucuuuauuaggaagauaaagcaagcaugcagacucuuuuaaaucauauuacuugaaaugucuaucagggcaaauugauucugauggugcuaaaguggugucguuuuacaugaguucagauuuuuucuuagcaugaguaaugugccaggcacugauuaggcccuagggcaccuccgaaguugaaaacagccgcaaaaacuuuggagacauacuuguuccaacugaucuuuccaacuguaacaaauagagcuuucugauucaccacuaacuccauugaucugguugcuaacuaaucaaucacauauugugauuauaaaaucaaaagugguugaacacauuaaaaccuaugucuugauacaagugguuaggaaaauaaagauauauguuuucaucguuguaagagaaaauuuagugauuucaugcuugagaauaugauaauaaaguugcuuauugaugggaguauaaaaauaugaagaaggauauuuaucuuucguaacauuggagaauacaauacuaauaucucuuacugcuuuuauaucuuuuaaucagugcgagucccagaccagguucucucuguggagcaccagaaauuuuauccagcuaccucuuguaugucuccguuuuuacuccucuguauaucucaguuuugugccuguuucugcauucuugcugcagcuaucuuauuucaggccagcaccauacacuucaauuacuguaaaagccuuauaucugaucccccagcauuuagucuugccccuuuucagccuucucacacuauagccagagugaucuugcuaaaauugaaguccaaucauaucccuuccuugcuuuaaacccuucaaauugccuuuauuucucuuaggguagccauaugauuuauuguucaaacugagauauuuauuaauuuauuuuucagcuauaauuuagauguagucaaaugcagaucuuaaauauacaaugagauuaguuuugacauaugcauacaacuguguaacccauauucuuuucaagauaccuuguauuaaucuaucacuccaggaaguccccuccugcugcuuccugguuaaucuauuuaauauccauucugauuccucauuccacuccucccccuaccccagacaaacacucgcugauuuccacugauguaaauuauaacucagauacuuuugaaaguaaaagagaaugcuacugauaauuauaaugagaagauacauguaaaguguugccaggaggaaugguuuccuuacccuuuguauuaaguccaaaauuuuuaauuggccuaaaggccuuauauaaucaguccccugguuauuucucaauccaguuugucuuauuacuaucucaacauuuguacuucuuuuucaacuccagaccuuucuuugcacauauguuuuccugugauggaaggaccaccccuacuuccccuccaccgcucuuuccucaugcuguagccuggccaacuucuuauucgcucuucauuucucuauuuacauaggauuucuuccuuugggacuuuucuccuagaccugccacacauugauuuauaugucugucuucuagagucccuacuauuuuucaauuuuccuaccaaugcucuucuuacucuauguuguuauuagccgcgauugcuauucuaauguauuaaauauuugcaaagugaauauacauaaaaauuaguuauuuguauaauuucacauugaguuuguaaauauaugaguggaacugacuagacuuuauaccuuuuaaguaaauagucuucauuaaauaaucuguuuuuaaaaauuguguaauuauaauuuaguuccucuagacaaagcuuccaaauaacugaaugaacaaucaguuaugauuuuuccaaacuuuucaaauacaccaugaaucucauuucuacugggugaucucauagacuuccaggacauucaaggcuuaaauaaauaauuaauaauaugccacugacgccagaauauaagaacuagcuaaagguauauuuucagacacuuuaaaauguagggucccugauuuauucuugaaaacuaaaggccuuauuuuuucuugaagcaacuagauaaaccacaagaguccuaucugguuuaucacaggauuuacuauuucgggaaaacaagcaguuuagggauaguucugaacuagguuccaggcaggaccagaaaaacaaaaacaaaaacaaaaacaaaaaaaccaagguuaauuauaauuuauugcucugaaacauauuuuaucacuauguuccaucuguugcacaaaaaucaguuuucuaauauauggccugggcaguuaauggagaauauuugcaugaauaugaugacagaaagauaguaugaacauagacuaggugugaggacuaagagaaauaauguggugguuuggugucuacaagacugaggagaaauguaaaauagagacugacaaagaacaaagaaugauugcuucaaaaguaaaauagaaaccaaaauucuguaauacaaggcaaugauagaaaaaggauguucucuaagguuaucuuuagcaauacccuuugucaagauaguugaagacaaagucugaagacaaagccuacuuuuagguuguagaugagaccaauaaauacuucuguuucucaaacuggccagugccuuauguagaguuggugauuaaucuuuaugauuggauuguugaauaaguacaugaauaaaagaauuugaucaguaugucccccuuaaauugaaaauaucuguugauaugacucugaagguauuuuuaauuugaaagaaagcagcuaauguaguaguccaaaguaagcuuuuugugugugaugaaaucaucagauauguacaucggauaacuuugcaauguuaacaguguuugcuucuauuguguuugguuagauagaaguaguugcauauauucaaauauauauuuguacauacaucuguaucuauauccauaccuacuuacaaaaugcaugaaaaaaucuucaaaagagcagauaaguuauucaguauaaugcuuuucaucauauuauaucucaguauguuaaaguuuuggcaacaggcauuggacacaggaccuuuaauauuguacuguacuuaguaaacacuuguuaaauauauaugaauuuaaauucauauaacaagaguuauuagaacaaauagcugacuaauaaaagagcuaacaguuguugggggugguuaaugugcuugauauuauccuaaucauuuuauauggauuuuuauuuuauuuucacuuaauccucauauaaauuccucaaauaaauccuugugugaucuuaugagauagacaguaauuuuugcccauuuccuagaugaggaaacuggagcacauaaccaguaguuugcagaaccagaauuugaaugaguuaaguacgucauacacuuggcuacuuugauaugcugccuaaugugugugugcuuguguacaugugaauauccaucuauuuucuuuuuuaaaucuaagaauauaauuuuauuuuauuuucaauaaaacacauacuuuaaaauguacauauuuauuggguugcacacaucuauuuucuaaugaucucaagucucccuaguuuugaaaauuaggaauuguauuuccuuuacucucgauagcacauaacuguggguuggagucaugguaacugaucauuagucaacugcuguaaaacuuuuucuaaaacuugaagcauuuuccuacuuaucuuaagucuacuuaucuugauuuaaaugauugcuugauauucauuuaaaaauacauuaguaucuagaaauguaagcaaauauuauggggaguguucuauuuuaugaucuauuuccuuugaucuagaaaauauuacuaguuaguauaggagugaaugaagcggagauauauuuagucugaaggggguaggacguuauauggucaucaagggaaaagagugguagucuucccaaaugucuuuuucuuagauagagcuggguaauuucuauucaaaucucugcuuaaaagcuaguguuaaccuggggacacaacuuuuuuuaagagagagggucccugucaccuagugaaguggagucaaguagugcgaucaccuccagggcugaagcaauccuuccaccucaacaucuugagcagcugggacuauaggugcaugccaccaugccuggcuaauuuuuauauauuuuuuagaaacaggguuucaccauguugcccaggcuggucucgaacuccuuggcucaagcaauccgccugccuuggccuccuaaagugcugggauuacaggugugagccaccaugccuggcuggggcauaacuuugaagacaguuuuuaauagaauuuuugaaaaaaaaaaaaaaaaaaaacaacccuuggaaacccauauucuuauauauacacuuugauuuuuuaaaauacuucucuuucuuaaacuaaugagaauaaauguauuuugccuuuuauuugccaagcacaccacuugucuuguuguaaauauagauaauauauauaaauauauacauacacaaaauauuuagauacauauauauuuuuauaauauauguaaguacauaaauacauggaauauauguguguauauauaauccuauugguuugggauccccauggauaccaaaauuccacagaugcuuaaguccuuuauauaaaaugggacuucuguuuugcauguaacuaugcacauccugccauauauuuuagaucaucucuagauuucuuauacuaucuaauacaguguaaaugcucuauuaauaguuguuauaguauauugguuuuuuauauguauuauuuguauuuuuuccaaauauuuuuaauccacaguugguugaaucugcagaugcauagucuucugauuuuuuuuuuuuugguaaugucacucugcacugcuuccaaucuagucuuuuucauugacauuggaucaaacuaaagugauugcauagguuucaucaccuaagacuuaugcacauagaacugaaauuucugaaauuuauauuuuauaacauaguucuuuuuauggcagaauguauuugcuucauggcaguuauuuuaauauucuaauaauauaaauuuauuuuaaauucuugauagugaaaaauaacuugaucagauuuaauaaccuauguaguuuuaguguuggaauucacagacuuagagugcuuucccuaauuuaaggaggagggguaaaauagggauuuauuucuaacaaaaacacuacguaaaaguaaaauccaagagaaaaauuccacacugggcauaguuguccugacaguuccuuuuuggcccuaaguuuaaaaauauauucuccaagggacauggaugaagcuggaaaccaucauccucagaaaacuuaacacaggacuagaaaaccaaacacugcauauucucacucauaagugggagcagaacacuucuuaaaaauaaaagaugauaggcugucucuguaauuugacaaauuaauauaauucucccuauaaaaugcauuuugauuuaaucacccuguuaauauaacuuuguuucccuugaaaauuuaaaauaucugacggugucccugagaguuugcuguggugcccuggaacaucuaagugcuguucgggaaucucaguuauuacucucuuguguaaaguauaaauaaauugaaugaauguguaguauuagguaauucucacuuauuugggggauaauauucaaaauuaaguaaucaucuuuucagaaauucauggccuuugugaaaaauucgauuaaaauggacaaguagcucauuuaguuguagcaaaaugauucugaaaguguuauucauaugaaauaaaauuacagauaguuuaaaauuguccuuauaugauaugguguaauauuuuuauugagaacuuuaguauaaacauaauauuugauuaauaucauuaugaggauucuuaagaaauaaaauauaauauacuucacucguauuucucuguaauuacaugugucaugguuaucgggagacgaauggguugaauucugacuuuuacucuaacuagucuaaggcuaaacugagcauagauaaccauuucccuugccagggauuaguuuaggaguggcuuaugacccuguggcuaauuaaauguaaugggaaagucagggaucagacuucugggagagguuuccucacugauaaaaagacugacagaaagggaggcuuccuucacugaacacugcuguaucuucaugagaugugcugaacucuggaagcucauuuugugaucaugaguagagauagcugaggaaaaagccaacgaauuuagcccagcagggcaggagggaagacuucuggguccaugagguagcuguugaauuaaacagucucugaacaagucaaccaugucauuucuugcuaugagaguauaacuuuuccuuauauacauuaagcacccuuaacugauguaguuacuccuaguccuuaauuauuggugguauucaaacugaaguuaaagacucaggacccuuguggguuucguguaggcaaucaaauuuguguuuugaaaaacacucccaagugauucuaaaaccucuucaucuucuuucuaauccuuuccacccuccauugagaacaucuggagcaagauaguuaugaaauugaaugaaaggacuuggugagugauuaauuauaugugggggucagggaaaaggaggggucaugguaacuaccguguuucugauuuggguaacuagguagauggugcugccaguuuaggugauaaggaccguaaguaaaagaacaacuuugguuuuguacauucuucauuagaggugucugggaacauuuagaaagucauaccagaaaguaguuagagccauaauccuggagaaauaucuaaacuacaagacuaagagauuuaguaguuguaguugaaacuguggguauagaugagauugcuuacagguauaucuuacugaguagggaagagaagaaacuaugcaauuucagagaacgcucugaaauuucaguguacaguggaggacaaaagugguugagaaggaggaaaaacaauuagugguaucgacaaugacacaucucauuuuaucuuagauuauucucagauaaauucaaagaccuuuguucuaagaauaaauucuaagaacuuugaucaagauguaaacguuaguguuuuuuuuugaaguaaauucuuucuuaaaugcuuguuuuccuuuucaguugaucaauuuauggugcuaaaugguaaccugaugggauaaauaauuaauauaccacucuaacacuagcaauuggcccuaguucucucuuacaagaucaauuucauuguaaugcuuauuacuagagauacacugguauggaacccaaaaccccccaaaauauaaauuuucaucaguccuuguuuccagucauuaacaugauaguagaagugcuguuuuaggacauacacagaaauauguauuauuaccucuuucauuuugcuguucauaauuuuguauucuauuccauccauucuuuuuauuauuccuauuuuuaucauuugacauguguuagccaauauacucuuuuggcauaaaaauaaaauauuuuggagaguuaggaggauucugaauccaaaauaauuuuucuuguuuucuuuaaaugcaaaagucuguagaaaaaggaaaaauugauaacuucuggagaguauugucuuaaaccuuucacauaaucuguggaugcuaaccuaggauuucgugugugcguguguguguguguguuuguauaugugucauauuaaaaacacuguguagugaaaauaccagccuucacacacacuuuuguaauaaauguggaaguauaauuuucaauuaauacuauugcuaagaggauccauaaaagcuauuugcaugcauuuuaugccuccuuccaagucucucucuuuucuuuuuacacuucaguuucaauagcaccuguaauuaaggaagaaaaccaagcccugggagcuagguaggacuuccagcuauugaucuguguaaacccaguuuauacugucaggggagaaacagucaacugcugagcugcuuugucacugacauaagcugagagaggauuuuuuuuuuuuuuugucuauacuguuuauacacuagucuauagaccugcuggcugguugaauuuuaaagagugcggagguuuaaagacuuguccccugagggaugcuucugccaguugggaagcgagcugaggcuguuucacagaaguguaugcacguguguugcuuguggaagaagggagggggagggugugaaagauugagcaacuaacugggaagcguucgucuugagucuuaaaauugaugugaaauauauuacuaauuuguguauuuagagggagauauugaauuuugaauauauguucuuuauuguuacagaaauuauguggacaauuuuauaggaggaggucugaauaguguucacauguauaguaaaaauggugaaugguuucacuuuaugaaguacaagauaaggauuaagcaauggucaaaugaaaaugaacuggucucauuugcaaugaacuguuuuucaguuuacagaauuuaacuuacugcaaguuuagugacucuuuuaacuacauuuaacaaaauauugucaguggugaaacaguuagcuuucgcuuaauauagagucugugcucauauuuuuaaagguacaugauuaugauuauaagcaauccaggguacccugcccuaagaguagaugauuuuuuuuuuuacaagauccuuuucuuucugcuuaugugcauuaaggcacugaagcuuucuuagguauugguauuggaauuuuauaauguuuuauuuuuaguugacacuuuauuguagucuaccuuuuuaaaagaaugcaagaaauucuacuuuaaaacacucaaugcuauauuuauguauacgguuuaaauauucagauauugaugacuucuguagaccuuaguuuuaguggcaaagaagugguagcaaaaauauuguucagugaggaugacugcugcauuaagauauuugcucuuuuuucuuuuuaaugggaaacauccuuauaaaauucuuugucuuguaaaauugccugacuuugaaguuguaugauguugucuucaaguuuaaaguuuaacuuuugaaucagacuuaauuuuauuuuucaaauauaacaaaauagauuauuaagacuuuguuugccaaguagcugauaauuauuuguauuuuauuauaauuuuuaauguguaugguuucuaaaagauuuugaaauuauuuuuaaugacuguuaaauaacugaagguuucaaaaucauucagauuauuuucuguguuuuauuaaagcauugauuuucauauuaggcaauccuuaaaugaaagugcacagaauagaagcuguauuuuugacagcuuguuuuuagauacacauuucuuuaagaguguuaagauaaaacuuaauaccaagaauugaaucauguaaauguuucuuuggcuauagaaagucucucucucuuuuuuuuuuuuuuuaacuguuugacuaugggacauguagaguuguuauaccucucaguaauucauucugcugccaacuucauucccuuuucucugccugcauuuuaauugaaacaacauuuauauuuuugagccaggaucugucagaagucccuauggcuagacugugguacaaguagcagcagacguagcuuacccauauggugcggugcuucuuguaaaauccauauggccuuguugaagggaaucccagcggggaugugaaggguguuaauacccuucaggccaggccuuuccccccugggguuucuguggcauugucagugcaaucugccaaagcacaaacuuaauuccuuuuuaauaaucaauuauuuuagucuaggaaccugugcuauuuuucuuaaggacaaagaaagcaucuuuuucuccuagaaaaugucucaaagaaguuuuaacugcuucuuaaaaaauauucuaaaacuuauuucuuuuuuuugaaauuuccauuuguaggaaauacuacagagugugccaaaguucuguuuucccuuugacguugaaagguacaguauaaguaucauuuaaaauaaauguagauucuuauaguacauacuugaaaaugauuacaugugcuuuuuuauaaaauaaaaugucccuucucuuuauugcuucucacaaaaaggcuagagauugaaaagagguugaaaauuaauuaauauguggaagaggaagccuuuuaaaucacaucuuuuauuuucucuacuaugaccaguuaagacaaguuugaaaacacauuaccaacagguucuauuuuuucccuuuguucucucuucagguagaaauugugaucacuaguggaaaaaaauacuaauaugaccuugauuggagucuuagaauuaugucuugauguauguuuccugguuucuaucucacuucauccucauugaaaagaccaucugugucaugcuguaaaacucauggcuacuugucucucaauaauagcuuuauagagguaguguaauauuauggaaagcuauagggaaacuccucuaguuuugaaaaucuuguuuuuauauuucacugaacaaauacugaaugaugaaauugcauagaguugaaauuucuuggaacauacagcccugugagcauaacaacagaucguuuauuguuuuucaugugauuuuuauacucuauuuucaguuuacuuaagagggugacaugaaggguuuuugaaagaauguuuauuuuaggaaaauacuucgcuaaaguauuagugagacuuuaugauuuuacuguauuaaagauaaagccuucugaaugauggacuaaucaguacuaauaagcauuguugaugaaugauacuccuuguuuuaccuuaucugaggaaucauugcccuaccccuaccaaaaaaaguuacacguuucauauuaauaguaaggaagauuuaggauccagcuacaaaaaggauauuaugaaucuugggcacuagaggucacauuugucacuagaggguuuuuuuuuuauuuuaaguuuauuaaaguguaagaaaaaccuauccacugaaaaguguaguuguuaaauguucagcauuugaaaugcaacauuuccugacaaaacuguuuguagcauugauacuggcaguaauuuauuuccuucugcacaaucccuauggcuauuucaaaaccaaaguguaggcgucauggauauuuuauuuugggacaaggaagcaaaaguucgguuaugguuaucuaauggcaagauuacagccaguacuaggaaauauauucauauauuuuaaauagaaauaaagauucaaucuaacguuuuauauugccccuuauaccaaagugugacacauauuaugguaguaugauacuucaaaguugacuagaauucuuuacagcuuagcugauaagccuuuuauuuugguagaaauuauauucuuauuuuauacuuggaaauguauuccucaguauauugauagcuguacaagagaauucuagaaaaaauauaacaaggguauuuuuguaggguacuuuauuggaugagaaugucaacaggagaagcaauuaaacagaguuggugguggcugccauuagauucuaaagcgacaugauuugcuaucuaagcaauuuuagaauaauuaagaaaagaggcuaaaguugaagaaaaggacuuagucaugauuucuagcugcuucuacaguuucaguaauaauauuuugauaauuuaugaaauaugagcacuuuuagucuuaugaucauuuaugguagacuaccuuaugauuuccuagugagagauuaauauaugcugaacuguucagucuaugagguauuacaacuuauuuugguguuuacuuuacaaguuucacacuuccucuaguuuuagaacauaguucuagcuucaagaaccaacugauuagaaagaugaaaccaaugucacauauaaauauacucuuauuuuuguuuuucuugaagaaaauugucaaacaaggcacaauguuuccuaauguuacuauauuuuagggugucucagaaucaaguuggacagcacuuuaccuuuguacugacagacauugaaaguaaacagagauuuggauucugcagacugacgucaggaggcacaauuuguuuaugcauccuuaggugaguauuuguaguaaaaaaaauuagaugcaaaauagguaacuaucucucuauuguacuuuguuaugcuugggaugaagaaaaacuuguuuucuuuaaaaacaaguugaaaaauaauuuuccugauuuucuguauacagaaucaguuaaguuuaaagauuuaccauuaacauaguggaacuuuccuugaaauaaucgauuuuuuaaagauuaguuuuuuguagaguuauuuuugaaaacuaaauauaaagagauguauucaaauaauaugaguuucaccuauuaaauggaauacaaaaaaaaauaaguuaaauuaauguaugcccuuuucugucacugaaccagaacuuggauuuuuaaaagugaacugcugcuuuaagacagagguugcaaacugaugaaccugguagaagcguuuagagguuuucguuuggcuacuggguguuuuaaaaauuuuaaaggacguuaaccuuaugaauuugaggaaguuuuguauauaguucauauuucgaauuccuuuugaaaagugaggcuaucuacuaauucugccauggcaacaauaagcuggaacugaauagcagauuuuuaguugugucaugagcuugcuaguuuccaaagguccuaucuguccugccuaauugcuuacauuaucugccuugauucaguagguaguuuagaguaugucuccugccuguggacuugggaucugaguugcugacuguuaggaagaaaggguucuaaagguuagcauucuugcaauauguccugaugaaucagaaauccagauguagucuauaaaaauaggacuccaaacuauuauuauaacauggauauuggucaaacuggauuucuuagaaaugcuuauaggaaaagaaauaacaauuuaugaaauaacauauuacaaagaaaacuuugguauaaaaucagucuuccuguucauuugcuauucauauuuagcuacaguuauaucauucauugagagguuguuaauuuacuuacaacauugguuagagcuggagaguuuuuuucuaucuuuauucaaaaguaagugcuuaacugcuuuagaaguuauagaaucgugaaugugcccccauucucucuuuagcacaacuuuuucaucuggauaaaaauugugcuuaaaacuuacacuuuauccaaaagaaugucaugcuuaaaacuguagguuauuuuuuugaacuuggagcagguuggcugggcagugggguuggagaugacagugugggcaaugguggggagaguuccuuuuaucauuguuuccugcugaaauuuuaaaagcuacaguuuaaaggggaguauaucuuuaugcacugugcccgagauggauuugcccuaauggaaagaccaaagcuguauaugcuuucuuauuuuucucaaugcauuuuugaaacuuuucauuaaaaaauugagauuuacagaaaaauuuucaugguacaauaaacuuuuauauaaacauuaccuagauucauaaguuguuagcaugcauuucucuuccucucucccccucuccccuacucuuccuuucucucucaauacacacacacacacacacacacacacacacacacacacacagucuuccccccaccuuuauuguuguuuuugugcacccauuugagaguaaacaucauuuucagguaagauuugagucuguauuuuauagcuuaccucacugccucuaaacugaccuccugauauuuauaauuuaaaagucugagccuuuuguuuugaacucuuaaaauacuuugaauacauugaacuuauuaaucauucacaaauaauuauugaauguuuagaauaguuucuauaaaugugcuuguggaauaaauauucuuaggaauuucuguuuaaauugaggaaagccaucauuacuugaaaauauuuauacaaaacaugaacuauaacuauuuguuaaucgacugaaagaauaauauaauguccauaucgacaacccaauugucauuaauuuguagaaaacaaacucuaaagcaaauacaauaaucaaauuauuuuuaucugcgguucuaaacuuguauauguagaagaacgccugaauuuugugguauauucuuugaaguaggaagaguuuuuaaccugcagaaaauaugauuauauuagauaaagauaaugaaaaccaaaaguaaaaucguguauuccaauaaagagaacauuucacaguauuauugaauauuuuaucuuuuauuuaaaauaauguuuccuuuuauauuuauuuuugucauuugacagugcuuuugguagauaagaaguaggaggugucaaaacuuuaugaaaaaaucauagaggaaaaucuuaaauuuagaaaauucuauucuucagcuuauuuuuccuaguaaauuagaaaaauauugcccuuuuaagauuuuaauggcauaucuuaauauuuuuucugaaagacaguaugugaagggauucuuugagaacagcugauuuagagaauaaccagcaaauuagauaacuauuuaauuuuaauaaugaauggaggauucaaauauaauagaauucagcaucuuauucagaaaauuggaaaauuauagauagguaaaugucuauuuguaagcuauaaucaguguauccccuggaaaggaauuuuggcagguuucuguaagugcuacaauaagaggaguuauggugcuuuuaguccgaguuuauccaccuaguuugauggguccuucaccacuuuuagcuuuaaaauuguugaaaggauggauaaagcuauaaaugucaacuagaagaaaaaaauuacuguggcagugagaguauacauggaaucccuaaaagauuuguguauuugagcacauaaugaugaaaaugcuuguauggugacaaguauaauaaaaucuaaaaugcaaauaauaaacugguggaaauauauuuacaaccacuauaagaaaggguuaauagccaaaauacauaauaagcaccuacaaguuaauaagaaaaauaaucugauagaaaaauaaguaaagcaucuaauaacuuacagaggaaauguaaauaauauaugcagcuaugcaugaugcucagcauugcugaggguaaaaaaaaugagcccauuaagauuagcagaauugaaaaaauuuuuaaauaagcaugagggaaaacacacuucaugugcuguuuguaggacuaaaaaaugguauaagcuuuugaaggaaaauuuaauaauaucuauuaaaauuauaaaaucucauauuucuucagucaguaauuucaguucuaggaauuuaaauccaggauuauuucuaagagugaggagaaaaguaugaacaaagguauuuauuacagcaugguuuauaguaggaaaaaugcuaauuagcuagauuuagucauuccacaauguauauguacuugaaaacaauguuuucaaguauauacaaacaaugagaguaacaugcuggugggagagaagggaagggguugugggacagagaggagguuauacuugaaaagaaaguauacgcaauaaguacguagaauuuuaucugucaauuuaaagaaauaauaaaaaauaaauuuaaaaguguugacaacaugaaugccccucaguaggaauugauuagguauauuaugguacauuuuguaaccuccucucugucccacuaccccuucccuucuuucccaccagaauguuacccucaugagggcagggauuuuugucuuuuguuuacucauauauucccagugucuacaauagugccuggcacauaauucuuaauagacuugauagauaauuauugaauaaauaaaugaauaaugcagcaacaguuuuugcuauuaagaaaaacauacacauauauacacccugacuuagagaaauuguuuaugaucuguuguaacaugaugaaaaauuucaaaauaauauuuauaguauguuguuauauuuguagagaacaaguuauauguguauguaaauguauauguauuuuaagaaauagcuaacacauaaauauuuguaucuuaauaugggauuguauguacuuauaaaaaagucuaaaaggauauacccugaauuuuuuuuacuuuauucacuucagcauuuaucuacuuuuuacaauaagcaaaaaucauuucaauuuuuuccugcucuaaaacucugagauguuaugauauagauaauaaacuauaaauauggaaccacagguaucauauuaaaaauuaguaggaauuuagcuauauuaccagguaaaauaugugcguguuugcaggaugggaaauuaucuuacuaguauguuuuaguauaggcacuccauacaagucaggugaucauggugacauagcagaauuaagaauggaauugggggcuuggugcaggggcccacgccuguaauccgagugcuuugggaggccgaggcgggcggauuacgaggucaagaaaccccgucucuacuaaaaauacaaaaauuagcugggcgugguggcgcacgccuauaauccuagcuacuugggaggcugaggcaggagaaucgcuugaacccaggaggcggagguugcaguuagcugagauugugccacuguacucuggccuggcaacagagagacucugucucggaaaaaaaagauaauaauaaauaaaaauaaaaagaaugggaaugggacaguuucauuccguguccuugaaaauugggauuuaaagagaaaaaaauauugcugaugggguggcuuuacaaucuuugagccagauauugauguuucucuguaauuucaacacaaaauguucaaccagauggcaaugauuuguaagaugcuuggagaaauucuaugacaccuaaaauuaauuucuuuuuucuccuucuucaacagugguuacuuaauuuuacuguacccuuaagaugugguugaaaaaguuugucuuuuuuuuuuuuuuugagauggagucucgcucugcggccaggcuggaaugcagugacgcaaucuuugcucacuguagccuccgccucucggguucaaccgauucuccugucucagccuccagaguagcugggaauacagaccugcgccaccacgcccagcuaauuuuuguauuuuugguagagacgggguuucaccauguuggccaggauggucucaaucgccugaacucccaaaguguugggauuacaggcgugagccacugcccccagccuaguuugccuuauuucacuauguaaccaagacuuagaauaacuaguaauuuuagggggaaaaggaagguaggauuaucuaaugagcuauucauacaaugguuuaggguagucaggucucuuaauuuacaggccagcuuccuuuauaacagacugugcugcuuccagaaguauaugagagaagaucaacuaugcucauuuucugaguuauuuaugaguagcuggcaaaagccuuuuuguuugcaaucaguuuuguaggagugaccucacuuuuagaauucaugugcuuaauagggccaaaauuuauugagaaguuugauaaaauccuugcauaagcaagacauagacauaugccuuuaaccauauuucugauaacaaaaauaauuuauuugcuauagaaaacuuggaggauccagagaaguuuaaaagauaaaauaaaaaucacuuauauuugugaacacauaauugucacuuauguuuugguauuuaguucuaguuuuauuucaaaagacuugcuaagauacauuuacagauuuuucugugucaaaauaaaugauuaacuguagucuuuauucacaguuugcaaaaugaaugaaugcaucuaaagcaguucauaaauugaaaaagcuacaguggcuuucauauuguccauaagugccuagaauguuuacacaugcuuaaucugacaauuguucauugcuguuguuucuuuucuuguaaguugagauuucacacaaaaauauuucccuucugaauauagguuauauuuaaucacuuucuuauaucuuuaccaguaguguauuaugacuuuuggauguuaaaauauguuaauaccuucuccuuaaaggugccuuuugugcaaaguuagugccuuuauacugaagcauucuccauuuguagguauucuacugugagauaauaauggcuugauuauccagaguucauugucagaagcaaaggaauuaagauucuuggacagaaauuaauugauguuucuccuauugucuuuccaauauccuaaacacuaauuuuuuucuauugugauaaaauauauuuucauaaaaaucuucucauuugugagcuaucuucuacuguuugaaguugucuuuuaauccaaaaauuguaaaagaaaaauauuuaugaaugucucuugagcuuuuguugaagcauagacauaauuaaaaugccauacauuuaagaagcuuuaagauauuucaagucaaaguaaaguaaaacaguacaaauugauagaauauuuucauuagaaauagcagaaaauaauuuuguuuggauuucuugacuggcagagacucuuuugguuaaagauguugauacuaaugauacuauguggcaauuaauuaacagcaacaucauuuaguguuuguuuaccauagccaaguggucugcuuagugacauguaugcauuauuuuuuaaaaaacccaaaaaacuauucuaguccuuagaguucuaagcuagaacauuuguauauaaugcuuuaaagcugcuuuuaucuacuccuggaugaugcuauuauaggacuugaaauuacuguaaucugcauuuaccucggaguuccgagaaaauugcaugcuaugcuauauaaaccacguguccauuuucuccuggauuuaugccauuacaagauuugaaaguuaguacauuucuuugauuucuauuuauuuuguucaccuuucagaaaaaaaauuagaauuuaggccuauuuaauacaaaaguugauauuuaauuuugagccacuguucuguucuuuuguucuuucuaugacaugucuauccuacuuuuaacaagauuucaaaaauauccugagauauuacuaauuuaaaucuggcaauuguuuguauuuagaauuguuucauaugcuagcaaaaaugcaagaaauaacuuuuuaaccuaauuugauuaacauaauuuuauaacuauaaaauugucgccaaggguucaaaaugaaauacuccaauaaggaagacagauuuauguuuagggccuuuguaguucccccuccccccuuuaacucauuccaaaccuaaagcuuucacacucuuccuuugggcaaaucccuuagaagcagaauguuucaauuuuacacauuuugugucaauuuuccagacagaaaaacagccucuagacauuagauguuuuccuacggaaaggcaguuuccuuaguuuuauuugauuacuauaaguuagguuccugcugauugcuuagacuuuagugguuaccugacuauuugacaaaaaacauuuccuuuccuuuauuuaaccuuugacuuuugaauguaaaaguuuuaucagcucuauaguggaaguagaagugugggggaagucuucuuacuaccacaaaauggacucaugacuuuauguauaucucucucuuuugccuuaugucuuuacagaaaauuaaggaaaugaucuuacaauuaaauuuuaacuaaucuccuguacuuuguuuuaaaauaauugcucauaauguuuuacauuuauauauguuggcaagagugcgagagucacaguuauucuuuguucaauuuuaaaaauucaagugaagugucuuauucacuuguuacaauaugucgaguaauuuuuuuuaacuuccuaggauuuuuguggucuguuguaagaauacagacuuugacugucuuugggacuguaaaauuuagugaaaaacauuuuaacauuuuaccuuauugauaaucaguuuaaaauuaguugcuuugagcauguaucguuugaaaauucccuaagaaaccacaaaauaaagacuugaaaauaacauuucuuacucuagcaacauaagcuuauauaauuuacaguauuuuuuaucucucucucuguguguguguguguguguauguguguguuucaaaaguuuucuuuuuaaaaaugauguuguuuuugccauauauuuagacuuaaaguguacuuagaguauaguuaaaauuggaauuacuggacuacuuuguauacccuggaucauuuucuugucagauaagaaagugaguagucgguaggauuuccuguugagcaguugcuucuuaucaggaguugugaauucaauuaccuauguagaccagguaaggggcucaaaugagagaaaccuguuaggugccuaacaauaggaaguugggguaaguacggugaucugaauaguacaugccacacucaaagacagaagccacaacucagcccuaggaauuuguugcacagugaaaaauguguggccaguauuaccaguucuuuugacuuuuaagagaaacaagaagucuggauuuuuacagugaauuauaucagauuuggaaguuggcaacuuauuuaauuaaacaacaguacaguguugaccaaacaaaauaugcccuuaggauagaagcagccugcaaauagccaguuagcacuguuugcuguagaugcuuguuuauuuacaacagaaaauguccuugcuuucuugacguuucuaggagcaauggcuacguuauagaguaguuccacuuuuauaugugauguuuuuauuuaaaaaaugaaugauauguacucuuuaaaaggagaaaguuaucacugagagccaguacauguuuacaaagagagcauuguuuauaacuaggcuugguuuauuauggugauaguacauacugauguaacagggagugcuguaguugaaauuugagucuguucuaauauuucacaaacaaauuaugugcagagaaaaguguugguuagaugauacaauuaugagucuuuugauuagguuaaaauuucauacuuagaauguugauaaauaauugguguuauuuugggaggcaucuugaagacuuuugcaggccauauccuuuucaaaauuuuuauccacagugaugaacacagaagcaauaccaaacuuaaaauuggaaggguuuaccaaaauguuacuuuaaagaaucacauugaauagaccuuuauuuguugggaaauuugccccuaugaacaaacuauaauuuaaaagucauaaagguaaugcucugaauguuaaauaaacaaaugaauuuuagaagauagaauuugcuucaguggauaggacauauaggcaggcuguuuuaagauuacaacagaaugauuuuugucucaguucauuuagcugccugaaaugccuggucauugaacauguuuauuaaaaggcucacuguacauuagcagauauacuuaaaguaaaugacaaguuaaugggugcagcacaccaacauggcacauguauacacacacauguaacaaaccugcacauugugcacguguacccuagaacuuaaaguauauauuuuuuaaaaaaggcucgcuauauagaaauacacgccaagauagggugauagacugucugugguagaccccugagcauauauuacucagguugauuaggguucuaaucccaagauugccauuccauagcuuugugacccuagauaaguugcuuuaucuuagucaaguauguaucaaagcauuaguguaagaauuaaaugagauaauacauauaaguauccaauguacugucauucauauaguuacuccuuaaguaauuuuacuuccugcacuuccaauuguuuuaacacauaaauucuaugauucuuagauucugcucucaaccccuagauggacguauaacuaacuagugaguuauacuccccaaauagaaauaauaaaguauuuuggggccuuagagaugacuaugagaaauaucccauaaggguaaagcuuauuucuaaacaguguuaguuuaauuuauagaugaagucauaguuugauuuauagaugaagucauagccugguaccaggaugaaauucaauaaagcuuauuaucuuggacauguaaaaaacaguaauaauuacguagauaccaaaaugccuagcacaaauaaaaacuguuuaaauuuuuaaaaguaacuuaaauauggauauauuaauuauuuauucaaagacaaggauauagucuuacagauaaauuauauuuaucuguauaaauuagcuucuuaaugaaaaaucugauucugaugugccuuugcaauuugaaaggaaauuaaaaggggaagauaaccagugaaaaacaauaauauaaaguucagaaaaccagaacauugaaagaaauguuaaggguuuuuggucuagaaugaaaaacauuaucucacuuucuaauaacauaauuauuguuauguauauaguuuuuauaguagaccaugaaagaaaaauuaagguuaccaaaggccucacuuuauuuaaauaaggugaaaaugacaauguaagcauuaacagguagacaugcagccaccuacaaucaauacauuuugcuuuaucuaaagcuccuugagaguuggauagaaacagaccagcauguucuuugaauagauuaggucucaucugaauuuuuaggucugaacuacaugacacauugaaauugucuggaaauagcaauuucuucaggcuauuaaaaguugaaaugugaguuugaaaugacuacaaaugaaagcaauuaggcucuaacuaaggauuaugugucuugguggaaggaaauuugccaugaaaacuauuucuuugaguuauagugaaugcagaaacuaugaugugcugauuugcauuauauuuaguuaguauuauaaaaguauuaguaauuuuuaaggguuuuauuuguaaguggaagauacacauaguaaaauagcgaucuaagcacuggggcuugaagaguuaaguaauuuaaguaggaaaauugagauuaccaauaguaauuucuaauuuuuagauuccccaaaaacugucacagaugugucacauaccuguccagauuuuuccaggcuuccaggcaaaguugucaauaugcuuauuguaaacaccccguuccagcaucucccuccuagagccuucauuccugauucagucugggcugguugcucucgaggccuuugcacaacuguucuuccauggucuuagauuucuugccuccuacauccguguauuccuucuuuuucaucuccuuuauuuuauuuuagccauccuuuaggaugucuuaggaggugaaguuuugaguccuugccugacugaaaaugcuguuaaucuguucucacacuuuauugauaguuugucuggacauagaagucuugagugcaaagaauuuaaccuuuguauuuugaaggcauuaucuucuaacuuuccuuauugcuguugagagguuugaugacauuuuugaacuugaucccuuuguuacuuguuuugucucuuuggaaacucuuaggcacucuucuaucccuuguuuuggaauuucacagugauacucugguuuggaacauucuuugugcuguucauucacucauucuuucagucuggagacucaugucugaaguucugggaaaauuuccagucauucuuuaaaaugaaacuuucauucauuucuuuccucuauuuuuucuuuauggaaugacuauagcuauaugauaguugagauugauggccugauaguguaauauuuuucucuuauuauuuaucuuuuuuguuaugaacauaaauuauuauuauuuauuauacuuuaaguucugggauacaugugcagaacaugcagguuuguuacauagguauacacaugccauggugguuugcugcuacaaagauaauaaaauaccuaggaauagaacuuacaagcguuguuuaucuuuuuauucuaguuucugggagauuuucuggaguuaucaucuaaacuuucuauugacuuuaauuuuuuucugacuuuagaauuucuuaaagcucuuucuuccugucuaaaacuuucuaucuuuacuuuuuagaaaaguuuaguuuuuuuuuaauagcuuccugcucuuaauucagcuccuaaggauauuaaauauaaguuuuggaguucucuucagcuguuuguauugucuauauuuacuuguaguuccuuuuauguucaauauaaacauuuuguauuuguguuuccucaaauaucuggugguuggcuauuaauuuguauucaaaaggaagguauuaaacugauuuggaaacauugcauguauaguaguggguuucauuccaagaaaauaggacuucgaggggcuuuuuucuuugagauacuguuaaaucaguguuucagaacucuuuagggagcacuucugcugguccuuuuccuuucuaauggcauuuagguuuugguuuacucuuuucugcuguuaguuaucuuucugcuuaccauauuuacaaagucauccaccugcauugcuauuguuuuuuccuccauuuugcuuguauucauuaauauauacccuuuuuauucauuuauugucauuuuggaguuauuuccagaggacacagagauaauuacauacagucaauauguuagauuuaaccagaguuggguagauauuuuaaaguaucauaucaguuuucauaucauuacguaguauuuguaauuaucauuuuaaauaacgcuauaacauucugcugaguaaagauacuguaguuuaccuaaauuccucuuuuauuacuacuuucaguuucugauucaaauggcaucauucauagucacuaacaaaucagacauuauaugaaaaaaaauccuguuagaauucuuuuuuuacguucuacuuacugauuuuuaaauuuuacauguuauguguauguacuauuaaucuguguacaauuauguaguaaaagcaucacaauauuuucucuuaaaaguagcauguuguauuaaugcuuugaagaaaagucuugaguauuugucaauugauaauuaacaacaguguauuuugugauuuccucuuauucuacaugaaaaguguacaguuuaacauuaaaaucuuuagacauuaaaaaauauacuauuuuaauuuuuaauaaggaauauagauuuuguuuuauauaaaugauuuuuggauuuaauauuuugcuaucauaaaaauuauaguuuuaucuaguacaaugaauuaaauuuugaauuauauuugguuuugauauauaaaagucauuuaaaauuuuuuauaauuuuuagaauagucuuuuugauauguguauugaguuauuuugaaauuugccaucauucuuaaacaucauuucugaagaauugaaaaacacauaguuuuguuguauuauauacuccaguaacauauuaaaaggagauauuuuugauaucuuuuguuuuaaaagcuuuuuaaaacuaguuuuuauaugauuuuuuuacagugguuaauuuuuaucuuaugcaugcuuuuauugaauaccaugaaaauaauuuuaaauauugcugauguaaaauagaaguauguaaugaacagcuuuuuaaauagaacucuagauucugauuuguuuuaugaaaacuaguaauaaauaauauguaaaacuuugcugaaaaaguaaagaaaauggguauaguucuuuuuugaccuccaggauuaaccuguuugaauuaauaugaauuaaauguuuauauugucuguuuucugauucugaauuuuauguauauacauuuuaaaauaauuauuuuacaguuaccuucccugguuugaaguguauuacaagcuucuaaauacucuugcagauuacuuggcuaaggaacugguaagcuauuuuuuccccauuuuuaaauugugguaaaauacuuauaacacaaaacuuaccauuuuaaccauuuuuaaguguauaguuuugugacauuaaguacauuaauguugaucugcaaucaucaauaccauacaucuuuuuuccuugccagucuaaaacucugucuguauccauuaaacaguaucuacucauuccuccccaacccuuaccaucccuggcaaccaccauuguaucaucuguaugaaucugaauagucuauguaucucauauaaguggacucacacaguauuuguccuuauuugccaagugacuggcuuauuucauuuagcauaaugucuucaagauucauccauguugcagcaugugucagaauuuuuuucuuuuuaagacugaauaucaauacaccccaguuuguucauucauucuucugucaauggacacugggggugcuuccucuacuuuuuggcuauugugaauaauauagcuaugaaaauguuuguacaaauaauguuccagcccuuggguucaauccuuuuggguauauaccuaaaaguggaauuacuggguaguaagauaauucugcauuuaauuuuuugaggaaucaugagagcauuuuccacaguguccacauuuuccacaguguccacauuuuucauucccaucaguaauguacaaggguuccguuucccucacaaucuugccaauacucgcucuuuucuuuucuuuucuuuuuugguuaauaguuuuguaauguaugugcaaagugguguauuguugugguuuuaauuugcauuuccuuaaugguuagugauauuggacauuuacuugccauuuuuauagcuucuuuggagaaggucuuuaauugugcagacagaaaauuacaaccugggauaaaugcucugggaacacagcaagcaucaccuaagucaaccuggagagucaggaaaagucucuagagaaguacuuguuggaacucuuuuaucugugucucaauagcaaauagguauugagucaaaaguuguagaaggucuguucaaguccuuugcccauuuuuaaaucauguugcguuuuuuguuguugaaucguaagaguccuucauauauucaaauauucauuucuuauuagauagaugauuugcgaguauucuaucccaaucuaugguuugccugccuuuuuguucuuuugauaguauuguuugaugcacaaaaguuuuuaauuuuaaugaaguccaauuuaucuaguuuuugucuuuuguugccugugcuuuuggugucauauccaagaaaucuuuuccaaauccagucuuucaaagcuuucuucauauguuuucuucuaagaauuuuauaguuuuagcucucaauaaaagucuuuaugcuuuucuuaaaaaauaaaauuaaaacuguaguuugcuuuugaaugaacaaaauucuaugggauaaugauuuuaauuuuuuuuucccuuaaucuuugauuuuuuuuuuaaauuuuuuuuggagacagagucuugcucuguugcccagagguggagcacugugguacaaucaucacucacugcagccucagccuccuaggaucaagcaauccacucaccucagucucccaauuagcuggaacuaugggugugugccaccacaaauagcuaauuuuuuaauuuuuuuuuguacagauagagucucacuauguugcuuaggcuggucucaaauucuuggccucaagggaucuuccugccucugcuucccaucuaccaagccuggccauucuuugauguuuuuaacaagagcuaauuuacuaaaauauuagcuaugcuauuugauacaauuuaauugaaauaaaauguguuuuaaaaauucuuuauaauugucuauugucuauuaauuuuuacauuuaggguguacuuuccauucucugguuaucuguuuaaauucuuauuugguacucugucacucuugacauuguguuuuucuggauuuuccugacauugucuuuucuuuguuuuacuuauguccucaccuucucuuuugggccuuuuuuguccaucuacaccuaaaauuuugguguuauuuauguuauauucuugguucucuuuucucuagauacuauuuauggguauuucagacacacucuuugucugaagagaugaaaagagucuugaagacucuuuucucuucaagaugaacuuucugaaaacugauuuuauuccacugcuuacaaucgcuucauagucuccucuuuuucuuagaauaaaauuuaaacuuguaugcagcaugacauauaauaacuuuaugaucuggcuucugaccuucucuucaaauuaaucugcucccacucaucugcugcacauaauguacuaucuaauuauuuugagccacuuaaaguucccagaacauaacucuauacaguugugauagauuacagaccacucacuaauuguuacugguagaacacuuaucuuuuaagaguuaaugggccgggcgcgguggcucacaccuguaaucccagcacuuugggaggccgaggcgggcggaucacgaggucaggagaucgagaccauccuggcucacacagugaaaccccgucucuacuaaaaauacaaaaaaauuagccgggugugguggcgggcgccuguagucccagcuacucaggaggcugaggcaggagaauggcaugaacccgggaggcggagcuugcagugagcgcagaucgcgccagcgcacuccagccugggcgacagagcgagacuccgucucaaaaaaaaaaaaaaaaaguuaauguagcuaucuuuugaaacaaaccuaauuucagcacaaguacuucucuagagacuuuuccugacucuccagguuaaguuaggugaugcuuucuguagguuucaagagcauuuacacuggguuguaacucugugucuacacaacuaaaguaauaauugagaauuggaacuguucuaucucugugucucccauagcaaauagauauugagucaaaagguguagaauaaguaaaaauacguuagaaaguuucuaauauucaguuuuuggcucuccauuuuauaauuguagaaacuaauauccagcuauugugacuuuuuuguucacuggauucugugugcccaugcuuuaacgucaaugauagacaaaauuguugauggaauuuuuaaaauaggaauauaguaagacagaauguuauuuuccucacucuaaauuuuuccauaggaaaagcuuguuuucagcuuuucaguauacaaucauuuauuucuuuauauuguuuuaaaacuucuguugacugagucuggagcaaaauauccuccugggcauaguauuuugaauuuuuauuuaauuuuuaaaaauuauauagcuuugguagauacaguucagcuaaaaugguauagacauuucugucugcccaguauggugaaacaggcacuauguuaaacauggaugcagacuauauuugaaaauaagcuuguaagaauaaaaauuaaugauuuugauaaaucagcugaaauccuucauuugccuuaaguggugguggucgcaaguaaaggugaguauagucaccuuagaauuaaaaucuuuauaaauguucccaggaagcuuaaugcaguauugguaauacaaagguaacuggacuuuuggcaaugugguuugauugaacccugaaauccuggauuuaaauucuuuuuuuuuuuuugagacggagucacgcucugucgcccaggcugaagggcaguggugcgaucucggcucgcugcaaccuccaccucccagguucaagagauucuucugccucacucucccaaguagaugggacuacaggcaugcaccaccacgccuggauaauuuuuauauuuuuaguagagacgcgguuucacuguauuggccaggcugaucucaaacuccugaccucuugauccacccaccucagccccccaaagugcuggggauuacaggcgggagccaccacucccggccuaaguuauauuuucuaauauccuugugacuuugauuaaaguacaguguuuaucagucagauaaucaguucugucacuuggaaaguaagggagguauuauuuauauaaauaggauuuaaauguguuauuaauaaauuaagguaguccuuuuacucuucuaaaauugucaaccaauuuuuuauaauguaauugcaaguuuuaauguuugucaaaagucuaguuguuuauguguauguguuugugcauguaaauauuuuucuguauauauuugauugcuuaauucuaugaaguauaucuuaacaucauuuuacaguugaauaauuuuauguugaagcuguacagacauucacuugccuaagaaaauaaguggaaauacuacuauuuauuuuuuugcaaugaaaagucaaaaccagaauucugguuaaauuauucgugauaauuucuuguucuuuguuuuugugaauguacauguggaauucacauuaauuauauuaguuguccaaauuuugaauacuuuuccuuuauuuaguaacuuuuaguaacucuuacugauaaauuauuauuaucuccauaguguguaucuuuuuuuuuccugaaaccaucaguaauacuggaauacauaaaagaaaauagcuaugagaaaauuuauauaauuuuggcuuucugagaagaggaaauaggggaggcuccauuuguguuccuuauuugaggaagaaauaaguuuauagcauuaauuaaaccagaaauaaaucuguaauuguaguacuuuuuucuguucauuucuaauucagugccauagguuauuuaaguaacuuuuacaguucaaguuauccuuacuugaucaauguaagaaagugcaaagaauuuuuaaaagcuagucuaaaaauuuuuauaccuauaagaacuuuguauaaacagaauaucaauaugagccacaauuuucuaugguauacuucauuguuuaaaaguccaagagguaaauuguuuauuuugcaguccuugcacaagguaauucuaaaacaaccauaugagccucuuuuacaaaggggaaugguauuaucuacaguauucucugauacauuucguuguuuaaaugaucaagaaauacauuguuuuuguucuuuuuaugucauucugaagaguacuucaaauagguaguuuugaaugaauacuuuugaaaguaguuacagaguucugauuuauuaaguuuugguauaaguggauagacaaggcauaagaaagaucgugagaagucuauaucucguauccaaacuuauuaaaauugcuaacuucucugaacaauugccuuuuccuuugauuuauucuuuccaauaugaaaauagagaauaaggauaauuaugucuauaaaaaucuuuguauauuuauuacuggauuuguaguaugugaugcagaaaaauugagggugcacaucaaggcacauuauuauuauacaaauccuaugaaguagauuuguuguauguuuuauuuaaucccauuuauugugggucaaguagugaccaguagcaauguagaaaagaaauauuuagaauaaccucuacauugcacuucagugaaauaaucuuacuuaaauuguuucuauuccuuaaaaauugcuuugggauuuuaaaaugaaauggaaaauaagaguacucugugaucugauaaaaaguuguauuacuauuuuuauucaauccaguucuuauuggauuuaaugauuuagauaauuuacuuuuauagcauuaguauauuuuauaauaauuaaguuuuucaaauacauguuuauacuaaauagaaauauugccauuauucuucuggauaaagggauuuaaauauguuuucauauuuuuagacucaaauauuugaauuucagguauuugaaauguuucuguggaaaacauuuauauaaaauaugucuaauaugaaaagccauaguagauuauuuuaucaaauaguuuuaauugcaguugcuugguauauguuuuauuuauaaaauguacuuuuucuuuugcccuaggaaaaugauuugaaugaaacucucagaucacuguauaaccacccaguaccaaaggcaaauacuccuguaaauuugagugugguaaguauucaaucaguaauuguuuuugggagucauagcuaugucucaauuucguuaagagcacguguaccuucaggcaauucuuuaccaagucaucucugcuuccaggaagacuucauugcuaguacuaacauaacaaggugauaauauugugucuuuuuaacaugcuguaacuaucauaacuucauauaucagguguguugaauuuaaaaaauuuuauuguaaacuaaaaguaaccaaaucuaugaggauauuucauuuuuaagaaacauugauuuggcugggcccgguggcucaugcuaguguaaucccagcacuuugggaggcugaggcagguggaucacaaggucaggagaucgagaccaucuuggcuaacacggugaaaccccaucucuacuaaaaauacaaaaaauuagccgggcgugguggcaggcgccuguagucccagcuacucaggaggcugaggcaggagaauggcgugaacccgggaggcggagcuugcagugagccgagaucguguuacugcacuccagccugggugacagagugagacucagucucaaaaaaaaaaaaaaaaaaaaaaaaaaaagaagcauugauuuucaggugaaauccgugcauaauaaaggaauauacacacaugcuuaauaacccuccuaaaaugaaaacgguacuuaguaagaauagaaaaugacauauaacauauaaauaugugauaaaaauucugggugaaaaguuucaucuguuuucccuauacaguaauaugucuucuaguauaaucacaaaauacuggaaauaugauugaauuuuuguuugucagacaacaagccugugaugggauagauuauuuauuguacuauugaaacuuuuaacgaaguguaccaucuauaucuaaaaacacucauguuuugggaguuuuuguaaaugcuuaaaguucaaaaucauaaaauauggauuuuuuauuaauuucuucaugguuuuggcauaugggcuagacuauuaaaauuuauuuauauuaauuuuguuucuucuaaaauaauaaacuuuuccuaauaaagaauaaaaaauauaaugucgcaagagaaaaugagaggaaagcuaacucaaaguauauauaagucuuuuguguuuuuaugagacagggaaguuguuaucuuuauuguauuuucuuugguaauaacuuucuucuuuuuaaaaauuaauuaauuuuuuaauuuuuccauaaguuauugggguacaggugguauuugguuacaugaguaaguucuuuaguggugauuugugauauuuuggugcacccaucacucuagcaguauacacuacaccauauucguagucuuuuaucccuuacccucccucccacucuucuccccaagucuccaaaguccauuauaucauucuuaugcuuuugcguccucauagcuuagcucccgcauaucagugagaacauacgauauuugauuuuuccauuccugaggcacuucacuuagaauaauagucuucagucucauccaggucgcugcaaaugcuguuaauucauuccuuuuuacggcugaguaguauuccaucauauauauauacugcaguuucuuuauccacuuguugauuacugggcauuuggguugauuccacgauuuugcaguugugaauugugcugcuauaaacgugugugugcaaguauguuuuucauguaaugacuuuuuuccucuugauagauacccaguacugggauugcuagaucagaugguaguucuacuuuuaguucuuuaaggaaucucaacacuguuuuuucauaguggcuguacuaguuugcauucccaccagcaguguagaaguguucuuugaucaccgcauccaggccaacaucuacuauugacgugggaugcggugaucaggugaucaguuuaauauuuguuuaguagaugugugaggaucauauuuugggauaccuacauguguaagaaguuuuaaacauugaauaauuauguuuuauugcuguuugcuaaauaauaugguggcugauguuuacaaaaguauuuugauuuuuugauuauggccauucuugcaaaaguaagguaguaucacauugugguuuugaguugcauuucccugauucauuagugauguuaagcuuuuuuuucauguuuguuggccauuugaauauauucuuuugagaaaugucuauucauguccuuagcucacuuuuuaaugggauuguuuauuuuuacugauuuguuugaauuuauuguagauucugaacaucagauguauagacugugagauuuucucccauucuauguguugucuguuuacucugcuuacuguaccuuuugcccugcaaaagcucuuuagcuuaauuaagucccaacuauuuaucuuuguuuucauugcauuugcuuuugguuucuuggucaugagauccuugccuaagccaaugucuagaaggguuuuuccaguguuuuauucuagaaguuuuauaguuucagaucuuagauuuaaguccuugaucaaucuugaguugcuuuuuguauaagcugagagaugaggauccaguuucauucuccuacauguggcuagccaauuaucccagcaccauuuguugaaaagagugucauuucucugcuuuauguuuuuguuugcuuugucgaagaucaguuggcuguuaguauuuggguuuauuucuggguucucuauucuguuccauugguccaugugucuugagcaaauuucauccugugauuucaugugauaguaguguucucuuacauuauuccauucuuuaaccacuacuauuaguaguagacuaaggugguuagcaccuuaguucuggugcuuaguacuucaaagaguucuuagucuagagccucucuccuuccagucauuucuacaaaagacugucagaugaaaguuacuuaagcuauauaaaguccccugcugaaaaccuuucguagcuccccauuuucuauagaauuuguuaaaacguuggccaggcuuucaggaccauccauuucuuagauucaauccaacuuuuaauuuuccuccucuauucuggucacauuguuuuguucagcuucuugaaugaacaucaugcuuuccuuuuggacuaaagccucuuuguugacuauguguuguuagucuagaacuugcucagucuucaacuuugugaaaccucuugucauacaacuuaaugcaguguuuuuucuuuccugugacccucucugcugcuuuauguuugcaucuucuuuuguugcacacugucaaaguggaaagguuuaauagucauuuguagacugggugauaaaaaacuaaggauaaccuggaauuuuuaacccaaauuugggagucagcagcagacaucauuguagcuauuuaaaggauaaaauauagaagagcacagagcagaggcuaaguucuaauugcccaaauaggcuauagggaaaaggaaaggagauccagugaaagaauugggggaaagagcaguuaaggagaaacuuagacuuguaggucauugaugcccaaagaauccaagguuuauggucaguggaaauacaauagaaagaccaagggaaaggucaaggagaauaaagaagagccugggauuuuccaaaaaaugguaauuucucuuugaaaguguuauauuuauaaaguuauucuaacacucuuaaagaguuaaggaaaauaaaggugcuaagacaauggagguggcauuaaugagaaauacaaauguguucucccuuuaaauuugaguaucauauuugcucagggguaaauaaauacaaaaguacaucucaaaaaaaccagcuauugaaacacuucaucuuuauuaauaagaaccauaaauuaaagauuucuaccccuuuuuaccuaggauuagaagauuuuggguuaaguuacagucacuaaguguguaauguuagucaagaaaguuaaucucuuuagaugauccuuuuuuuuccauuugagaaauugagcaugucaacuuuugagaaaguuguuuugguaaucaaauaaaaugauauaucuagauauacugugaagagcuauucagguguugguugguagcaaauugaaguuucaucucauauggagaaaauacuuucuucugaaauagcuaaauuguagcugaaauaaucuugucaaaggaauuugaguggcuguguucuguuccuauguauaauaguuauuuucauaauuaagccuucuuauacacacuugaauuaauagucuuauaguuucaagucuuguauaccuauuuuaaaguuauaauaucuuuuuuuuuuuuuuuuugaaguggaguuucgcucuuguugcccagguuggaaaacaauggcgugaucucagcucagugcaaacucugccuccaguuuugagugauucuccugccuuggccuccugaguagcuggaauuacaggcgcccaccaccaaaccgggcuaauuuuguauuuuuaguagagaugggguuucaccaugcuggucaggcuggucucaaacuccugaccucagguauucugcccgccuuggccucccaaagugcugggauuacaggcgugagccacugcaucuggccuaguuauaauaucuuaaguauugauaaaaucagcuguuaauguuuguuuacuaugaauuauuaauugcauuugauuucaauaacagacuccuaaaguacuguauuuaguguuauacuguuaaauaagugacaaauuugggacuaggacacuuaucuucagcuacuagaggagauuuuaguuuuaugauguaagauuaaaauggaugauuauguaaguuuuuguuccuguacaaguggauaauggccauuaguaaucagagauuuuuauaaaaaguuaaugucuaaugagaaugcuuuuuuuugaaacauuucaaaaucgucaaauauccacagcauucucuacucuuguaauaugaaaauacuuucauuaggauuuuucuagcauaaaauuagcaaaucagcauuuaaaauaauacuuauaauuaguauuauucaaguauuuuuuaguggcuaacuuggcuacauggguuugucucaauuacacagcaaauuguuguguaagcuucucccaugaaaguaaaauauucauuuuuuucucucauguauuauaagaaccaagagauauuuauugccugugagcaaguucugaaagaucagccugcucuaguaccggugaguuaaaaggacauuggcuucuaaaaaucacuauuaaauaggaaaaauaaucacuuauuucacuaugccuuuaagcuucacuccagcccuuugggaaauggugaauuugacucuuaagaaaauuaaucauuuggaauauauaauauuuucuguuuauacuaucuuuuaaagcauaguuuuaugaaauauaguacuauuaaaaacuauuccaaauaaaaguagguuauagagaccgaaaucuuugcauauucuccauuuucaguaguaguaauuuuaaaguauauucacagcacaagauuugucacauuuuuuggucccaagaucacaaaagaucuugugauuuaucuccuauuguucuucuacccuggaaaauuauagauuaugacuguguuaacuauccuuguucugacuaguucaacugugcucaaauauuggcuaaaauguuucuuuucuaaucauuaauaauaagauauuauuaaauauguccuuaugugauucagauauuaaauaauuuuggagauuaauaugaacagaaaauaaaacuuuugaugauuaaauugcacuuugauucugggugguaaaauuugggaacauugugggaaacaugaaggcauauauacacaauguauucuuuauguaaguauucugaugaacuguuuuacuucuuugaacauuauagaagcuaauuaauauuuggcagauguguaacaaucauauuuugggauuacuacguguuuaagaaauuuuaaacauugaaaaauuaugcuuuauugcuauuugcuaaauaauagggugguugauguuuacaaaagagauuucuugugacuuaccauagaaacccagcccaggaaucuuaguagauuuugauauauuugguuagcaagcuuuaauuuuuccaguccaccucaacuaaauguguuuuaauaauauauauguuuauauguauguauagguguguaugucucuauauacuguauauauacacauacguguauauguauauauguacaaaauaaaccuuucagcaauauacucuuuuuuugccuuaacauuuuuucccuauuuuaauuuuaauuuuagggucaaauauuuuuaaccaagucuuaacuuuuuguauggcaauguaauuguuaaaucucauauaaacccgcuaacucauuuaagaaucucucaaauucaacaaauccugaaugucaguccauggcauuuuuuaauuuacucaauauauuuuuuucugauuuucauuacaaauuauauguuaccaguuuuaauuaucuuuuucauaugugauuuauuuguauugauuagcauuccuacuucauugccccugauguaacuggacucccaacaauacccgagaguguaaguuuccuauuuucuacuuuaauuauucuuauauuauuaauuuuguuuauuuuggucucacuguuuaugcguuuuuauauagagaaauaggauacauuguaauuaucuguguuugugagaaauaaugaagaaauaagaaauaaagauauuauuuucuuuucuucuuuauauaucugccccuuuaccuucuucuuaauaucugguuguggauaaggaaaauuaaggacaauaauauaaggaaaacuauuucuaucauuuguaguaauuagguaggaucauauauauauucaauuaggucuucagcuucacuguauaugauagaagagauaccucaggagauggcuucuacuuguggagaagaauucuagcaaugggaaaugucuucacacaaaucauuauuuuagugaaauugacauaguauuuuauauuccuuguauauaaugcuucaaaucguagaugaacuguucuuaauuuccugauuuuaauuuaaagcaauacauaucuugcaagguuugauggcuauuguaagaaauuuuaaaaauugcuaaaauuuucauuuuauuuagaguccuaauucuagccauacuagaacuauuuucaguauuuuaauaguuauuacacauuaguauuuuguagaaauguuuacauagacaaguagaaguaacaaauaugcuuuuaugauuuuggauaacuaugugaaaaugaaguauucccuuacguaauuuuucuucagcuucccuuggaaaguuaaaaugaaucaguaggaauaacucaaucaaaaguaaaggaaaaaucaacaggaaaaaaguauuucaauauauacuuauuauuuacuuugggauucuaguguuuuuccaaauguuuucaaaccuacugaguguuugguuuccaaaagcauguagguagugaaggaaguccaagaagccaauaguaaauuuucugauaccaaaccaagacugucgaugguguuuucaguacagauggauccaaaaaacccuuaugaaaagcuuugcaucaaguugcucguaugggccugagauagauaaucaaagcucucaggugacauaauggauccuaaaguauugacugcuguacacuguaggccagguacuccuuguuaauguuuucuuuaaggcugacugaccaugucuugacuuauaugacccuugucccuucacuucaggguuucaaagucaaauuugcuuccgucuacucucucuccuauuuaccuuucucuuauguuuacuaacaaacaacuaauaacuugauuuaacaaaugucacauuuuaaaaaagaugauuacuuugaaaguuucaaggaaacaaacauucaaaggaaaaacugccacugagaauauguauuuuuacuugucuauuaacauguuuuauuuugcagaaaguccuguuuagggaaaagaaagcaagagaauaagcauaaggcagcacucuaugcugagaaauaauuccccaucuaaaaauuaccuuucuuuuagauuauaggaaauauacuaaucuugaauaacuugaauuuuuauauggagaguugaauuggaaggugagaaagcacgaaauaaaccucuucccaccaaauucaacaucacccacugauaguuacagguucuauugaugugcucuaucaugauuaccaauuugugaugguaaaguuucuaucuuccggaaauugaagaaguaauuggauuucuuacauucuugccugacuagaaguuuuagccuacuaggucauagcccaccugaugcuacaguuuuuguuuguuauaucuuguugaaucccuuaauuaguuuguugcuuucugauguauuuguuucauuauagaaaauuaaaaauaaauaauaagaaaggagaagaucuaaaagucaaaguuaauguaguagcuuaucccaguuucauucucaugugggggauaagagugcuaaauuaaggaaucaauuuagaacaucaucaaauuauauuugauuauaguggauauaaagcaagcgugacaugaaguauaaacaagguaauuuccuuaauaaaguaccaaagggcuguuuuauaaauucaccucauccuuuggguacguugugcaugcugugucguaucagaugaugauugugccugcauagugaauggcaaacaugaaaagacucaaauguauugucuggggcagcgguuucugaaggaucaguguauauaagaaucaccagaaguauuuguuuacaaaacagauucuuggccagguguggugucucaugccuguaaucccagaacuugggaggccgaggugggcagaucaucugaggucaggaguucgagaccaacccggccaacauggugaaaccccaucucucuacuaaaaauacaaaaauuagccggaugugguggcgugcaccuguaauccuagcuacucugguggcugaagcacgaaaaucaccugaacccgggaggcggagguugcaaugagccaagaucucaccacugcacuccagccugggugacaaaaaagaaaaaaaaaaagcagauucuuggggacauacacuaaagaugacaauucaacagagcagcucuagguugggucccaggaaauuagcuucuuuucaaauacuuagcggguaagaaaguugggaaaucugugaucugaucauccucugcaaauacuuaccuugaguaggguuauguuucaacuaauaauagaauauuauguacuuuauguggcagccgacuaguauuacacuuaauuauuuuaauaaauaccauuuuaaauaauaauacccuuugaacuucaagacuuucugguaaguguguaaaauguuuuucuucacauucacuaugagcuguaacuuacacaauuaucuuuuacuuguacagagaaaucuuacagaauauuuuguugccguggaugugaacaacaugcugcagcuguaugccaguaugcugcaugaaaggcgcaucgugauuaucucgagcaaauuaagcacuguaaguacuucacacuucuuuuaaguagcagguauugaguguuucacaaaaagaccuaaaaaccuuugcagauuuagaaaugugcuauguguacuuauaagacaauaucuacauacguuuuugauguaugguuuuaaucuggcucuugaaguacaaaagucugauuuauaggaagccuucucagaugcauuaagucagguuaauuauuuuuucuuaucaggagaugagaguuuuuuuuucuuuuuaacucuccagaguucauuuuagugccuucuaccauauaaagaauucuuaagagcuauuaugagauuuuuauuauucacuuguggcuuuuuccauuggagccacuugaaagaaaucaaggggccaugauaauagcugcuauccuaaccugguaauagguagauucaucuuuguugccaaguagugguuugggaguagauuguauaauaguuugauuuagagcagcucuuugggcugauaauaacuuaaaagucaaaguagcauuuuuuauaaaucacagguuuuaugacauucacuaaaauguucuuuuggaaggucuuuauuaauaugguaaaggcagggagagaaagauuuuucuugggucauagaaaaauauucagaaguauuuugcuagauuuuauaauuuuuuucucauuuaagcuucaaaaauuuaauauuuucaacuuaaauuuuuaaauacaaauuuaaauauaguuuuagauaaucuaugauguauuuauuuagcaaaaacuauuauucaauauuuuaugaauuuucuuccucacaaauuugauuaauugauaaauaaaaccauauuuuuaauguuuucuucuccuauaguagaaauaaaaaccuuaaucuguauuuuagcauuuaaaguagaaggaguuucaggauuucuguaggauaucuguuuaacauuuaacagugagaaagguauuuucagugagauuaaaugaccacuucaaggccaaacagcuaguuagagacagauaaugugaaauugagucuuuugauucuaauuuuuggguuauuuccauuacucuacaauugaaaaaaauacauacaauuguacauauaauuuguaugaauuuauaauucacgaaaaucucaaaaauacgauuuugagauuuugaauuguaauuugauaugcucacuccuaaaaguugaaaaugcacuuuacauauugaaaaauauaugcauuuaaaagaguaaggguggauaaaugaugcaguaauaucagagaauaagugcuagucaaugacacaaguaauuuuuuucuuacacaucuuagagaugucaagaaauucaguuugacucauuugauauuuuaauuugccuaucugcuauuuuuuaacuuacuauugaagugaaacauucuucuucuuucuccccagcuccuccuccucauuuuuuaaacaugauuuuuuuuuaagauuaaaaaggauauuuuuaaauggauauuguccucaaaauuaaaaagauuguauaauaggcuuuggaacuaaauuuuaucaggauuaauucauguaacaaauguuuauuaggcacauacuaugugccaggcacuuucuagacauuaaccauauucgacuggcaugaaacaguuuguaaacaagugagcaaacaaauagcaauuauuuauuagcuaggguuacauaauggauaaagugaguggguuuacaggguagacagugauggacagguuuccauuuuauguaaggaaggccucuccaaugagguaguauuuuguuuguuuguuuuuuugagacagggucuugcuauguugcccaggcuggucucaaacuccugggcucaauggauccuccugccuuggguuuccaaguagcugggacuauaggcacacgccgcugugcccaacucagugagguaguauuugagcagagauccaaagaaagugagggaauaagcuaugugagugaagcauaagcuacuguauuuguguauuagaaauaaaucugaguauauguuuuugaaaaauauugguguuuuauuuaauuuauauccaccucuuaaugaccaaguaaucuguuugacucaguuucuuuaaguguagaguaggagcaauaguagccuuaaucucauaggguugauguaaagauuaaggaaauacauauauauaaagugcuuagaaugauaucugcauagaauauauguuuaguaauuaugagcuauaauuuuauaauaguuuauauuuaauuuuuuuuuuuuuuugagacagagucucacuuuguugcccaggcuagagugcagugguacaaucuuggcucacucuaaccucugccuuccagguucaagauauucuccuaccucagccucccaaguagcuaggaguacaggcgccugccaccacaaccagcuaauuuuuguauuuuuaguagagacgggguuucacuauguuggucaggcuggucucgaacuccuaaccucaagcaauccacccgucuuguccucccaaagugcugggauuacaggcgugagccaccgcacccggccucuacauuuaauuuuauaauagucuacaucugcaguuagaguaaaaauuaacauuacuaucuuuuaacuuaguauuuggcuuuaaaaacaaauuguuaucauaaaggcuuaguauuuugggggaguuguuuucuauguuugaugucaauuuauuaucaacuguuuaugacaauucaugaaaacuugauggugaugucaccucuaaguuaccagcucuguuuugguucacucucugggaccguugggcugauaaaagaaacauaauucaaguucucuuucaugaucuuagucuucuuuuauggaggaagcugcuuuacuugaaucugucuugaauaauucuuuuauauauacaguauauaaaauauaucugcuauaaauuccaugcauaguggcauuuaaggucaaggacucauuucuuaacauaaauuaaaaguaauuuauguaaauuaaaaguaaaaucaaugaauuuacuuguuuuuaagcuuuuuauacucauauuuuuauauaucacggagacuauaauguguuuaauguucgaaauuaacguuuuauccauuuuuaauuuuuuaaguauacagcccaacucuuaauuuuuagaggaauauauguaaagguggccuaacauucauaauucuauuguaguuuuagaaauuuugucucaguuauuuacuuuuugacaaucaugauuuuucauaguuauaagagaaugauaauuauaaaccuuacagcuugcuguagguuuuaguggugacacucucauuagagaaucagcuagcuugagguuccuuuucuuuaggugcuguuugugguuaaaaaugauaauuucuugccggaugcaguggcucacgccuguaaucccagcacuuugggaggccgaggugagcagaucaccugaggucaggaguucgagaccagccuggccaacauagcgaaaccccaucucuacuaaaaauacaaaaauuagccaggcaugguaccacgcaccuguagucccagcuacucgggaggcugaggcaagagaaucacuugaacccgggagacggagguugcagugaaccgagaucacgccauugcacuccagccugggugacagagugagacuaugucaaaaaaaaaaaaaauuaaccuuuaaaagaugaaaaguuuaaaauuaaaaaaauuaagauauguaagcacagauaucaagaauauuguuauguuuucaacauucuaauagguuuucucccuauauuuuaaagugugguauuguguuaguaccuauuauuauauuuuugcauguuugaguuuaaugaauugagauauaaucaguuuuuuuuuauucuguugauucauacauuauucuguugauuuauacauugucaaguacacauggaacgguuucugguaauccugaacaagaacauugauuuuauccaugcuguagguaggccauagauguuuaagccccaagcgaaucuugguagacuagcagaacaucauauuagauucucguguauucaaagcagaggcauaaaucaugauauuacaaggggguaucaguugacuuauugcuguuuugugaccauagguagguuggauugcuguuuaaagccaugucagugguucucaaaucagucaggcaugaagccuugucauaugccucuauaauuguaccucaccagacuuucucuaacuauucagcuggggcugugcauuuugucucaaacacccggcuggccagcaucugacaggagcuuucucaucauccugucaguaauauguuaacuagaguguaucuuuguggccuguagaagcagguggaagggaugcuucuuuuaaaagcagaugucugaauguuagcuauuauuuugaccauuauuuaguuaguaaauucacccucagaaagucuauaagcauauuaguuacagagauuugauuguguagugcauguuguuuuggggauauuuagagcaagcaauauguuaugaguacuggaauuacguuaauaaacuguaauuucuuccuuuguuauaguugcccccaggcauuuaagcauaugcuuuucucuccucucauuaauuccaucaagggcauauguaaaaagaaaucuuucgaucucuggaaaaucagcuauuaaauauagauuuuacagguuuagucagacugaaaggcaguccagaggauuuuaaccucuucaucuggauuauacauauucuugauuugucucuuaauggagccaccugugucagcauuuaaucugaaacccgaagugcagagacucuuucuggagaugaggaauugaacauuuggugagagaacaaagauuacguaguccugcuuccuaguuaagguuauuaaaguguauuuuugugccucauguuuuuaaagcugcagcagaguggugcaguuaaaaauuguuaucaucucucagggaaagauucuagaagcaauuuuuagauuuuuaauucuuccccaaacccguaagcaaccaguuaugucaucugaaacugaauaauucuacuuaccaguuuaucauuucaccgguacacagcuauucugaacauuguauuuuuagucagugcuaagugaauaugacuggaguggggaaaugguacuguugaggucaucaggaagcaguuuauuggaagggaugugugaagguuauuuggaggagacuucuguuacaggaaaacuagagguguuuuuaucuuccaacuccuguagugauaauggcucuguuuuucaugaaaauaaacacguauuucugccuuaugauuuaguccauuuguguucuaaaaguaaauaauuggcuuuuaauucacaaugaagaauuuuuuaauuuaacaauuauggaauuaucaaagaguuguuauuaacuugucauuccccuaggcucuguaagcuuuguuccuguaugauauccacagaaaugaccuuggaugauuucaguuuaccaagcauuuuuuuuucuuuuuucuuauccuuauagcuuacagacagugauaauguuaguauuuuuuauauggaacagugacaauuuugugcugauaguguaaucaacauuaaauaaaagaaaauaauguauguguugguuuuguuucuuuaauaaaacuauugagggcaguguguuuauuuuaaaauguaccuucuauauuuauauguuuucacauacuauaauuuuuuuuuucauuuuacaguuaggcaaguuuuucucuuccagugagcuuucuuauagugcaguuuagcucauuguugacaucccauucaauaccgccaaaaugcaacucgccaucuuuuccccauagucuccuucuccuacuauaaagggcuaauuuggugaaucacuccucccucucaucuguuuuccccaccuacauccuauagguucuaccuccuuaaucuuuucuucuccgauuccuguucuucaacugcccacugucuuaguucagcaguuacuacuucccacagauauuauuuucagaucauauauacugaauucacuuacauaaaaugaugauguuauuaauaauuauagccaauauauaauauagggcaugcuuugcgcuacuuacccuacugagaaauuuauuuaaacuaacucauuuaauuauuauguauuaugugguagguacaguuguuauccacgguagacagaugaaaauguggauuuugaaauugagagggaguaaguugaucaaggccauaguacuaggaauugguuuaaccaguucuguaugauuccaaaguauaugcuuacaaccuuuaugcaauuuugccucuuacaaugaccaucuuauaaaaccaaaugcauccuuaccuucugccccaauauaguaucccuucccuuaaggaaccucuguuuauuauuugaauuacuuacagugaagugacuuuuuuccucgucuuugcaggucuagucgauuaucucucaaugugucauauuuauaccuuucucucauuuugaauaccacuuuuagggcuagcacuuaucuucuguuuggaccucucauuuuccauuuucucaucuuuuagauucauccuauauguaauuaauccuucagaauaaaaaaaaucuauugguuacucauugccuauaaacugcuaagucugguaaaaaacuauccauuaucugauucuaaacuugucuuucugaguuuuucgauuacuuauaguccacacagaucuuuagacaauaaaguuaucagggcggguuuuuuuuucuuucuuuuuuuuuuuuaaucuuguucagucagucacuacaauguaucugucucuuaggacaguguugauauguauccauagaagguuuuaacaauaauuuucugagugaauggaugaaauugcacuuuuugcucuuccucauauguguuuuaaaucucccacaugcaugcuucugaauguuuuucaaaaucugguuugcuuuacagaaggcuuaguuuguaugaguaaccaguguaacaucuuucaucucugaauuaucauagcauuuaccacauacccuucucaaauuuuaaauauuagugaauaugucaagcucuuguauuagauaucgaucucuuuaaaaauuaaaaaccugccuggcaugguagcucaugccuguaaucccagcacuuugggaggcugaggugagaggauugcuugagcccaggaguuugagaauagccugcgcaauguagugagacccugucucuacaaaaaauuaagaaaauuagcuggguguggugucacacgccuguaaucccagauacucgggaggcugaggugggaggauugcuugagccaggaguuuaguacuguagugagccauaaucgcucuacugcauuccagccuggcaacagaaugagacccuguaucaaaaaauaaaauaaaauaaauaaaaccauggguuguguguaucuguggguguguucauguauguauugaagaauaaauuuaaucauuuaaauugugucagaaaaguuuuuaaaauaaaaaauuauuaauuacauuauaguguaaaauauaaaguguucaucugauacugaaaaugccagaguagaaaguguaucuuugucaaguagaaauguaucccuugauuuaucucuuugacauuugucucuuuaaauaaugaaaguuucuuuguaaaccuugaaguuuccaaguuaggugcugauuacuuccuccuuccuucccuuccuuccuuccuuccuuccuuccuugcuuccuuccuuccuuuucacgcagaguugcacucuugucgccaagguguuggaguguagugaugugaucugggcccacugcagcuucugcccgcagaucucaggcaucuuuccacaccucagccucccaaguagcugggacuacaggcaugugccucugugccuggcaaauuuuuguauuuuuuuguagagacgggaguuucaccauguggcccaggccagucuugaacuccugggcucaagcaacacuccugccucggccucccaaaguugcugggaucacaggcgugagcuacugugcccggccuaggcacuaauuucuguguagguguugucuuuaaaagaagauuuguguuuagcuauuuucuacuagauaauuuuuuuuaaaagucuaugccaaaacaguaaugccuuagggaaaaauguauuaauacaucuuaaacccuuuucagauucauggauuuguauugcaguuaugacucuuguucagccuauacaggaacuuaguuugguauucuuuggucuucauauaguccuaaauagaaaguucauuacuuucuuucuauaaaaaauguucauuuguucauucauugaaucguuccucauuuaaggaaugcuuaacucaugccaggcaguguucuauagguaagaucauaaaguaacagccuuuguaucagucuggauaugaccaggaaagagaaauuacauaguaauuugaacaaggaaaguuuaauauaaagaauuuaaaaacuauaacauugggauugggguaacaagggaugggcuacuaguaagugaaggaaauucuaaagacuauagaaauaacaaauauaaagcagcuacuagucuuagggcugagacggagcacccagggaagaagcccuaucugggugugagauccagacuccaauggagagggcacagcuguguggcucauuggauagcagagaaguugcuguggugccacacuggcagaauuuucuggaauccugcccuuuggggugcccaggaaagcugcccucagagaaaugccauuccuuagaacuugcuggaaagccauaugagagguacuggggaagcuguuugcaagagaugccucacucgcagcagacuacuauaaagccuccuaaggugaagcuauuaacuaggaucguguuacuggggaaacucccuuaaaaaacuaacaaagggaagcugcuggccacuugguacuguuggaaauuguacacuccaguaaucaggugcaggagaugccuccugggcugcaggaaccaggcaguagaaaggcuucaagugcugcaagagccagggguacucugcuauaagguaggggaaugcugagggaaaccuuuggcugccaguaccugcaggagccaggcacugcagaaacugcccacugcauaggagccugguggacaccugugcuauaggaaaugggcccuagggaagaugcagguacaauaggagccagcccuugaugagccauaagcuuugcaggagccugcagagugucucacuggaaccaggagcaaguucucucuuuuugcauugucccuuuaguacccucuccugacaaaguuugacaucaugccaguugcuaaaaggaaaaauauccagaguccagauccauuuucacagaucaggcagugaggggcagauuuggagcugagaggcaauaaguugauaauugguacaguccaccccuuuggauacucagccucuguuuguacccuucuacacauauuugaauuccuguacaauaaaacaaaucuauauuucuaccuaauaacauacaacuaucauuuuuuacaaauguagacauucucacccuuuccucuaaaggagaagcccuuguuuauguaacuggucaagaggccauaauugguauguauggcuuccuuuuauuacccauuccauauuucucucacccucagcuagaacuucaccuggacaggaucuuuaucugguaaaaugucccauucucaaagaaucucaauccucaaagauuuagcuguguuuugguuguaguuuuucauuaacuuuuacuuuaggcaugcaaguccugaggcaccauagagaauccccugguucaagacacguuucucuuugccaaacuauuauguagaagcaccccaguuucccuuugguuauugagaacaaucacucaagccaguagauuaacuuccucuuuuucagccuguugauucaguggcauaugguaccccaguuagccaaguggcaucuuaaaauuaaaguagaagcauucuucuguuaaauaggaaggaguuaaaaauaguuaaccaccugagaaggaaagaaaugccuuuauuuugaaauaaauauuuggcaugaguagaguuuccaaagauaagguauauaaguauuuauucauuugugcauugauaaaugcuauuauuugccagguacuaaguacugggaauuucagaguuacuaauuugugauucuauaacagugucagugagucaaggacagucagugugauaaaaauucuaacaugggagauauuaggagauagaguggcagacuacagaguuuacuucaauaugacaccucauucucgaaaggaauuuguaucaugucuaggaaauauaucuuuaauauauuacuguuuguguguguguauguauguuuguauauggagagagugggagagagagaaaucagacuacaaaaucuaucuggggauauaaacaguggccagauugugaagaaucacauuugcuaauuuaagagguuuggcuuuuauccaacagauuguggggaggcaaaugagguacaugacaugguaaguuuuguuuuggagaagauaacacugguggccuuauaaaagaagaaaugcaguagggggaauccagcugacaggagaucaguuaaaagauuguuacaguaauaaaagcaagagaugauuagcuccugaacuagaacagugaccuuaagagggaggugagguuggguuuuagaaacauuuccaggcaagagucuuuugccugugguauuagcuuaagaguagguaagaaaagggagaauguagaguggcauacacaggacaagucuuuaccaaauguuuacuuaguaucugcuuuauaaggggacaguucuugauaucauuuacuaacagcaaauuucacuuuauaauuauguguaugcauauacacacauauacauacagauauucacauauauaugauaugcaugcuaaauauacacauguauguuaaacagacauaagauaaagguuauauauaguaauuuuaacauuaaaauauauauaauuguuuauucuuauuuaauuacaaauuauuauauuuguuaacucuaaagauuuagaauuuacuuuguuguuguucugccauugugauugucucuuuuucaguugcuggugguuugcgaucaguuuuauuuuguucugggugaaagauauuuuaaauuaugauuucaaauaugacuaauaguuaaagaguagcuucaaucaguuuuuauuuacuauuuauuugaaauauugucugaauauaugguaguaauguguucauauuaauaauaccuucuaaaauuagagauuuguguuuuaguccuaacuacucuacaguacaucagcuaccuucuuauaauucaucuaauuucuuuuacccugaaauuucuugucuaaaaaaugaagaaauugaacaagaaugauuucuaggauccuuucuaguuguuaaauacaaugauucuuauauuguauauuuauuguuuaaaaugauugccaaauuauguaauuuuuguauaaaccauauccuaacccuucauccuccagaauguagaguuuagauauuugugaagaaaaaauauagacagauuugaggaguguuguaguguuacacucuuuaauuuugguggaaaaguagaagggccuucucuaagaaaagaaaaacugcuauugaauugacuuucugagagugagaauuagaaaggaguaaauuuagugauagggaaaugucauguaggugaggagauguauuugaggguauuggcauuuauguauaaugugauagcacagaaauccaaagaguugugacgaggugaguacagcaguaauggugguauauagaggguaacuagaauguaaguuccuugagaguacagauuuuuguauguuuuguucauuacuguauccucaccacuaauaauaaugucuggcacagguuuggugccccacuugcuggcuuaguaaucuugggcaauugacuuaacuuugccucaguuucuccaacuauaaaaugaaagaaagaaugaauacuugaaggaagcaagcaagaaagaaaaauuuagaauuauuuggcuaggaagagcuaauaaaccagugacuaaaugugagaugauuagaacuuuccaaaggacuuggguaugauggaaauaguuuagaauaaacuuuuagcagugaaguaucagaauuuaccaucaacuauggucugacuguguccccuaaaauuuguauuuuuggaauuuaaaaccuaauaugauaguauuaagaguuagggcauuuaggaaguaaugaaaucaugagcccucauaaaugcaauuagugaccuuauaaaagagcuucaagggagcuguucagucccuccugccgugugaggaugcaguaacaaggugccauccuauggagaagagagcaagccuuuaccaggcacugaaucugcugguaccuugauguuggauuucccagccuccagaauggugagaaauaaacuccuauuauuaauuaguuaacuacucugagguauuuuguuauaguagcccaaagagacuaagauaccauccuaagagaauaaaggaagaaaauaaaguauaaaaaauuuagguuuauuugaaaccaccaaaaugucuuccagaguggcuguaccauuuuguauucccaccauaaaugaaugagaguuucuuuuccacaucuucaucagcauuuguugucaguguucuggauuuuggccauucuaauaggugcguagugguaucucauuguuuuaauuugccuuucccugaugacaugugauggggaacaucuuuucauaugcuuauuugucauuuguauaucuuugcugagguuggugaggcaucaguuacaguuuuugacccauuucuuaauuggguuguuuguuuucuuauuauagaauuuuaagaguuuuguauauuuuggauaacaggcucuuaucagauaugcccucugcaaauauuuccucuaaaguccguggcugcuuuuuaaauuuucuugacaguguuuuucacagaacaaaaauuuuaaauuuauucauuuuuuauuuuauuuuauuuuauuauuauuauacuuuaaguuuuagggcacaugugcacaaugugcagcuuaguuacauauguauacaugugccaugcuggugggcugcacccauuaacucaucauuuagcauuagguauaucuccuaauguuaccccuccccccucccccgaccccacaacaguccccagagugugauguuccccuuccuguguccauguguucucauuguucaauucccaccuaugagugagaacaugcgguguuugguuuucuguccuugcgauaguuuacugagaaucaugauuuccaguuucauccaugucccuacaaaggacaugaacucaucauuuuuucuggcugcauaguauuccaugguguauaugugccacauuuucuuaauccagucuaucauuguuggacauuuggguugguuccaagucuuugcuauugugaauagugccgcaauaaacauaugugugcaugugucuuuauagcagcaugauuuauaauccuuuggguauauacccaguaaugggauggcugggucaaaugguauuucugguucuagaucccugaggaaucgccacacugacuuccacaauggucgaacuaguuuacagucccaccaacaguguaaaaguguaccuauuucuccacauccucuccagcaccuguuguuuccugacuuuuuaaugauguucauucuaacuggugugagaugguaucucauugugguuuuuauuugcauuucucugauggccagugauggugagcauuuuuucauguguuuuuuggcugcauaaaugucuucuuuugagaagugucuguucauauccuucgcccacuuuuugaugggguuguuuguuuuuuucuuguaaauuuguuugaguucauuguagauucuggauauuagcccuuugucagaugaguagguugcaaaaauuuucucccauguuguagguugccuguucacucugaugguaguuuuuuuugcugugcagaagcucuuuaguuuaauuagaucccauuugucaauuuuggcuuuuguugccauugcuuuugguguuuuagacaugaaguccuugcccaugccuauguccugaaugguaacaccuagguuuucuucuaggguuuuuaugguuuuaggucuaacguuuaagucuuuaauccaucuugaauuaauuuuuguaaaagguguaaggaggggauccaguuucagcuuucuacauauggcuagccaguuuucccagcaccauuuauuaaauagggaaucguuuccccauugcuuguuuuugucagguuugucaaagaucagauaguuguaguuaugcggcguuauuucugagggcucuguucuguuccguugaucuauauaucuguuuugguaccaguaccacacuguuuugguuacuauagccuuguaguauaguuugaagucagguagcaugaugccuccagcuuuguucuuuuggcuuaggauugacuuggcgaugcgggcucuuuuuugguucuauaugaacuuuaaaguaguuuuuuccaauucugugaagaaagucauugguagcuuuauggggauggcauugaaucuauaaaauaccuugggcaguauggccauuuucaugauauugauucuucccacccaugagcauggaauguucuuccauuuguuuguauccucuuuuauuucauugagcaguguuuuguaguucuccuugaagagguccuucacaucccuuguaaguuggauuccuagguauuuuauucucuuugaagcaauugugaaugggaguuaacucaugauuucgcugucugucuguuauugguguauaagaaugcuugugauuuuuguacauugauuuuguauccugagacuuugcugaaguugcucaucagcuucaggagauuuugggcugagacaaugggguuuucuauauauacaauaaugucaucugcaaacagggacaauuugacuuccucuuuuccuaauugaauacccuuuauuuccuuccccugccuaauugcccuggccagaacuuccaacucuauguugaauaggaguggugagagagggcaucccugucuugugcccguuuucaaagggaaugcuuccaguuuuugcccauucaguaugauauuggcuguggguuugucauagauagcucuuauuauuuugagauaugucccaucaauaccuaauuuauugagaguuuuuagcaugaaguguucuugaauuuugucaaaggccuuuucugcaucuguugagauaaucaugugguuuuugucuuugguucuguuuauaugcuggauuacauuuauugauuugcguguauugaaccagccuggcauaucagggaugaagcccacuugaucaugguggauaagcuuuuugauaugcugcuggauucgguuuuccaguauucuauugaggauuuuugcaucaauguucaucaaggauauuggucuaaaauucucuuuuuucggugugucucugcccggcuuugguaucaggaugaugcuggccucauaaaaugaguuagggaggauucccucuuuuucuauugauuggaauaguuucagaaggaaugguaccaguuccuccuuguaccucugguagaauucggcugugaauccaucugguccuggacucuuuugguuugguaagcuacugauuauugccacaauuucagauccuguuauuggucuauucagagauucaacuucuuccugguuuagucuugggagggugugugugucgaggaauuuauccauuucuucuagauuuucuaguuuauuugcguagagguguuuguaguauucuuugaugguaguuuguauuucugugggauugguggugauauccucuuuaucauuuuuuuuccaucuauuugauucuucucucuuuucuucuuuauuagucuugcuagcggucuaucaauuuuguugauccuuucaaaaaaccagcuccuggauucauuaauuuuuugaaggguuuuuuuugugucucuauuuccuucaguucugcucugauuuuaguuauuucuugccuuuugcuaguuuuugaauguguuugcucuugcucuucuaguucuuuuaauugugauguuagggugucaauuuuggaucuuuccugcuuucucuugagggcauuuagugcuauaaauuucccucuacacacugcuuugaaugugucccagagauugugguauguugugucuuuguucucauugguuucaaagaacaucuuuauuucugccuucauuucauuauuuauguacccaguagucauucaggagcagguuguucaguuuccauguaguugagugguuuugagugaguuucuuaauccugaguucuaguucgauugcccuguggucugagagacaguuuguuauaauuucuguucuuuuauauuugcugaggagagcuuuacuuccaacuauguggucaauuuuggaauaggugugguauggugcugaaaaaaauguauauucuguugauuugggguggagaguucuguagaugucuauuaggucugcuuggugcagagcugaguucaauuccuggguauccuuguugacuuucugucucguugaucugucuaauguugacagugggguguuaaagucucccauuauuauugugugggaaucuaagucucuuuguaggucacuuaggacuuguuuuaugaaucugggugcuccuguauugggugcauauguauuugggacaguuagcucuucuuguugaauugaucccuuugccauuauguaauggcccucuuugucucuuuugaucucuguugguuuaaaguauguuuuaucagagacuaggauugcaaccucugccuuuuuuuguuuuccauuugcuugguagaucuuccuccauccuuuuauuuugagccuauguccuaugugugucucugcaugugagauggguuuccugaauacagcacacugaugggucuugacucuuuauccaauuugccagucugugucuuuuaauuggagcauuuaguccauuuacauuuaaaguuaauauuguuaugugugaauuugauccugucauuaugauguuagcuggugauuuugcucguuaguugaugcaguuucuuccuagccucgauggucuuuacaauuuggcaugauuuugcaguggcugguaccgguuguuccuuuccauguuuagugcuuccuucaggagcucuuuuaggucaggccuggugguggcgaaaucucucagcauuugcuugucuguaaaguauuuuauuuuuccuucacuuaugaagcuuaguuuggcuggauaugaaauucuggguugaaaauucuuuucuuuaagaauguugaauauuggcccccacucucuucuggcuuguagcguuucugcugagagaucugcuguuagucugaugggcuucccuuugaggguaacccgaccuuucucucuggcugcccuuaacauuuuuuccuucauuucaacuuuggugaaucugacaauuaugugucuuggaguugcucuucucgaggcauaucuuuguggcguucucuguauuuccugaaucugaauguuggccugccuugcuagauuggggaaauucuggauaauauccugcagaguguuuuccaacuugguuccauucucccugucacuuccagguacaccaaucagacguagauuuggucuuuucacauagucccauauuucuuggaggcuuuguuuguuucuuuuuauucuuuuuucucuaaauuucccuucuugcuucauuucauucauuucaucuuccaucacugauacccuuucuuccaguugaucgcaucggcuccugaggcuucugcauucuucacauaguucucgagccuuggcuuucagcuccaucagcuccuuuaagcacuucucuguauugguuauucuaguuauacauucgucuaaaauuuuuucaaaguuuuuaacuucuuugccuuugguuuaaauuuccuccuguagcucagaguaguuugaucgucugaagccuucuucucucaacucgucaaagucauucucuauccagcuuuguuccguugcuggugaggaacuguguuccuuuggaggaggagaggcgcucugcuuuuuagaguuuccaguuuuaaugaaauccagcuuaucaauuaauuuuuucaugguucaugacuuugguguugucucuaaaagucauugccaagcccuaguucauguagauuuucuccuguauuauccucuaggaguuuuauaguuuugcauuuuacauuuaggucugugauucauuuugaguaaauuuucaugaaaagugugaggacuguaucuagauucauuuuuuuggcauguggauguccacuucuuccagcaccauuuauugauaagacugucuuuuauucauuguauugccuuugcuucuuugucaaagauuaguugauuauauuuaugugggucuauuugugggcucucuauucuguuucauugaucuaauuguauguucuuuuauaaaugcuacacuguuuugaauauuguagcuuuauaauaaguuuugaacucagauagugucaguccuccaacuuuguucuuucagaauuguguugacuauucugugucuuuugcuucucgauagaaacuuuagaaucaccuucuuguuuuccacaagaaaacuugcugggauuuugauugggauuguaaucuauagaucaaguuggaaggacugacaucuucacaguauugagucuuccuacccaugaacauggaauaucucuccauuuauuuaguucuuugauuucuuuuaucagagucuuuaguuuuccuuauauagauuguauacauauuuuguuagauuuauauguaauuauuuaauagagcauuuuuaugauacuauaaugguggauacaugucacuguaaauuuguuuuauccuagagugugaacucugauguaaauuagggacucagaugacaaugauguaucaauauagguucauugacuguaacaauguaccagugugguuggguauguuaauaauggaggaagccaugggugugugagggcagggagaacaugggacauuucuguacuuucugcucaguuuugcuaugaauguaaaaguauucuaagaaauaaauucuauuuuuaaaaaauguacaaaauauuguuuuugcauuauguaaaauuucuguucuccaaacauuuucuuauaagucucacuuaauuugaauauuagaguuuuucuuaagugagacuauuuaguaguuaauguugugguuuucagauacccugcugcucccguuuuuggucugaacuuuaaaaugugaauauaaauuaaauguguuuaaacaguuuuuuucuuuaugguuuccacuaauuuuuuaaaaauuuuaugaggaauucauuacauucccaucugcaacaguuuacuguuuauacuuauaguuauuuaugaugcuuaaauuucuaaauuaaguauugauucaguuaaaaaucaggugaggucucuaauacauguuucuuggauuuuauuaauaaaugcuuucuuagggaauauaaaucugccccucaguaacucauuuaacccugcaguaacuccuauaacucuagcugaaguguaggauuucuacaaaagaaugaggcacaaucuagauaggugauacagaggcuagaauagugugaguagcaaugugucuauaugauaccuuuaccuguaaggcaugcuaguuaaaauugugcuauuuuucauaguggugauuauacuagauggauugucuuucugcuguguccaugggaaucugauaaaugucuuuuucuccucccucaaaauacaugccuauuuaauugcuuaaaacaauucuaguuuuauuaauagacugauuucuucuaauaaauauaguuuaagaagaaggaacaaaucagauuuuguaucacaaagcaggacaacuuugguucaguuucaaacuuagguguacucauagacauaaguugagaugauaacuuguagaauuuguaucaaugaucuuauccuuuuaacauuuucugggagagucuguuuuauuaguuaccugcuguaguuacagucuguguugccugaggaaaguuuuguaaaucagaucucugucuaucauagauuucucauacaaaggucaauggcucuuguuugauuguccgguccaaagaugcauucucuauuauacaauuaguauaaaacacaauauuuucagucaguggaugcuauucaaagccucauaaugaugauaauuuaaaaucuuuguauauugaaggcaguuugaaauagugguuacuauacuuuggaucuagccugccuccaguuguauccuggcuuugcuguugauaagcucugugaucgugggcaguugguugaacuuugucuuagugccuugaucugauaaguagaaguaaugauaauaguacuugaugagguuguugugaggauuagguaugaguaguucaaguacucauaacaguucuuggcacaugguaaacauuauguaaacauuuguuguugcuauuauuuucaauggcacuaccuauguuuagaccuggugaccugggaccagaaguuucaaaugccuuuguucuaugacugaguuaacuguugcagaccuuugcugucagguuucucugucugguuucacaggcauuaguucuugucccuucucaugauucccauauauacuuauguuguaauugaaguccauaguaaaucaguauuaccaauguuucuauuuugcauuagucagcucuuuggaacuguauuaguucaauauauuggguaugcuuuaugaaaauauaugugcauuuuaaauaucauaugucacauaaagauaagaaauuuuuuuccauaaaccuuuauuugguaaauucauuuuuaucugaaaauuauaacaguguauuauucaguuucaggguauaaugccagagauauguuugaacugaaacauggaaauucuucccuuuacccuuuucucugcuuucgugaggaacaauugugguauuaaagaagcaacugacgauauuagaaaagcaauguggagucuuggcccugucacuaaucagacauaugauacuuggguaauucuagcccaaagaaagacuauaugauauuucauuuuucuuuaagcuuaaagauucaauauaucauaaauaauguuaaauuaauaagauucuucuuacuuggcuuauuaaauuguucucauuucuuuguaguacuuuauauugcaaaccaaacuucuaaaauauguaguuuauuuuccuuuaauuuguguauucucaaaauguuccagguaaauaguuuauuaugauagcacucucuucagagguauguaaaaaugucauccagaauaauauuuagagucuuugccauguccuagaaggcucuauuuuccuuuaauuuguauauuuuucuuuaauuuguauauucucaaauguuccagguaaauaguuuauuaugauagcacucucuucagagguauguaaaaaugucaucgagaauaauauuuagagucuuugccguguccuagaaggcucuccaucauugauucugcuucucuaucugaccucaucuccugccauucucccacuuccuccagucugaucucacugacuuccccauugcucugugaagaugccaagcauguucucaccugggacuucugaaugccucguuuaauuuaccuggaaugcucuucuucccaaauccacgaguuuacucucucccuucaguuagguuucaguucauaugucaccacguuagaguucuucuguaauccuccuaucuaaaauagcuccccacccccaucacucccuacuuuagguuucuuuauagaucuaaucucugacaauauuuauuuuacuuguuuauuguuugcuuucuccacuaacacauaagcuccauagaaacggggacuuuguucuguuuaguacugugucccuguugccucauagggauuucgauugcauauagcaggcacucaaaauuuuuguugaauuaagcaaaaaaauuauuauaauauuuucaguugcauaauuaccuuauggacuuuagagcaccuacuuuauuaaagcacuuuaaagcacuuaaacuuuuagauauauuuugaaaguggaucugaauuauaguccagucauaguauuccguuagccaccaggguagaagaaaucucaauacauaagaauauaaaaaagauagaauucaucugaucuaaaaauaaagaauguuugaucuaugagagaaaauacuuacagaucaucuagcauagaguucuuauuuuaaagaucagaaaacugagacaugguuauauuuguagaugugccagagaucacauggcuuguugguggcagagcccuaauuuugugucuguaauauacauguuaugauuuuaugcaauuuacauaugaauguguuacauuuucuaguaaauuuguuuuauuuuauuuacuugcaacuuugcuaucaucuguaaaagaauaugccauaauaguauuuucucauuuuuuuuuaaguuucacagcucuugcaugcuacuaggugaauauggaggauuaucuuugggaugcuuccgucuucuuuggaaaucuccauuuaggugucucaugguuaacagaauaaauauuugccaaagcagauuccuuauaauucuacuuaaaccugacacuuuugcuauauuaccuuuaauaauucauucugguugcuuaguuccagaacugugguugggaaggaguugucauauauuuuuuccucuccuugucaccuauaccccacauccagaaaguugccaaguccuguagacucgguucucuucugguagaucuugauuagcaggcauaacccucuaccagaugcuggccauugcagaaauuuugugacucugcauauaauuacagaaaccauccucuaagaaaucagucaaauucaucagauaauguugaauuuuguuagcgaauaacuaauaaaacuucauuuaaggaugaccaguaaggaggcagggaaaguauuuacauggcauuuaguagagugcuuuggacucuggguaugcccagugaaauaaauugcccagugaaauaaagugagguauuaaauauaauaccucacauuaagaacguguuuuuccucuugcuacaguuuuuauuugcucaguaacaaaaaaagaacacucucucuuuuuuguuguuuuuaaggcuuuaaaugagcuguuuaaaaagucaucugugugcagauugagaaauugaauaauuagcugccuuucaacgcuucauaagcucuuuuagcccaucagguuaaaaaggggguggaaagaguuaauacagucuuaaagaggccuaauuuacaacuaaggaguaccugagagcucuuggagaauuugacacaaugaguuagaucaaccccauuuucauuucccucuagcugcaguuuguaacauaaauaaauccauggucuauaauuguuaaauggaaguauuugaaugccuccuaguggcauauuguaggcucuaauuaaggaauuuaaaaaguaauacuuauugaaggaauacuaucauaaccuauuaaagcuuguaaguacaagguaguaaaauccuuuaaugauaacauccuaagugaaaucaaaauacauuauuugccauacaaaacugauuaaaaacaugacuggaaaaaauauaauacauauggcaaagaugcauauacuuugaauaaaaauuuuugguuuugguucaaaucgaguuauuuuaauuuacuuuauguaauggaucuauuuugcacuuaaacauagacaaauguggcuaauaauaggauuuggauagcuuuguguacauucauuuuuuuaaauuaauugugcuuaucacuuaguuucuuuaaauaucuuuguauaauaauagagaaaacgguuuauagaaagucugguucauuuucagauuuuuuuuuaauucugaucuucaaguugaauaaaauaauuuaaucgguaaccuugaaauacagacuauagcaaaacuuuaaaaugauuaagaaugcugauuuaauuauugcuuuaugcauaaaaaugacuuuacaucuacagaaauauaauuuaaaauggaaagaaagucacauuaaaagaauucugaugagggucagaagaugggagaaaaaagugauauccuuuuguuaaguacuaaaaaauguuuaauuaacugcuuaccaaaacaaaacaauuaaaauggcaauuaccuuuaaaauagcaacaguguaauuacagcuguugugauauaaagcuaggaaacaaaauguuaaucuggaaugaacaguuuaaauaugaaauuaugauauacuuggcuuccuguaguacagcugucaagcuugggcaguuugcuggucaauagugacauucuaugugucagugaacagagucucuugauaccguaacccgcaguucacacauuacugaagcuccaacugucgaacauucaaguccccugauauuauugcagcuuccagacucuccuaacuggcucauguuucauucuuuggcaauuugcccuaaugauaucccucaggagcuuucagccucucuuccuuuccauauuuaaucaucuuauauuaaucugagugauacacaaacuaugcuguacaaauuguaauuuccuacaauuuuucuaagaugcacaccuaauuuuucaguuuuacuuuuacuuauguucuaaguuuucaaucccaaacucgguauuuucagaugauuauaacuaucuacaugauucccaagaagcuucuuuugcuguuuauauauguuucagaggggccucugagauguaagacuuuuuacauguagaagugauaaagacaaugugauuuauguaguuauguaaauuguucugugauuacuguucauuguugauacauugaacauugcuuuuuguuuggaaggucagcagcuacuuauuuuuguuauccuuuuacaaauuucaguuaacugccuguauccauggaucagcugcucuucuauacccaauguauuggcaacacauauacaucccagugcuuccuccacaccugcuggacuacugcugguaagcuggcuuuugccagacuccuuuaaguuuagguuucaugauuagauuaucuguuuauuugugaacuagguaaacuugggggcauauuuaaaagaaaucacagaaacuuacauuuuaauaaauaguaaagauggcuuuuaugaaggacagaauaauucuguacaaagguagcgcaaguuuauaccuagcaaacauaaaguucuuuagauuuugugaauuucuucugcagucauuuagauaacucaaugcaaaauagaaaaaaauaacagucuuaaguuguguuaggaaaacuguauagaaguuauggugucaguuagagaacccaguaucccaggugucagaauuugucuggcaaaucugccagcaaccacauugucucugucagggcauacucuuguuaccuuuacuucagaauacacuucuuuaccccucuuuuuucaauaauagcacaccaaauaccaaguacugauaaagggguugucucuaauacaagaauucuuguuuuuuguuuaagucaaagucucagccuugauccaccaugaaaagcaauguugaaaaguauugggaguaguucugaaaaguuuccuggcauuagacacaauuccuaaaggaucccaauaaccaggccucuagacccuccuuguucucuucaccuggaagagucugcauauuuaucaugagucuaaacaaggauuagacuucuaaauagcagcuucugggccuucuucaagacuagggggggaaauguuaucuucauugcauaaucaucuucugcagguauagccuaauucuuaagaaaugugaugggauuuuuccucuaaaucauugugcacacacauagaaggaaacaauuuugaccuuaauguguuugcuuauuucacagcuaauguuacuaaaacacagcacuuuuagaaucaaugcacucauuuaacuuucuuauuucauaaaaggcagaaaguauuaaggauuaaaaaugauuuaaguucauacacagaggguuucuauuaacuuuuuaugacugagccucuucagaacaagugauuguagugacaacacauguacuuggccacauauugauuacguuaauauauugguguguuuccacagcaugguaauauuauuaguauugauaaugcugugaaguaggugcccagugaccuaccauugcuauuaugcuguuugagaacuagaaaggagaaacuguuuggcaggaaacuauaggaauguaguuuauauuguuaagugucacacacacaagucuaagaauaaaauaaauaggcccuuuguuauucauuuuagaguuuuccuuuaaccaacauaccuauaauauuuuagcauuccuuaaagggagggucucauuuauuuauguugacauaugcaguagaucuuuguauauacuguucaguaauuaaacuuuauuuauuuaaaaauauauuuuacagcaguauuuggaaauauauugauauaugauuuuacauaauauaucuuuagaauuacguuuuauauaugauguuagugccaucuuaauuuuucuauuaaaauguucuaaccucuuaagagauaacacaccuuuaauuaaguucaauuaucuguaaugaauuacacauuuaagacuuucuaaaauguuauuuagaaauuauuauaugacacaggcaguucuguacuaauuuuuuuccagaucuuuucuaaucguuucuaccccugccauaaaauucaaugaaguaagcuuguuucauauuucagucccuggaauuuucuuucuagugucuaaugucugaaauagccuuuggguugaguucuaagagcuugcaugccaaaaaccucccugguucaaagaguaagucagugauauucaaacaagaaguuaucugaaacuuccugaaccuuaaggucacaaugauaggcucagcuucuaucauaggaacggaguaauauaauauaauuauuuuuuuaaagaauagccaucagaaaacuugguaaacuaaacuguuuccuaggguaaacaguuuucuuccauuuccauccuugagguuaaaaaaucauacugaucuacauguaaaagggaaaaaaauuacagaucaucccuucaaucucauaguuuugauuaaauacuuuuuaugaauauuccaguucaaaaauagugucaugaagauuugauaggaaaagauauaucuuugcuaacucuuuggcacgauuggaacuuucugaauccugagguaauccuaccuccauaaaguauuucuguuuuugcaacugguagcucugguguggguuggacuguggagagccguaaugccaucuugugaccauggauggauaucgcaucuugguccaccaauaaagccuugcuacuuuguugauucauucauccauucacuuguucauuaaacacuuagugaccaucuauuaauauuugccaagcugugaguguguaauguaaugaauaagauuuaguuuaugccauugcaagauucacagauagcaagaaauacacacauacuuacaugugcacacaugcacacacacagcacaguguaauacugcaauacuauaaguauuacagaauaggcauacaaaggaccauggauggcaacacauaagaagaaguggccuacagucccugguagcuuagggaaggugccugggaggaaaugacaccaucugcauuuuccccuaaucagccaauguaagaguacuuuaauguggcaagucuaugauguugcaagacagucuuaaccuaucuaaguccauaaacacauggcagguagugugacuguaggacuaguaaaauuguaauuaucuaucauuuguucaugaaugguugagucacuauuuaggcuauaugacucuucuuuuuaugaaaggagcagauuuagcuucugagagaauagguauuuuuuuucuuuaaaaaaauggaaaauuguauucuuuagacuaccccaauagacugcuguuauagucugugucaugaguggucucuuuguaugaaaaccuaaaaagaaaaaaaaagcuauucuuaaguacaggugaauugcuaccaaaaagaagcagcaaucauauggaggcuucuguauccuaucuuugcaaaauaacuucauugaaagaaagauuuaggacaguuuuucacauagaggacaaaacaucuguguugccaagaaucucuucuuggcuuguuaaugcccuuaucuaauuaggaaauuuaaggcuagguuugcaaaguuacuuuucaugagauuugggugauuucauauuaggauuacacaauccaguuuuugugagaaagaaacaacuauucacucuauauucugcaaaauguaauuauuuuaggaaauuagucucuagguuaauaauguuuacaguucuaacaucuguguuuuagauuuugugagaaauuggugagaagagaacauguggagauaacaagugaucccauuuuaaaaguuucaaguuauuauaugauuaaauuuugcauacaagcuuuuuaaugaauauuuuuaugucagcuuaacaauuuuuaucaauguguuuuuuauacuucugaagauaaguauaucuuccauaaaguuuaaaauguuuuugccugggcgaaagagcgagacuccgucucaaaaaaaaaaaaaaaaaguuuuccuagauguauucaguagguuauuuagcagucuguuucugauuuuaagaaaaucugacccacccauuuaucccaccaacauuuguaaaauggacuuaguaauuauuguuuuuagaaggcuuaccuauuuuaaaacucuuucauuaaaauguacuuugaaauuucagacagcaugggcuuuucuguauuauaaaucuugugaauagaauaaacuaaccugagguuaauuggaaguuuacacagugacuuuaauaauuuuaugcuauuuugaacauaggcagggcuugagauauuuaagauuauggccuaacuucauuuuguuaaagguaucaaaaccuuguuguggaagccuagauuuguuagugauaugcauuuuaugucuucuucucuggagaccuagaaggaauacagggaugagaacuugaauuagggaaguaguggaacaguacacauuuguuccuccuguuuccuuuugaagguagaaaaucuguuaggucuuaaggauaucaaggccuauaaacaguuuucaacuuucagccaagugaaguauccagaauaucagaucaauuccagauggucucuugcauucaaauuaaaaaaaaaauaggaaggaacaaagcuacaaagggcaaagacaacugggaauuagaaucuaguacaauaagaaguaaugaacuagaauguacaggcuaacgaggaguaaaauaagaacuuuaacacuuauuuuguaaauucuggauauauagauuggugguuagccaucuuuaaauaaauuuggaacuuuuuaagguuacuuugaaaucucugggucugucaggguggcuguguaaucuauugcugguucucaguagcaaagugaacacacagaaauuuggacagcucuguucuaauaaugacaaugauguuuagaaaauuaugcaaaucuuuugagaaagaggauuaucuguuugcauuaacagaaaaagagugucauaauagagcacaaagaugccuauaaaagaauugccaaaaauguuuuauuuuaaaauagcuauuuauucauauaucugcuauugacuucguagauaucugucaauucucauguuuuucuguuagauaauauuuuagguuugaaaugucaaguugaauaauuuucuucuuguauuucgugagaaguauuucugaaauaaccagcaauucuuauucuguguauuaaaaauuuaacaucuauauuuuuugcaagaguauaaaauccauagggaauauauucaguuuauauugucuauuauuguucccaaguuucuacccuaaggccuggcaccugcuaugcuccaaauaucauguguugaauuaauuaauucaagauuauucucacacuugaguauuuuuaaauuuauuaaaauuauuaauaaaagugaaaguuggauaaaucugaauuuauaaaauuagguaaauaaaagacaauguacaugaggggaaagauagcacaguaggugaggaaguuguuuccuuuuguacauccaguuccagaacagugucugacaaacaauaagucuugauagauauuugcagacugacccucugauccaaauauuuggugacauaggagguauguaucaaugaauauauauauuaagaauaucauagaaauaagaauuuaauugaauaggaaaagaugugcaaaacggauguuaauaaauuugaugauuauuuaagauauauuugcuaugagguauacggaaaagauucaauucagacuauggccuagaccuggauauucuucuuaagguaaaaacaaaccaacaaacaaacuuuuuaggcauuauaacucuugauuaaauuauaaaugauuuuaugauguuuauaaaaagcaaucuuaauuuuaaauauauuaauggccucuaagauuaaauuugagcuuuauauauugaauaauuuugaauaucuauaauguguuaugcuggaacugagcauuuaauacauuuaauuuuuaaucauuuugaauuacuuauacuguuguuucaguuuuaaugaacuauaugaaucuaugcauauauauauuuuuaauuuagugccccaaugccauaccugauuggaauacacuccagccucauagaggugaguaucuuucagacaugagacagugauaaaauuaacucauaaaauaauaguuaaaacaguuuuguuuugaagaaauaucagugguauaggacaaagaagugacuaguuucauauuuagaguaugcuuaucauuuuuaaaaagacaacauugaaauaauuacauuuaaauuaacauacuaaaugaccauuuuuuauggcaugaaauccauaaaaauagguuauguuugguagaaaucauaugguaaguuuuaaauacuaaaacuucaguccuugaucaguugccuuuuuuuauggcaacuugagaucauuuauaucucuuuuucagaccuauauuuugaaagucacaauuuauguacuuaugagucaugaaguaaaauuuuuuauuuugcagacuucauuauguucccauuuaucaguguguacauuuuaaaugugguuuuaauauacuaaucaugaacuuuagaauauagccuuaaguuuuaauuuucaguucuguuggggaauauaaaauuuaguaauuuuuuuccacaauuaccacaucauuuuaaaauuauuuuugucacuuaaguuauuccuauagugaaagaucuugaacuauuaacaccaugaacuugaaauuagugagauuuccaggaaggucuugguauaggaucagcaucuaauaaaauaagcaaaaggcuuuaauuaaaacaaagucuugggucaauugaguggugucauuaugcuagaugcuaucaguuuuauucagauaaauuugucuuuuuuugcugguuguacagauuguacuuuaacccaguuucuaauaagcaaccuaaaugaguuagcuuugguuuuccucuugccaucacuguauacccuccaucaguccuuacuuugaucaaagaugagucuguugauauauuuuaaaacuccugaggaucauauugggaaagagucacgccccuuuaggagguccagguuguggauuccgaccgguacucuagguuccggcauuuuuucuuaucacaaaaugcuagggcaacauuuuuuauuuguuucaacaauaacaaaaaaaacauauuuaaauaaauaucuuuaguagguuuguuuguaauauugaagucugaguuggauaccuuuaugacuccuuauuuuuuauucauuucuagaaaacuuauucuuacaugccaagguacuuucagugaaaggauaaauuacauaaaauaaaauaugaaugaguagguacuuaauuuguuauuagauuguggaauauaugacuagcauuuaauguaucaguaauuugacuucauuuaaaaucuaaccuugguuggauucucuucuaaaaagucaucaaauuugauuuuuauauuaguguacuugucgcuucuuaaugaaucuaauaggauacauaauuuuuauaacauguuuauuuauuuauagagaugaaaaauauuuaaaguuguugguuaccuguugauguuaauuuuuuuuuugcauaaugauucuacaucaacuuuuaaagcaaaugauucagcguuuccaaaauacuguauaaaaggguauauauuuuaaacauucaauuuaauuuaucauauauucuuggauaccuauaaauaaaaccaauacuguuuuuaaguagcaaauuuaagaauuauuugcuccuuaaaaaguguugucuuagagaauaauccauucuaacuuuaaauuggcucuuauuauuaaaugagaauauuugaagccauuauuagacugguugaaaucucuguauuuuucauacucuggacuuaucuaagugucuuaauagucagccuuauuuuauuuaauugguuuauuagugaaugagaagcuauacuggggacuucaggaauucuuuuaaaacaauuggauaucauucagcaacuuucuuguuaaucuauuacaagaugauguaaauccugcaaauuucauucuuguuaugccacuauuaggcggauuuuuucacuaaaauuucuagcuuuuaugcuuuuuaauuuuaccaaaauggucucauaauuaaaauauugauacagcuauuuacauauuuaguauguaagacugaacugaguaaauguuugcauuuugccuggcaauuacaaccaauuuuuucuuuaaggaauaauuaaaauauuuucuuauucccucucucuuggucaagagaguuucaacacauuuuauuguguuauuagguuggugcaaaaucaauugcgguuuuugcuauuuuuuuuuuuaauggcgaaaacugcaguuaauuuugcaccaaccuaauguaacaacuucuaaauguaguuguucaaagucaugaaauucauaucccuuaacaucuuucuuucaguuguuuuaaugaaauuaugaguaaaggauggccagaucuuuuuaaaauacaaauuuccuucuaaaauaaaggcuaaagacauuuuguucugccugaaaacuagacuuuggggaugaacucaaggcagacuaaagccugcaggucauuaggaauaaauuaguaaaggcuacaaaugugaggauuaucuuguuuguuuuaauauacaauggauucuaaauaaaauguugacccagguuuauaagaucaugugauugcugccacuaugucauuucuuuguauuaaugugcaaaaguaccuuuguagccauauuguauggaaaaguuaaacauagagggugugagaaagacuucacuaacuucaccaccuuacaguuguucuuaauaagcauuucagucuaugucuaauauuauuuucuuauuuuugaagaaaaagauaauuuuuuaaauuuucuuaauuuuguaucucauaacuuuaugagauguaacagugagacacagaaggagguaccauuuuauauaccacaugacuuccaaugccuauuuagaaaaaaaaaauagcugaagucuaauuuggagggaaaaaauagaugaaauagugauacuaauccaaauuuaaaaaaauuuguuacacucuauuuuuuccuuuuuuguuaauguauuaauagaauuauuuucauauuagggaaucucaguuuauuaauuugaaaugaauauauuuuucuauucuuuuucgaguggucccuuaaauaaaauuuaauauucagcaauuaccagauuuuuaaaacuaagagcaguuuugaaaaaauuguacaugucauaguaguaccaauuuccuuguucugaguugagugauaauguccucacgaaacacuuugggggcacauagcuuuaucuuaggcuauuuacagacuaacucauuuuaucccuuaacaaauacaucagguuuauuagauuaucuuuauaguuucugucauaaaaugacaacuuaaaguugaagaugaaaaucaaaauuaugacauguuuuuucacacaaaugcaauuaacauaauuuauauuuuuacuuauaaaauagguuacuguaguuauacuauaguuacuuuauagguaacuacacauauauguauuuaaagcuuuuugcauauaugugaaaagaaaaggaaauaaguguauuuguaaauauuuuugcaguaguaucacuauaagugauucgcugcuaauaucuuagaaauggccaucuuuuaagucuuuauaauaaagaagacagauuuuuagaaucaucuguccucacuguagacauuaugccuuucuuaacauguggaaauucucugcuuuagacuaccauugcuuuagaaaguuuaacauucuaauaugcagagauuugaaauuguaaaugaaucagagaaauuuuaauuaugaccaacuuagaauaaccaguuuggccaauuuaaaauauaagguaauaauaagauuuuaagugacaguuuucaaaaaugacuauuauuguagaccaccacuuaaaaaauacuacacucaaauuauuaaccuauugcuaguugacuuauacaauuaugaaauucagaguucaugaauguauuuaauuaaugagcacuuauuaaggaauaauacuauuuguuacaaauuaaauaagacuaauaaaauuauaugaauuaaguauaccuauuaguuuaaguaggaaaaaugaaccauaaguauuuucuuuaaggaugaaaacuaugauaaaauucuuauuuacuauuauuuguagacauauugagauaauuugacuauuuugauuaaacuuucaaacaaaugggacaagucaagauagucugauaggcuauuaaauuugguaccuucuguugaaauucaugugagaaauauuacuaacaauaaauuccauauugcuauccuuuuauucucucuuauucagcuuucaguccucaucaccaacauauaccuuuuuguauagaauauagacaaaaaauuuaaauuauaguuuaaugcuguagucauaguuauugguuuauguuauccuugcaauaugcuuuaugcuaaacauagguauagagcuggccaugaauucuuguuucaugggacugaacuuaaauggguaaauuuuaaagaauauaauuuguuuacaguuugauauaacugugccuauuuuauaagaauuuuuguuguaguuauguuuaauauaagaugaggaaauauucaauuuuaagcauuuuuacuaaaucuuuucguaugaguuguagucagacuuucucaggaggcaaaguuguuucuauccuuucauaauauaggauuuuccuuuuuucuuuucccaagccuaaugcauuaagauaauguuuucuguuuccaaacucaucauaacuuuguaaaguaaauauacugauuuguauucauaauuguguuuuuuuuauagagagugaaaaacaaaucauuggaagauguuguuauguuaaauguugauacaaacacauuagaaucaccauuuagugacuugaacaaccuaccaagugaugugguaaguaugaaggcuauucaguggugaacauauauguuuucuccuggaccucugaauuacuaaguuauuuuucccacuuuuaauaucugaaauaaaaggguuggguauuugcauggggugugagagaaaucaauguugauucuauauuuaauauuuuuaccuuuuagcaguugagauuuugaauggaacaucauauuccuuauuguaaaaguaagaucauaauuaaaaagcuagaugcauucauuaggcagaguuucuuuaaaccuaagucucuucaucucaucuuaaucauuauauuacaaaguaggcauuucugucugccuaguggcaugucuugcaaaagaaugagagaguuuuugaaggcaagaagaagaagggggccaauuaucggcuuuugcuucccugccaccugccagcgcuuuuccuuuuaauuaaugaucugauguuacuggucaauauaauaagaaaugcuuguacaguuggggucagaaaauucuggcuuugaucucccucaacuuucugaaacauuuauuuguuuucucuaaauuauuucaguuuuauuuuaaucuuuucuauccugcugagggcugcaagaaugaaaaccuacacuguuugucauuugcuuuggcagagcaaagacugcuuacuuagaauucuauuuguaaauuaaacugcaaacccaguuugucauaaaagacaucugauccuuuugaaaugacgaaaacugucuuuugucuguaaaggcugauaaauuaagugccaguucucuucuggucuuugaucuugcggaggguugugugugugugugcgugugucugcagcuuauaaugggacauauucuguaugucacguuaaauagucuccaaaagugcauuauuuuuggccuucauauuccuuaguacaggacaaaaaugcaaacuaguacuguuucuguauauauuuuaauggcuacuuaaaaauaucuuuauaacauaguucuaaguuaaaauaacuuccuuuuuaaaaaaacaaagcauuuauucuuuauauggauauuaaaauuugggaauaaaaaugccuucagagcauauuuuucuguaauauugaacuacuuugaaauccauuauuaaggaguuugagaaagugaauuuaaaaauccuaaacucaaaaauacacuaauaccagccuugauuguccuucugucuaaugauaggaaaaauaugauuuuaaagucaaaaucagauuauuuaugcccauaauaccguaaaauacuugcugaccuugagacauauuaaaauucaacuaccuuaucuuacuguaguaaaacuuaugcuaugaauguacaaaucuaauccuaggccagugaaaaauuacaucuuuuuagcucauuauaacuagauuaccucauuauaaaauuuuugcaaaaacaaaaucacaaagaaauuauuagaguuacucauuuaaaaacuaaucaaaguauuauucaauggauagagaaauaauuaugaaaauagaaucccaacuuuuaagaaugcuuuccuuauaugcauguacuuccuaccguuaaugccuuagggagaaagauuguuaaaaagagaaagaagaaaaaaaagagaaagaaauucagcuuuucuguacgugauauuaaaauuuuuauaggcagcuucaaucaaugauagaugauucuugaaaaaauaaucuuugaaauuuuauuuuuuugaugggugauucuuuuuuaaauugaaaaguacuacuuuccuaguagaauuaguuugaugauuagaacauuuauuuaaauauauggagaaguuaaauaauauuucacacauguaaguauuuaaauauauggagaaguaaauaauauucacacauguaaaggccugaauauauaaaaugacagaagagacuaucuuguuauuuacucauaaaugacaauauaaacauaacugaaauauuuaaaaauauagauaaaaauuauacugaaaggugguguagauugauuaacuaaauauaugcuugaaauucagggacacagacuuauaaagaaauuuaaagaauagacaaauaaaaauaguucugagauggagcuaggaccauuuacugaaagugugagaugguuuaaaguuauaguaauuuucuaaaaauuuuuugggugauuuuuagaacccauuucuaauaaauauagcuuuuucaucaguuuucuaaaguuaucucuuacaauuuugguggaaauaggaugaagcaucacaucauauuuuagaagcuccccugccccacuagacagaacaggacaauuguaaaugucuuaaaugaguuguguuaaaaucacaaaugaucuuacuaaaauuuuuugugugugauuuaaauugauaaaauauacuugaaaccugaaaaauguuacuauuaguauuguuugauuguuuaauagguuaacugagauuuaauugggggggguccuuuuaaaauccuucaccaaagcauuuaaauuauacuuacaggcugguugacuuucuaugcauguguacucuauuauugugucagauugaccaguggucuuggcuguucaaaggucaguggucacaguuguccugaauuacuaguucuuuuuuccuguggacccucugcuguguugcaugcuguaaucuucuuaauggcuucauuccaauauucacacauaauauuuuagauuuauugacuguuagaaauacuaccaugccaguagcaguuccgcuacucuuaagguauuuaaaauuggaaaaauaaaucagggcaaagcuuucaggauuccuuuguuuucguuaagggagggggaaaaccucuuuuccugucuucugacaagaacacuuguuuuuugauuucaucauuucacuauagauuuggaucauuaaaagaaaaaaaaacauauuuuauugggagugauuuuaaugauauugauuauuacauggaauaacuuuuaaaggcaguagauccaauaaaauauacucuuguaguuuuugucuauuaauauauugugacuuuauuuuuuaguggcugugccaaauagacaccuucaaacaucuguaguauaguuugaauguuuugaaauaaaaaaaaguaaauguuaggacucaguuacagcaucaaucacaguuaguguuauuguaguauguuuauaagggugagaaaaagaaccaauugaauuaaauauaacauuugaaaucucaaaugacuugauuuuaauuuaugaaaaugcaguauuaaaaccuccuauuccaaaucuauauagaauuuaguuuuaauugcauaauaauuuaaaauauauuucugagauauuccugcucauuuuaauuuuuaucauuaacguuuuaaaaaagcaauuuggagguuguuacuauuucaaauauaaauagaauuacucucuuacuaggaauuaagcuaauaauuagaauuauaauauuuaggaauucucucauaugaauauuaaacaauuguaaauuccuauagaugaaagcacauuagaauugacaucugaaaagguuacauguauuagaauauucauuacaacaggcaaguuuuuuuuuaccuguauugcuuaacggucucuaauaauuuaaacuuauuagauuguaagaauaguaauaauauugauaggucaauaugcuauuccuauuuuagauaagaaaaucaaggcacagaaaguauacuguuaaugguauaucuauagauucaguucauagagguugauccucaggccugugcccgaaacaguagaccauggucccuuucauauaaaugugauauacaauguaaugaauaacucauuuaaaauauauuauagaagcuuacuugccacuuaaacuuguuaaagaaauaucaguuugauccauuugauuuaaauuaggauuuucagcacuauuuuuaaaacuucauuuucaucuuaaauauaauacuauuggaaaaugauuuucuguuuucuacuaugaggguguauagaaaauaugguacacuuaagaguuauuguacaagucacuguagaccacuguauguuacaggauagcuauauuuuguaugaagcauauuuaauuacuaaaacguugaaaagaccuuauuauaaugaugcuaucuaaaauaucauacauauuauggugaagcuuucaggaaucauaagaaggagugcauuaagugguuuuauugugauaaaaaaaggaaagacacaaauugcucugaaucaccaaaaaucauuaagagcauguaagaacuggagaaaaccucuaaaauucugauaucaaauauuugaauaucuacauucaagugaauuuauuaauuuggggauaaguuugagagaauuaguuuuuucagggaauucuaaaauaaacuuuucaaaaaauauuaaguuauguaagcaaauuaaacucuuagaaccacacagauugucaauggauauguuuaauucauugaauauuuccuguaaucuaacaugaagguuuaacauguuaaauugucauaauauauguuauaaagaaaaaaaagggccccagagaauauuauauuaguuccagguuugccacaguucugcuguaaucuuuauuguguuuaaugguaaaugaagucccuaacaaauuucuaggguggucagguuagaaagauucauucagcuucuagaguaacuuggagaacauuuuauuacuucaggagacaaauauugcuuucaguuugcccuuggaaaaguauagucaugcuuuuucuccucucagucuucaauuguuagaacucaggcaucuagguguaccuugccuccaccacacagccuugguacugugcuuuguaaauaggcauucaauaagugauugcugaaaggaaauauaauuacacuucuuuuaucuuuuguaauagaaacuugcuuuuaaagucuguuuacaguuaccuccuagaacauuuuauaaggauauuuccauuugacuuuaauaagaauaaugaaaaugagaaaccuggacguauauauaaaguauacuuuuugacuaugagcauaaccuuuuauuuccuguauuuagaaaaagagaccauguugugauggcaaucauugugcuucugcauacccagcugaaugucuguggaaacucagcuauucuuuuaaauaguuauuaucagagauauaauuauuuacaaaguaguuuuuuuguuuguagguaaacuauuauagauuuugcuguucucccaacuguuuucuugguguauauuuugaaaauauaaaccuuaaauguuagaacaaagaaaacaaaagcaaaacccgaaaaccuuaacugugcuuguaaacauuuaaaauauuuuuguuaguuucucucaauugaguaagagaaccuggcuuucccacagcaaugauccaggcuuugguaauaccccccuuuaugucucuguacuucugccauucuaaaguugauuuauuguuuguuacuuuuagugauuuuaagugcucaaugaaguuccuuggcuuucucauggcuuuucauuuccaacuaaauuaccuagccuuucuuuuaaugucuuccucccaugcuucuuucucuuguuacugcagauauuuuuuuuuucuaaaaaagguaaaccuugauuuuggcuguuaaaauuauuugcaauuuauuucugguccuuuaaauucuugauuuuuccauauccaagcaacuuuuuguguguaauauugugagcacugucacaauagcaguucccaaaccuugccgauaucauaaugaccuggugaccuuuuaaaugaauuauguuucugagcaccaucacagauacuuugauugagucaacuggaggaauaaauguagaauugugcauggaacagauuguuagauuuguucauuuauucauucaacagguauuuaucaaguaucuacuauguacacgcauugugcuaagaacuggguauauaguggugaacaagcaaacauauacccugauuucauagaguuuaugguguguuaacacucaucuaguauuacaaauagagacaaauguuauaaaagaacagggugcaguuggagagaauuacagugguauccuaauuuagauuaagggugagauagguagaggcuggaccuguuguagcucaguggcacgggaaaaaaaccaugugugucucuguggugcagcaaggcauuaucuuaugugguagugcauaaauucucgggggcucaaguguucuucuccagcuuaauaguaaagguugcaagccugagguuucauuuuucuuaugacguggcaggaaccugaugcugugccaguugcacugaggaugggauuucaggugcaccaguaugagaaaguauggaagcaguuaggagcuuggucuauauucuuauuucauaucucucauauauccuuuauacuguuuguuuauuauccuuuauacuguuuauuauccuuuauacuguuugguauauuuauuaggguacaagcuaagcugcuauaacagaaauaccugaauacucauucuuagaucaaaauagaaauguauuucucuauuguauaacaauuaagagguaaguuuuccaaagauguggaacaacucugccauccucaauacauagcauccaacucuagguuuaagguaugcucuuugucuaccuugccguagaguaaagaggagaauccacagagggguauucauaucccuuuuagggacagccugaaaaugucauguuccucaacucacauuccguuugucugaacccagccauacggauacagcaaguuccaagggauguuggaaacuagcugaguuaaccuaguuuuguuaaauaugcaccaguccaaacuuaagauuuccauuagcaaagaaagggagaauagauguugguggacuuaaagccaucucugcuguaaguaaacugauaagaaaauaauuuuagccaaacugagaugccauuuuuacuaguccgcacucucagaucagccuuuugugguccagccaagcucaguguaucaggaacaucuuucugcagaauuggccucaaugaugaugaguaugaguaagccagaugggaggaggaagaagagggagaggagagauaacauauauaaagguuuuccuguggggaagagguugguuaauucaagaccuauauagcuguagugaaauaaacaaaagaauuaugcaaaaugagauaguagagauaggcaggggcgaucauaaaagauguguaguucuuguuaaagaccuuuggauuuuauuggaaauucauuguauacuuguagaugaugccauauucguuaggauuugacagguacuuuaaacauacaaugaaacaauguaaugauaugcucuguagguaaguauaucauaugcuuuucauuuaauaaauguuaaagguuacuguuuuaaucuucgaauagagacuuguuagaaaauuauuaagagagaaguguuaauuuugcuucuuaauaaacugaacuuuagaaagguuaaaaaaguguagggauuuaauaucuaauucaugugauaacuauaacaugauucaagggagaauaaaaguuuucaacuuuauaacuuuguucuacagaugauuauuugacacuuuaacuuuucuaaauguauguaguuuuuagagagcaguuuaguuauaugaaaggaaauauuuaaaaauaucuuaggaguguuuuagguuguguagauuaucuaaauauuauuuuggaacacuuauuuuuaucuucucuucuuuacccugaugcuucucuuugugaucauuaaaaguaaaauaaaaauuucuagguauagcaguuaauauauuuuuacugcaaaagcauaucuagaaaucacaucuaaaaguuaaguaaaagaaaaaaucuguuacuucucagaaaaacucaacccccuuuuaugcucugccuuccuggcuuacuguccuuugguauaauuacuucauuacuuagacugagugcacauggcuugcacucuuuuaacauguaccuauuugcuguguuuacuuauguaauucuguccuuuuauucauagucacuuuagugcuaagaggguaaaaguggggaauuggugguaauauuauucaugcugcagugaauucccagcgugcuaaaauccagguuauaauucuucccauggauggcugcuuggaggucugaauucucacugaaaggaauuuaaaacauuugauaagagcaaugaaaugaugcuuauuucugaauuuucuuuucauuguuuaacuuuucguuugugaucuauccuaauacuaaauuagacuaaaaaauguauuuacagaguguaaaaucucuaaagacaauacaauaaaauguccuuugugaaguaauucuuagccauuggagguugaggcuagcuugcuuucuuaagaauaaaaagagaaaacaauugauacuuuuucaguauuaauaggauuaugugauaauagccauaugacuaaggcuccaaaugcuuuucugaauucagaguuaugugugaguauaagccuuaggauuucaugggaagagauauauuuauuucauaacuaaaguuagaaguuuggaaauuaaagcagaaaaugcucuuuccuagaccagguauuaaaaaguacaggacagaccccaucauuuuuauagauaaaaacugcuaaaagcuaauuagcacugcaaagggcauugguaacuggugauaauuuacuccagugauguaaagaccagaaacacagccagguugaugcaaugauuuuauauuauauuaauauccuuauaucuaaaacugauuuuuaaaaaacaauuguuuucuuacagacuauuuuugagcauucauuugcccauguagaaacacuuagcugcccuucuggucucugaaaaacaggaacaacuucagauguacugacaauugaagcccacuagaguaggucaaggaaaaauuauuuuuauguaauuuguaaaaguugaaauaauguagaaagaggcaaaggagaaauauaacuauauuucuugccaggcaauuuuaguuuaaaaucuguaugaaauuagauaguauacucauguagaauaacauuguccaaaauaaaaugugagccacauguaugauuguguuuucuuguagccacauuaaaucauaaaagaaauaggugaaauuaauguuaacgauauauuuuauuuaacccuauaccuaaauauuauugcuuccaaauauaaucaauaugaacauuauugaguuuuuuuuguacugagucuucuaaauacagugucuguuuacucuuacggcaaaucucaguugagacaagucaaauaucaaguguguauaugacugauagcuaccuuauuggccagcauaguucuagaacagguacauucuuuuccuauuuucuacacauccacagggaucucaggagcuaucauugacuaguuuuggaagugaaggcugcauauuuaugauuugguuuggaauggcuuguggcauuguguuuaauacucccuuauaacucaggcaacaauuaugcagucaaggaucugguauaauaaaggcugaggaauggcuugacuugccuguauucuuagugagcauauguguugugauuguccagagaacauuguguucuugauuuguggagaacugaguugugaauuucauguuuuauuuuuaaaaauacacauuaaggaauuuucuuuugcagagauguaaggugcauuuuaauuuuuuuuuauuuucuaaaguaaaaaucuuuuaaaaaaacuauuuauauauaauaauacuuuaaaaagacuggaaucauauuccuuacaucguaaucuuuuuuggggguggagguaguaauuaaauacguauauugauaugcacucccauugcuauugaaggcauuugaaacuuaaaaguagcauuagaaguuucagaauaaaggacauuaauuuagauuuauuuuuguaauuauuauuguuugaauauguggguuaccaaaaaauaugcauuuauugagauuagauuuuaauaauaaaaaucccucuuaaaugaauccugauuuaugcacuuugugggcuaaaugaauuaggcucucaauuuuuaucugaaucuauggagcuuggauauaaauugaaaagaucacagcuauggggagaagaccuacacugcaaaggccuuucugcauagauuaugaacauaacucaauaauuuuuucgaaacugugguuauaauuggacccaaugggggucuguuucuuugaucagaucacaguaacugugacuuuacacuggaaaaugucacuauugugaaguuuuaucaccuguagagcuggucuuuccucugaugcuguguucauuucucauuagcauuauucaaaguuuaguuguuaauuagguugacaguucaauuacaaucauauacaagcaaagucagggcuacuugcauaaagaaauaaaaauaacccuucuugcauagauauaugugugcauguguauuuguguauaugugugcauguguuguguguguguauaugugugcauguguauguauguguguauauguuugcauauauauguaugcacauauauaccuaaaaaggagaaaugacuauuuuguuauaugauaguuucauaaggguaagaauaugcucuguuaagugagcauucuuuccaaaauuugucguaccaguuuuuuuucuaaauaaaacagaauuguuacacaacuuaauauguuuccauuuuaagcauugaugaauauauaugagaaccaauauuuuuaagugaacagaauauaguuuucuauuuugugugaaaggaauugguacagugaauuggaugcauaggagcauuuuauaucuccuccuccuuaaaaaauaagaguuuacaucaggaguaugaucucacuuaaaauucuguucauaaauaauaugcauuuucuaaaauacauagcacuuaaaagauagaaaaauguaugaaaaauuaaaacaaacuuaaauaucuuuuaaaauuaugcacauuuuuagguaaguuuuucuuugauuugaaacauuaguguuuuaaucugauuaccgguucaugaggcaaugauacugaauucaaacccaccaugugguaguggaaaaaacuggacagaacuagguuuagaucccagcuuugccacuuauuggcuacauaguaagggcaaaugaauucacaucuuuguuccucuauuucuucauucauaaaugggaauaugaaugcuuuucuuagaagacuguggugaagauuaaaugacacaauguauaacauuugcauaaaauucuccacucaugguauaauuucaauaacuuuaucucuucuccccucuucuuuaucucauaaugacaaaaacuauucaacaaaugacuggaaaauuauauaugcaaaugagacuuccaaaaauaaaauuaaaugguaagugauccuggaggaccuguaacaaauaaccuuacauagcaaaaacgaacaaaaccuaaccugcuucaucucaaaacaaguagacacauguuguaauugcuagaaaucuguagaaauguggcucacaagcaguuuauuguaaaauaauuaaagcuuauuuaugucaagaggccuugggaaaaaaagagagcauaaaccaauuugcauuagcacguuacucuccucuccugcuuucguuucaauuaacagaccagcaggugcucucugcaguuaaaaagauaagcuaucagggaggaggaugaauuuuuggcugaccuacagacacugugguuugccugcugauuggguuccuaccucgcuguaccaauuucugagguguuaauuuaacuguuccucucugucaugcaggucucggccuugaaaaauaaacugaagaagcagucuacagcuacgggugauggaguagcuagggccuuucuuagagcacaggcugcuuuguuuggauccuacagagaugcacugagauacaaaccuguaagcguuuuguuucaucacuguuuuaauuugcuuuuuuaugguucuuuggaaugagacagaaaaaaagagacaucauuuuaauauuacaccuucaaaaaauaucauggaaaucuuuuaagauccaaaauaauguguuucaaaacauacauuucaucuccaauuuuugacuuuuuauuuuuaguuuuguuuaguacucuuucauuaguauuucccaaagucuuuguguuacauuauuaaugcucuaggauuggaauacuuacuccuuaacuaauuaaagacuuguauuacuguauuuuaaaacacuuaccugaucuuguuaagaucauuaagaaauucacaagacaauugggcuuauuagauuaaugaguuuagaaaugacagguacaaagugauacuuaagaaaaauagaacuugaagguuuuacaauauuuggaaauuuguugucuuccuaauucaugacccuuugcuaagguggguuuaucucuuuagcauaucuuagcucauuuucucauucuuucuguuuuaauacccuaauuauuauuguguagaauuauagccaaguuuuuaagaguauccaaaaaggugcaagucaaaauacauuuguugcucucucugaauuguugguuagagcauguuaggcugauuuuacagaaauuauuacacuauucuuccuucacugggugaauaaguuguaagagauaaaaccauugauuuaguaauaagaagaccugcuaucuaauaggaguuguuacuaaacugcguaaccuugacccauuuccuuagucucucuagauuuugaucuucauguuuguaaaaugagaauucuuauaccuucccccucuaucuuucaggauaacucaguuguaacucaguuaaacucaauuguaaacucugaggcacuaagcaaaugugaauggguuguaucuuuucuaaacugacuucugaauuagugguucccacucaagugguccuuauagcucuaaaaggucaucuaauuauuggaaggauuccuuaaaugcaugggcagauccgcugcuauuuuuauaaguucagcugcuuguuugucuaguuuacuugcuaaucuuuuugagauauguguauauuuuuaaagcauuauauaauucauaguacuauacagaguauacauaucucacaugggggagucuuaaaaaguuguucauaguuauaagggucucauucuuuaaaagacuggaaaccaauaaucuauacuacaguagggcauauucguauuugaauuguucaacaucaguuaaaacauaaaaaugaguuugaaacacaaaauuggugauugauucugguuaugucaaaguuugaaaauagggauugauuucaaguuuacaguaugggaaggaaaguuaaaaauaucacuuuacuugaauuuugacauauuuaaguacguauucaucuuuauaaacuaaacuucauuuuuauuuuaaaauuuuuugaguacuucagauuugaagaaaggagcaaaucaaagugagaacauuuucuaaaaugauuuaaacuaucaguuuguugggugcugacugaaauuaauaaaauaucccaucuuuaauauuaguuacuguagauuucauuguuuaauuuucucacccuuuaagcuucauugcacagauaggaguauaagauuucagugacuuuuuaaaaaaaaaucuugaaagccauauuguuacuaucugugaaaaauguuuaauuuuaucuuagaguauauuucuuguuuauugaucacauuuuguuauaaauuuauuuguuuaguugccuacauuuuuuucuuuuuacauuugguauuuuccuguuuucauuucugcugcuaguuuuuuuuuuuuuaggaguauuuucauuuucuaugccuuuacauuuuuucugacucagucuuugaaugaaagcuuccuuuuuaauguauacugaaugcacuuagaugauuauuuuccauuuauuuucacaagagauaguuuuuagggaaaaugauuuauuucuuuuugugcauaaacuaugcuuuuucaaccauuaucuuuauacauuacuuguaucauaauuuauuaaaaguauauuaauguuuuguuuuauaauucuuuucggucauugauauaauagaccaaugucuucucucuuuacuuagaccuuuuuuuaauaucaaccaaaaauauuuuauaucaaucaaauauauuuugguugauauuuaaaaaaagggcuaagugcagagagaaguuucaaaaacauauuuaaggaguauccugcuacuauaguacaauuggaaaggaaaauauuacucaguagguguuaauaaugugaauuauuuuacuagacauuacuuuuuaaaauuuuaugauuguuuauacacauaaaaauaaaccauuauuucccuuaguuuuaacaaaacuaaaccuguagguuagaccaaugacagaucagucucaggugccaucucuucaccuggcauucaaggcccuuaccaugggcaggcagucuguuauccuuuuuuccuaaacuuugaccucaguucagagaauucugccuguggcuucgaaugucccaagcuucucaggcuuccacacauuuacuuauaguguucuuucuuccuggcaacgcuuuuaauccucacuuuuaauagccgucuaguuccuucaugauccuggaagcuguaguuuguguuuguacugaccccuucuuucuaugaauuaauuauacuuauuuuaacacauuucuucagccuuauucauauaugauuuguuaauuacauuguuauuuugacugauauucauaauuuuugaucacuauuaaaacguuaacugaccauugagcacccauuggaugccaggcauugauaggcccuuuagauaaguguucuuacugaauuuuuacaagccuucaaaauauuacucuuuauauuuuaaagaugaggaaaaugauacucauagaauuuaaguaaccucacuguuucucuagcuagugaagaguggggcuuagguuugaaucuguuuuuuucacggucccucucuugcucuaguguggcauauuucuguucuacuuugccucuguuaucauaugaugcuuuuuuuuuuuuuuuuuuuugagauggaaucucacucugucucccagccuggagugcaguggugugaucucagcucgcugcaagcuccaccucccggguucaugccauucuccugccucagcgucccgaguagcagggacuacaggugcccgccaccaugcccgccuaauuuuuguauuuuuaguagagacgggguuuugccgcguuagccaggauggucuugaucuccugaccucgugauacaccugccucggccucccagagugcugggauuacaggcgugagcuaccgcgcccggccgugauacacuucuuaagauauguuuccugaacgugcauuacuucuaaaugaagauacaugaaaggcauucaguauucacuaauggaaagaccaaacugaauacaaaaucuuaggaauuuucuuaauggaaacaggugguauaggcaucucauaauggguauauaaauuggagaaauuauuugauauuuaugcugucucuuuccauuuaugguuuuguuuaccuggaguaacuacuacuacucaaacugcuucauccucuucccuuuagucuucuaauucuucucuucccuucuuugucuuaaugcucuacacagcaggacugaauauauuguacugaaagggaguuuugauuugucuauuuuucucuuucugcagaaaagcaucuaaaguaaaagucaauggcaagcugcuucauuguauaagaauauacuucuucuguuuauuaggaugcauuauagauauaauuuauguuuaucagauauauguugaaugcagcuauaauaggaccucucugaagcuucuggaccaaaaaauaauguucagcaugugcccugcccccauccccacaggagcuuauagugauaaagggugauauagucauuucuucucuagcaguaauaaacaaaacgaauccgaaaauuauaaaagaaaauuauacuucuaaauguaugggaaacaagaaaccugggagauaacuauugaaaaugugcauuuuucaugucuuucaccauguucucaaaaaagaauaaaaccaaaaaggguuaggauucgcuccuauagaggcagcagaaccagucauaaaugaccuucaaucaggagaguuucagcuuuaucuuacaauuaaugcacaguguuuacaauuauuuaucaugggaaugcagugcuuaguguuguauauuagacaguucacuuuuaugauguucauguuagaucaaaguugagcaagaccagaggcggggagacagguguggcuauuauggucuuauugaagaagaggaagaaaggaccuuugugaauauccugaaggcucaaaucucaaagaccuuaggaaggaagacaggaguacuggggaaccaguggauguggauuaugagaaaaauacccacuaggaugauuugcauaucccuauacagauacuaaauacauaagcuaaauucugcuaaagaguaacuuauuuuauaaauuaaguacuuaaaacgucuaagcuggcaacccuaaauuguuguuacuuacaguguguaauccacacucucuaaauguuaccuuggcaugauuggcaaauaaauuguaccuacccuuaauuacagagaaaaauauaaaacuccuuaaaguuguuggaaauuuaaauaaaguaaugaauauuuuacucuuuuuuuuggauuuuagccaacaguaaguuagcuacuuuuuaagaauugaaaaaugugagauaaaauuaauguacuaaaugaauggaagaaaagcgguaagagcacaagacucuguaaccauacugccuggauucauccucauucggugaccaacuaguuguaugacuuggggcaaauuaaccuauuagugcuuugguguucgcauuuguuaaaaaaaaguaaugaugcuucuuggauugccauguaguaaaugcuguuuacgucgucauuauuaaaaauaaaauauuaaaaucaguagauuuaguaaggaaaaucccuuuagcauaaccacaaacaaagcaucuuuccagaaaggaaaacacugccuuaaacaugacaauacuuuuaaaugauuguauuaaauaacuaagaaauggucuuuaguuauaccucuuuguaucacuugugucagaagcuauaaaaaaauaagucaaauuuuuaaauaacagcuaaugcugaagaaauguuuguuugaguuaaaauauuguuuaguauauucaaagacauacuugauuauccugccugagagcacagaaguaacacucaaguuuauucccuuuaaugcuuaaggugcugucauguguuuccaucacucaagcuuuccugggcugccuugaaccuugcuaauggauaaaaaauaaguuacuuuaagaauaaagauugguuaguaauccgguccuccguuugacaagguggaggaguuaucuuucaaacauuuuuugauuauuuucuuuaaaacauuaucaguaaguaauguuguuguauuuagugauuaagcucaagcaauuuaaacacaggguuggcauccauaauuuaaaaggccauucacuaaaucuuugucuuaacauuuacauuuaagaaacuuguaauugucaacuuauuagaguuuuaaaaauccaaguugaaaaguacuacucacaguuuuaugguuacuaaaacauuuuacacauccuuucaugucauuucucuugcuugagcacagauagaccuguugacuugagagaugguuaccaccaaagaaauauuuggugugcaucuggcuuuuuaauggauaaaaguuguuuuauggcacuuucuuucugcucauuucuaauuaguagggagagaauuuugcuuaauugcuucaguaauaauauacaguuucuccucaaguacuuuggaauaguuagaacuagggacuuggguaguaaguguuccauuuauauaucacugauauguuuuaugagaauggagaguguuuuucuuauugccuuaaguuguggggaagaaaaauguaauuuuuaauaguaugaacaaaguuaaugcacaaucuauuaauuuuuucuaaguauuuaaauucacacaaaaagcuagaaacagcaaugucuaauuuagaaaaauuaguuccuuuuucugucuuaaguugcugaaucauagguaaauagaacauuaguagguagcuguaguuuuucuuuuuucaagacagauccagcaacuugaggauaaaguaauaaaauaauauguacaaauagaauauuuugaugcugaugauuaaacuuuauaguuugacugugagguucuuuuucauugacuucuagcuaaagugccaacaauggaagaaaauuacuguuuccaugguuaauauacucugaaaguagaguugcuguaucuuacauaauaauagcauugggacauguagaagaaaaaugcuguauaaccugaaaaucauuuauuauuauuuccugugagaaucugcaaauauuugaacauucccaugagauaucugacagcagagucuuucagauauuuuaaauuuaaaauagccaucaauaugcagacauuuuugcuuaguuuguuuauacuccuuuuguaauggugacauuacauugaguccaggugcauuaaggaacugaauaaguauaauguugauguuuuggauuauauuucacauuuuuuacguuaucauucuuucugaugcccuaauuuucuuucacagugaacucuugcuaagucauacacguccugauaguauaagaucuaaucuauguuuuaaguauuuucuuguucuuacaaaguuuucuacucccgguacaauauauagaacuugaaagauacuuauucuuaaaacaaacaaacacaaacauuaugucaauaaugauuaucacucugaaguugagcagcauacuaggguagaaaaacagcuguauuucauccauaacuuacuuguggcuuaauuauucuauauaaauaauucauauaguaacuagcagauauuuauuuaacacucaaaaugcaggguacuggguugggugcugcagggcagggauccccagcucccguuaggaaccaggccagauggcaggaggugaguggcaggcaagggaaugaagcuucaucuguauuuacagccgcuccccauggcucacauuacugcuugagcuccaccuccugucucauaggagcaaaaccccuauuaugaacugcauaugugagggaucuagguugcaugcuccuuaugagaaucuaaugccugaugaucugucacugucucccauuacccccagauaagaccaucuaguugcaagaaaacaagcucagggcucccacugauugauucuacauuauagugaguuguagaauuauuucguuauguauuacaauguaauaauaauauaaauaaaguacacaauaaacguaacgcgcuugaauuaucccacaacuauuccccacuccucugguccguggaaaaauugucuuccacaaaacccgcgucuggugccaagaaguuuggggaccacugccauagggaaugcaaagaugaucaagaauuuaguccccgaccuccagaguucacagauaagauauaugaaaauaaccuugaauguauggcagaaaauaagucccuaagaaaaucuguuucucuucucuguaauauaaacuuuauuccgauucuacugcagauuauguuuuccugauagcuguuuauguuccuuuguugggcuuuccaucgaaaugacugcuuuugauuccuuucuuuuugccccaucacuguuuuauggagcaaaauauucaguuguuuuucucucaugucagaauuaucucaugaagagauuuucuuuuccauuguuuuauguuucuacgugguuacuuugugucucuacagaaucauauguuuacuuacuuuucugugaaugaauaauacaacauuuaaaaaaauagauuauagauggguauuucucaauugcauaagucguuuucuguaaguagauugaucaacucaacuuuaauauucaagucuguacagauaauucuuaaguauguauuaaauaacaaauuuuccuaacacgaguuucuagcuuugugcuacauaucuucauguauuucacagacaucuguaguagauacuguuggugcccugcccagauccccuguacuuguuguugccguuuugugaaaaauugcacuuagcuaaaugggagugccucaccaggaaaacuguguucaacccucaucuuugcaccucucaccauugaaaaagaccacuucuuauaugggauauaagaagcuggccucucugccucaaagugggauuaacucugugauacagucagugcuuucccaugggauucggcugaagcuugucuccaguugagaccauguucuugcuugacuuuuuccucugccccgucuuguuuucuuuaauaccuuuuuccugagagugaucugcgaaaaucaauugaaccaagaaccccugucucaggcuccaguaggaauacuacagaaaacauaugccaaaauugauuuuaucaacuucuccuuaaaugugguuuucuuucuauauuuucagucucuaauaaauaaugucauuuuaugacccuuaaucuagaaaucuggaagucaccuuugaccccuacuuguuacugucgauaucagugguucucaaacauuuuggucucuggaugucuuuauacucuuaaaaauuaucaaagaaccuuaauuuaugugagguauauguauaaauacuuaccauauuagaaauuaaaacugaaaaaauauacauuuauuuaaaaagcaauauaaacuaauuaaauaugaauauaaaacauuuuugugaaaaauugcuauauuccuaaaaaaauuuagucugaacaauaucauuguuuuacauuuuuuucagaucucuuuaauaucuggcuuaauagaagucagcuggauucugauauuugauuccguauucagucuauugcaauauugccaaccauguagcuuuugggaaacacuguuggaucucaggagaaaaugagagugaagagugacaauaaugacuuacauuauuaugaaaauacuuuuguuguuacagauccuguggaaaagucugaccuuggaucacacuuugaaaaacaucacugcauaucaguugacaaacuaguccuauugauuuugccacgaaauguuuaacaauguaguuaaccacaugaacuucaaauacucauaaccuggguuaaaaucauaggcagaauucuucucaugucauucaauucaacuuugauuuuaaagaacucauacucaagagucauuuauuaauaucucuuucauaacauaugccuuaaggaugacaguaauugaggcuuccagugauggcaguaauugagguucuuguauauuaauauauacaacuuuaaagcauuauuaauaaagacuuauuuuucuccuugagagaaaauucugaugugucagugcuuugccuuuuguuauuaucagagauucuuaguaaauaaaccguguuaaucaaauugaagguuuaguucaaaguuuuuccaugauuugugucaucacaaguggauggacagcaaaucugagcuuuuucuuuaccuguucucuggagagauugaaaguacucaaagguuaaugaggacagaauucuucuagcuuaauucacauaggcuaaugauuaaacuaugcccaacucuuaagaaagcauagacuuuagucucucauccauuucuucuugucuugaaauacaucuuuacauguuuaaggaaaaaucuaucccauaaaaacuaaaguuacuauuaguccugauuacuuuguaauagcagugaugccagaacugccauuagaggcaauuacuuauauuuauuuuuaaaauuguauuuauuuuugugaagaugauaugucauauagaauaaggcuuagcucauuugcuauuuuuauuuuauuuuuaaaauucagucauaaaacauuuaucgggcucccaguguaacuagggaugaugcuaguacuagagauuagaaaacaauagaccuuuauuuuuaacaggcuugccuuccuccgauagauuauaaauucugugauaguggaaaauauaguacauuugugaucauccaaaauauauuuauguaaauuaguccgguuuaaaaaauauguaauuuaaaggucaucuguagcucuuuaccauuggcaauaauaggcuagguuggugacuuaugccuagaauuccagcuuuuuggguggccgagguggggagaucacuugagcccaggaguuugagaccaaccugggcaacauagcgaaacccuuucucuacagaaaauacaaaauguuagccgggcaugguggcaugugccuguagucccagcuacuugggaggcugaggugggaggaucaccugagcccaggaggucaaggcugcagugagcuaugaaugaaccacuauaauccuaccugcauggcagaaugacacccuccccaaccccuccccucugaaaaaaauuggcaaucaucuguauaaaaauguguaaugacauuuuuauuaugaaucauuggcugguagcugaugguaggugacaccacuuaagaguuuaucgaauugucuucuuuaauaauuuguuugaauuuuguuuucuuuuuucuauagcagugcuauccaggaaaacuuuuuaugcugaaggaaauguucuauaucugugcuguucaauaugguagccacuaaccacaugugaccauugagcgguucaaauguggcuaguaugacugaggaacugaaauuuuaauuaaucuucauaaauuuacauuuacauagcuacaugugauuagugucuacugaaugugacaguacaguucuauaguguauuaacuuuaucagaaagugguaauaguuuaauuaguuacucucauuauuuuauuuauacaggaaccuauuuucagaauuguacuuaaagauaucuguaauaauauugagucuuccuuaagauuaaauuauaauuguaauuaaauuauucuuauuuuuuuucaaaguucuauuacaaaguaaacaggcacacuuuuucuuuuuccuaugacauaaauauugcuacaaggugcauuguaaugaaggaaucauuuuuauucaucuguguuuucauuuuugucauaaaguuuagucacuuaucuuuguuuguguugaaugggcuaaagggcuguucaggcugaugagggaaauagcaggugguaggaauuagccagugggugaugauuuucugcauucaugcaaaggaauaaauagaaaaaaaauggaaucaguaggacuugagauuuaaguccuugcugguuuggaggagcauuugguagagcuaccacaagacgcuugcaaaaauaugauuacuuaacgcaaaggauuaaugaaagcagaucccaaguaggacuuauccuggaaaguauccagccugaauuguuuugcaaucaugaagagaaggugauuguaaaaucuuuucauuaauuaaaaaacaaauuaaugaucauaacaacuaagugcgaaugucaaauaucaugcagcaguuuuuauaguaacaguguuuuccaaucaggaugcaauaaaauuaugugauauuuucagguaugugugcuauguuuaauacucauaauucaaucugaugaugucaaaucuuuauuuuuaggggauuuacuuuuacuugagggaguaaaauugagcaauuuuaagaguacaugggauccuggauuagaaagguguaguacaggcuuauuaguagaggaauauuucuacuagccuaaacuauucuguguaaggaagggucuguugcuucugcaccuuacgcuuccucuaucacucuucacauaccuauuuaaagagacuaguucucucugacuaaccuuuuauugaugcccuuaaaaucuuuauuucuaucuagggugagcccaucacuuucugugaggagaguuuuguaaagcaccgcucaagcgugaugaaacaguuccuggaaacugccauuaaccuccagcuuuuuaagcagguaagaguggaccuccacauuuuucuuuuguaagacaacauugucaguuuuacacauuuguauuacuauaaaacuauguacaaacccugaguagcaucuuuucuagaaugucaggaaauuuuuguuuauuuuguaagucguagcuaguuaugacauagcacucuagaaauauuauauaauaacuuugcuauuaaaaauuucucaucaaauguggcugagcuuaaagucucauugaggaagaauauacauucacagaagaagcagcaacaugacuaguuuuacuuauacaaggcaucuuagaagaaguuauuuugguaugguggauugauacgguaaacuaacaaacuguauuuugauaggauuauuccauuguaauauaguuuauaaaauaguucauaaaaugaauauuuaacuuuuuaagcuuuguaagacuuuuuaauacucauacauucagaauuaauaauaagacucauaguuaugcuguuuguccugauuuuugguucagaaaauauaauugcuauuucaaaaaagcaguaacuagacaucagauuucagaaauuuuggaugcacugcuucugucauuccauuguguaaucauagcaagugucuuaaauuggguugucuuaguuucuguauacaaaauuugaauuaaguucuuaacacuuguuuuucuuauuccgcaugacaauguuaaguguaaaguuuacuaugugaauuaaacauuuaaugaagaccuacugugugucauaaacugugcucagggccaggauacaaaaaugaauaaaaacucaguaaugcccuugagaagcugacagucuaauaauuuuuuugaacuguuagaagggaagauacuauaucacucaaaauaaccuucaaauuaggucaguaaagaagucagcauggcaacaauuaaugcuacuacuucugaggaaauuuuaaaaaauaaucugagauuacaaaauacucuggggcauggggagauaccugucuuccaauaagugaaguuuuacauuaaggaaaggguuaagguuauccuguacacaaacuuaaggagcauggauuucaggaucagagauguccugugaauuuccaaaaaauagagugggcugcuuuuggagcuuuuugucccuagaggucuccaagcauagacucaauuacuucccaggguugaaaggaagaucaagugauagugcuuuauaaaugcugaaguauagcacaguacaguccuaagcuagucaugcagugcaugcuuguugaguaaaauaucaguaccuuuuuguauuuuucucuaucaagaagaggcacuaucuuccauuaucaaaacugaguugugaagauuaaauuauauggggguuagggauugaauggguagguagaauaucuaacuuauuucccuuugaucaugaacuucuguaacuaguuccuuaccacuuaauaaaguuaauaaaacaguaauuuuuuugcauaguuacagaagaguuuacuuuuuaggagucauguauaguuggguugcauuuugacuguaucgcagaauaucuguuuuacaugaguacauauuucuuuuucuuuaaaauagaaauauuaccaccuaccucacaggauuauuauaagguuuaugugaauuaacacauguacacucucagcacaaugcauggugccuuguugaugcucagcaaaucuuaaugucugccucauucuuagagaaauuacauuaacaaaauacauaucuguguaggacuuuuaaaaaauacaguuuguucaaggacguuaaauguaaaauaugaaaauggucaaccaaagaacuaauuauguggacaauguggauagucuuacuugcacaaauuggcugucuucuagaacuugauaugcucaugauucuuaaaaaagugauacgugaagauagcccugaaaggauugaaaagauucucguugacagaguuucacaaacuucuaaaagaagagucaauugguaaaaaacuaacacagaugaauccucaaagauacuacucauauggcugaaaaaauauaaaaauauuuauuagguacaaaagauuuaugacuaugacuuugugauccauuauaggucuagaauuauucagguuaucucuuagaacaacuuaugcuucaaauuugagaggacucugacccaggagagcagcauauaauuuuaaggaaagaguuaaagugaaguuuuauuucugauaauauggcaggguaggauccauaaauaaccuacauacuacaauuuaaaacguaauauuuaaagaacuccuuauguugagacaguacaggagacaaagccuagugcucacuuuacaagaugagaaguguaauaggagacccaguuccuguaauucugagaagacuuaauguacagguaaacuagaaauaaagguguuuacuuucucagucaguuuccuggggaucuguaaggaaacucauacauccaaagcauuagugcuggguagagggaagggaaaaaugcuguuaagaaauaaccacaugucagucugcacagaaauuugcagccugaauuaauauuuucugauuuuggcugacaaaacucaaacgaaauuuaaaggacccuaaauguuagugcccccagaccucaggaagaggcaaacauauauucccucuucaggaaaucaccuucagccaggcaucaaauaauucuuccagcuaaaauuccaaaaggaaauuuugcuguuaaaaauuauuaaaagggccaggcgcagugacucacaggagaaaauuauuagauccuagcaacagguaccuguaaucccagcacucugggagaccgagacggguggaucaugaggucaggagaucgagaccauccuggcuaauacggugaaacccugucucuacuaaaaaaaaaaaaaaaaaaaaauuagcugggcgugguggcaggugcauguaaucccagcuacuugggaggcugaagcaggaaaauggcauguaccugggaggaggagcuugcagugacugagauugcaccacugcacuccagccugggcgacagagugagacucuuaucucaaaaaaaaaaaaaaaaaaaaaagaaagaaagaaaagaaagaaaaauuauuaaaaauacaaugaaagaaauuauaaaugagagcuagcagaaacaacagaugaaacugacuugcaaagacuuuaaguauuggaauuaucagaaauagaauaugaaaauagccauguuuaacauguugaaagaagaaacaagccuuaaaauguucagagaagaaaaacuucaaagagugcaaagccaauuucaaaaagguagcaaauaaacuucuguuaaggaagcauguaauaauugaaauuaaauaaguugauguguguaauugcagaucaaaucuaagugaagagagguuugcuaagcugaagauauauuugaaaaagaaguuauacaaaaugugguauggaaagacagaaauggaaaauauaggaaguugauagacauagaggguagacuaagaauguccuuaaauucauauagucaguucuaauaggugaggacagaaaauggaacagagacaguaguugaaaggauagugccagaaccaaugaaaauacacuucauaaauuuacaaauuuauaaagucuuaacauccaaacugaauaaagaagaaagaaucuaugcccacacacaguguauauucauacauccaaagcuauaaaacacuaaacaaaauggaaauuuauuuaaauaggagaaaaaagauuaccuucaaaggagcaauauauugacagcuuacuucacagcagcaacaauggaaucuagaagauacuggcaugauaucuucaguguguugagaaaaaauacauagaauucuaugccaaacaaaacaccuuuuaauuaugagugacaugaggacauuucccaacaaaaacugaguuugccccccucguguugguuucauuaauguguccacuuggcuaggcuaccauccccaauuauuccaucaaacaguaauuuagguuuugcuaugaaaggauuuuaaagauaaaauuaaaacuccuaaucauuugacuauaaauaaagaagauuauucuagauaaucuaauugguggaccuaucugaaucacuuggaaagcuauucuagauaaucuaauugguggaccuaucugaaucacucggaaagccuuuaaaagaggucuaaccagccugggcagcauagugaaacccuguuucuacaaaaaauacaaaaauuagcuggauguguggugcacaccuguaguucuagcuacuaugugaggcuaacuagggaggucccuuaaagggagggacuuuuuuuuuuuguauuauacuuuaaguuuuaggguacaugugcacaacgugcagguuuguuacauagguauaaggaaagacaguguucuccuaguuuacuuaucauuuuaaaaauauuucaauuguauaauuuuuguuguauuuuauuuuuuaaaaauuuuaauugacaauaguguguguuuaugggguacaaugugauguuuugauacacacauacacauuguagaaugauuauaucaagcuaauuaacauaucuaucaccucacauuuuuuagaaugcugagaacauuuauaaucuacuuuuuuaggccgggcacaguggcucaugcuggugaucccagcacuuugugaggcugauggggguggaucaccugaggucaggaguuugagaccaaccuggccaacauggugaaaccccgucucuaauaaaaauacaaaaauuagccaggcaaggugucacacgccuguaaucccagcuacacuggaggcugaagcaggagaauagcuugaaccugggagacagagguugcagugagcugagauugugccagugcacuccagccugggcaacagagcaagacuccaucucaaagaaacaacaacaacaacaacaacaaaaacaaaaacccuacucuuuuagcaauuuugaaauguacaauacauuaguauuaacuguggucacuguaccaugcaguagaucucaaaaaccuauuucucuugucuaacugaaacuuuguauccuuugaucaaaaucuuccccuccccuggacacuccuucuuucagucaacaaagcagaagcuaccaacuauccuugcuuuauuauuauuauuuaaacuguuaauauuuaauuaaaguauuguguuaaaacauauauauuuuuaauguuuauacgucauccaguaauaggcuguauuuucauugacaguugacuucuuaaccucuuuuggucucaguuucugcauuguaacaugaguuagaguaaaagaucacugaguuugagauaccucucaucucuaacauuccaugauacuuugaaauaaacauagcuuagauggaugauaguggguuccauuuguaugaauuucucuucagguaauggauuuggaaggaaucccagaaacaguuccuuaaauccacaacucugacauuaccgucuuucuuuagcuagcagcuuuacaaagacuuaagccauuauuuucaggucucuuacuuuuaucucauacugauacaaugaaggaaauuauuuucuucuguacauugcuuguuauuaaggccccuggaacugaaguuuuuucugcucaucuuaccauacauucaccauggcuaaggaccacggcaaaaccaaaccuuucccccaaaaccucuccuaccauucauauaguaauauaaauguguauuucucaaacuuuucuauccaacagagugccccccauggcagaagagaaugcauuuuuuaaagaguaugggggguggcuguaugagcucacugauaagcacauuuuaggaagcauucugcauuuuuccaaaacauuuauacauuguauauucuauaccgcaauguagcuauggcaaguggcuauaauaguuugaaugucaacccuuaggucaaucaucucaucuuuucuauuccuuuagagcucuguucaugucugaguuauagaauuuaucccauguuauuguaauuuaucuuuuuuauauugacuucaucucucuaaagucuucccugagugucccucccccucacuaagucuguacuccuuuuuuucugugccuauauuacuuuaaacacauuuuauuuauucaugcagucugauugaauuuagugugucaauccaagagccucaucuagaacuauaaacuuacgggcucuccaugaauauaggccuuuuuaacugauaaucuagauuacuguuaggaaacuuauuuaauagugaaggaacucacauauauuuaaauagauauucaaaauaauucugcuugcccaaauucuaacucuuaucagggaggaaaaugauaaagauucaaauuggaaaacucuuuuuuaauguucccccaaaaccuuuucuaccuuucauugaguaauaaaaauguguauuucucaaacuuuucuauccaaaaaagugccccccauggcagaagagaauacauauuuuuaaagaguauaaggggguggcuguagaagcccacugacaggcacaguuuaggaagcauucugcauuuuuccaaaacauuuauacauguuguacauucuauaucacaacauagcaguguuuauuuuaaagugaaaacauuuuaaauacugguuguauuacccucuucuuaccuucauauuaaaauaaaacuaaaauuucaguuaaauauaccacauacauccuuuggcuuuguguucuuggucacaccauugagugucacuaauggcaggucuguaccccugugaagaauauuggcuuggaauccaguagauccggauuuguauccugguucugccacuuucauggaguaucacacuauauaaggugcuuggugccucuuugggcuccaaauccuuuccaauuuccuauucuaauguaauaugcaaucacauugaauguuccuucacacauacauuucacaaugucagguuuugucuaugccauacuacaccaucaguauuaauaugcuuccugucauuccgccauagccucuucaaacgucaacucuuacauugaucauucugucuuuucuauucuuuagauuuuuuuuucuuuuucuuuuucuguuuucuuuuuaaauuauacuuuagguucuaggguacaugugcacaaugugcagguuuguuacauagguauacaugugccauguugguuugcugcacccauuaacucauuauuuacauuagguauuucuccuaaugcuaucccucccccaggccccuaccugccaacaggcccuggugugugauguucccgcccuguguccaaguguucucauuguucaguuccuaccuaugagugagaacaugcaauguuugguuuucuguccuugugauaguuugcugagagugaugguuuccagcuucauccaugucccugcaaaggacaugaacucauccuuuuuuauggcugcauaguauuccaugacguauaugugccacauuuucuuaauccagucuaucauugauggacauuuggguuguuuccaagucuuugcuauugugaauggugccgcaauaaacauacaugugcauaugucuuuaugguagcauaauuuauaauccuuuggguaaauacccaguaaugggaucgcuggaucaaaugguauuucuaguucuagauccuugaggaauccucacacuuuuuuccacaaugguugaacuaauuuauacucccaccaacaguguaaaagcuuuucuauuucuccacauucucuccagcaucuguuguuucuuaccuuuuuaaugaucaccauucuaaauggcaugagaugguaucucauugugguuuugauuugcauuucucugaugaccagugaugaugacccuuuuuucauaugucuguuggcagcauaaaugucuuuugagaagcgucuguuccuaugcuuuucccacuuuuuaaugguuuuuuuuuuucuuguaaauuuguuuaaguucuuuguagauccuggguauuaucccuuugucagauggguagauggcaaaaaauuuuucccauucuguagguugccuguucacucugaugguaguuucuuuugccaugcggaagcuguguaguugaauuagaucccauuugucuauuuuggcuuuuguugccauugcuuuugguguuuuagucaugaaguccuugcccaugccuauguccugaaugguauugccuagguuuucuaggguuuuuaugguuuuaggucuagcauuuaagucuuuaauccaucuugaauuaauuuuuguacaagguguaaggaagggauccaguuucagcuuuuuacauauggcuaaccaguuuucccagcaccauuuauuaaaucgggaauccuuuccccauuucuuguuuuugucagauuugucaaagaucagaugguuguaguugugugguguuauuucugagggcucuguucuguuccauuggccuauaucucuguuuugguaccaguaccaugcuguuuugguuacuguagccuuguaguauaguuugaaguuagguagcgugaugccuccagcuuuguucuuuuugcuuaggauugucuuggcaaugcgcgcucuuuuuugguuccauaugaacuuuaaaguaguuuuuuccaauucugugaagaaagucauugguagcuucauggggauggcauugaaucuauaaauuaccuugggcaguauggccauuuucaaaauauugagucuuccuauccaugaauguggaauguucuuccauuuguuuguguccucuuuuauuuuguugagcagugguuuguaguucuccuugaagagguccuucacaucccuuguaaguuggauuccuagguauuuuauucucuuuguagcaauugcgaaugggaguucacucaugauuuggcucuccgauugucuguuauugguguacaggaaugcuugugauuuuugcacacugauuuuguauccugagacuuugcugaaguugcuuaucagcuuaaggagauuuugggcugagaugaugggguuuucuaaauagacaaucaugucaucugcaaauagggacaauuugacuuccucuuuuccuaauugaauacacuuuauuucuuucucuugccugauagcccuggccagaacuaccaacacuauguugaauaggagagagggcauccuugucuuguacugguuuucagagggaaugcuuccaguuuuugcccauucaguacgauauuggcuguggguuugucauaaauagcucuuauuauuuugagauauguuccaucaauaccuuauugcgaguuuuuagcaugaagggauguugaauuuugccagaggccuuuucugcaucuauugagaugaucaugugguuucucucauugguucuguuuaugugauggauuacauuuauugauuugcguauauuaaaccagcccugcaucccagggaugaagccgacuugauagugguggauaagcuuuuugaugugcugcuggauucaguuugccaguauuuuauugaggauuuucgcaucaauguuugucagaaauauuggccuaaaauucucuuuuuuuguugugucuuugccaggcuuugguauccagacgauacuggccucauaaaaugaguuagggaggauucccucuuuuucuauugauuguaauaguuucagaaggaauggugccagcucucuuugugccucugguagaauuuggcugugaauccgucugguccuggacucuuuuugguugguaagcuauugauuauugccacaauuucagagccuguuauuggucuauucagagauucaacuucuuccugguacauaacgaaaugaaggcagaaauaaagauguucuuugaaaccaacgagaacaaagacacaacauaccagaaucucugggacacauucaaagcaguguguagagggaaauuuauagcacuaaauacccacaagagaaagcaggaaagauccaaaauugacacccuaacaucacaauuaaaagaacuagaaaagcaagagcaaacacauucaaaagcuagcagaaggcaagaaacaacuaaaaucagggcagaacugaaggaaauagagaccaaaaaaacccuucaaaaaauuaaugaauccaggagcugguuuuuugaaaggaucaacaaaauugauagaccgcuagcaagacuaauaaagaaaaaaagagagaagaaucaaauagacgcaauaaaaaaugauaaaggggauaucaccaccgaucccacagaaauucaaacuaccgucagagaauacuaccuuuggucuuugauguugcuugccuacagaugggguuuugguguggauguccuuuuuguugauguugaugcuguuccuuucuguuuguuaguuuuccuucuaacagucaggucccucagcugcaggucgguuggaguuugcuggaggucuacuccagagccuguuugccugaguaucaacaguggaggcugcagaacaguaaauauugcugccugaucuuccucuggaagcuucgucccagcgggguaccugccuguaugaggugucuguuagccccuacugggaggugucucccaguuaggcuacagggagucaggcaccugcuugaggaggcagucuguccauucucagagcucaaaugucaugcugggagaaccacugcucccuucagagcugucagggauguuuaagucugcagaaguuucugcugccuguuguucagcuauucccugcccacagagguggagucuauagaggcaguaggccuugcugagcugcaguggccuccgcccaguucgagcuucccggccccuuuauuuaccuacucaagccucagcaauggcggacgccccucuccucaccaggcugcugccucacaggucaaucucagacugcugcgguagcagugagcaaggcucugugggcgugggacccacugagccaggcacagaagagacucuccuggucugcugauugcuaagaccaugggaaaagcgcaguauuugggcagaaaugucccguuuuuccagguacagucugucacgauuucccuuggcuaggaaagggaaaucccccaaccccuugugcuucccgggugcggcgaugccccacccugcuuuggcuugcccucugugggcuguacccacugcccaaccagucccaaugagaugaaccauguaccucaaucggaaaugcagaaaucaccugucuucugcaucgaucacacugggagcugcagaccagagcuguuccuauuuggccaucuuggaacugaucccuccuuuagauuuuuauucauaucucacuuguagcauuuaucccauguuauuguaauuucucuuuuuaauauguauuuucaccucucuaaagucuucccugagugucccucccugucacuaagucuguacucuuuuuucugugugucuauuaguuugaacacauuuuauuuguuuauucacucuaacaauuacauauggauuauuuauuuugugucaggugcugcuacuccaagcacuugagauucagagauguguagccuucuguuaugaagcugauauuucuagugaaggaaauggguuaacaaacaaacagcaaauaagaaaaauaucagugagcaaaaaguucagaguauaugagacauugacuggauggccaauuuagauugagugacuagaaaaggcacuacugaaaaggugauauuuaagcuacgucuaaagaaggaaucaguuuugagauaugaaaagaagaacaugguuacagguagagagaauuguuacaaagaccuaaaggagggaaagaacuuggcauuuucuaagauccgaauaaaugaaaugugggcauggaaaagaguuguacuaaaugagguuagaauggcauaaaagggacagaucauacaaggcuuugaaggcauaaggaguuuaccuuuuauucuaaauggaacaguaugcuguagggaaguuuuagcuggcacaugauuggaucugaucuguauuuuguaaagguugcccagauuaccaugugaaaauauguuagaggagagagagguggcaaaaguccaauuaugaggcuuuuucaguuguccaggagagaagugauggugguaguaaacaagauggagugaagcaggacagaauuuguuuguuugagagguagaauugucaacucuuacuuauggguuagaguagagagaaauaagaaaucagagauaauguucauauaugucuuuuuauauugacauuuuaaauaacugucuuauucauuuacauaucaauuuucucaauagguuaugaaccuuucuaauacugggaccauuuaugauugcauucuauauauccaguuucuugcauaggaccuugucaauguugggugcuaaauaaauuucagucaaaucucuccuuaacauguuuuuuauuauuacacauaaaaagcgauuuugaauacucaaauauuugcuuauuacagugauaacaaccauaaauaauaaguaaagacucuaagauuagggacauagggagauuucuguuucauuaaagguaaccucuuuaugaccaaaagagaacacuaagauaacauaguacauucacuaaaguguauaaauuauaauauuaggguaaaaauccucaagaucauccaccucuaauaaaaucaccauuccauuuuguaaacaugcccucaguucuaucaaauguuuauguaauuuuauugacauaaauugaaaaaucuuaguuuuguuucuuaagauuauucuuaccagguaauugaauaaaaauuuauuucgaaagucucuggugggccuuggauaacuauauuguuauugugaggaaacaucugaguacuuauuauuugauaaaauaaaucccauguaguuuuggagaggggagaucauucucagcuaaucuucaguacuucuuuggagauaaauuccuaugucacauaaggaaaauucaguaaccaugguauagccugguuuaaauuuuuuuuuuuuuuuggagauaugggaucuugcuauguugccuaggcuauucuugaucuccugaucucaggugauccucucaccucagccuccuagugguuugggguuacaggcaugaaccagugugccuggccauuauuuuuuugacaaauaaaaauuguauauauuuaugauauauaacaugauguucugauauuggaauuugauuauagaauggcuaaauuaauuaacaucaauuuugauuguggaaugacuaaaucaagcuaaguaacauaucaguuaacucauguaauuaacauuuuuuguggcgagaacguuuaaaaucuacucuccuagcaaucuucaaguauuuaauacauaguuacuaacuauacauuauaguuauuaacuguacucuccauguugaacaauagaauuccugaacuuguuauuccucuugucuaauuaaaauuuugucugcuuuaccccaaccccugguaacuaccauucuguucucugcuucucugaguuugacuuuuuuagugaaaucauguacuauuugucuuuugaugccuggcuuauuuuacuuagcauaauguccuccagauugaaucauguuguugcaguugacaggauuuucuucuuuauaaaggguuaauaguguuccauuguguguguguguguguguguguguguguguguauaccacauuuucuuuuuguauucauccauucauggacaguuagguugauucauauauuuguuauuguugaguaaugcuguauugaacauguaaugcagauagaucuucagcauacugauuucauuuccuuuggauauauuccuagaagcagaauugcuggaucauauaauaguucuauuuuugguuuuuugagaaacuuccauacuguuuuccauaaugguuauacuaauuuacauucccaccaguaagguacaaggguuagcuuuucuccacauccuggccaaaacuuaccucuugucuuuuugauaauaaaaauccuaacagguaugacaugaugucucacugugguuuuaauuugcauuucucugaugauuagugauguugaacauuuuuucacuguuggccauuuguaugucuucuuaugaucaauguuuuuuuuccaaauauuuugcccauuuuuaauuggguuauuuauuuucuuauuaauuuguuugaguucuuuauauauuuuggauaucaauuccuuaucagauauaauuuacaaauauuuucucccauugcagagauugucucuucacucuguuauuuccuuuguguaaucauauuugucuauuuuugcuuucguugccugugcuuuugaagucaugauccaaaaaaucuuugcucagaccaguguugagaagcuuuuccccuguguuuucuucuuguaguuuuaugguuucaggucuuauguuuauaaauccauuuugaauugauuuuuauauauaaucugagauaagugcccuauuuuauucuucugcacauggauguccuucuccauuuuguguucuuagcaccuuaguugaagaucaguugaugggaaauguauggauuuauuuuuggguuuucuauucuauuucauaugucuguauaucuguuuuuaugcuaguaccaugccauuuugguuauuauggcuucauaguauauuuugagaucagauaaugugaugucuccagcuuugcuccuuuuauucaagauuguuuugucuauuugaggucuuuugugguuccauaugaauuuuaggauugauuuuuauauuucugagaaaaauaucauuggaaccuugguaggaauuacguugaacuguagaucccuuuggguaguauggauaguuuagcaaugcuaauucuuccauccaugaacacaugaacauggaauauuuuucuauauauuuugucauuuucaguuucuuuuauuaguguuauagcuuucauuguauaggucuuucacuucuuugguuaauuuuauucccaaguauuuuuuuaugcuauuguaaauuuaauuauuuucuugcuuucuuuuuggauaguuauuaauguauacaaaugcuacuuuuuaauacguugauuguguaucuugcuacauuacugauuuugcuuauuaguuccaacaguuuuuuugcucaagucuuuagaguuuuccgcauguaauaugccaugagcaaacaauuucccucccucccuccuucccucccucccugccugccuucccuccgucccuuccuuccuuccuuccuucccucccuccccucaucuccccaguuuggaugccuuuuauuucuauuuccucaugaauugcucuaacuaggauuucuacuucuguguuuaaaagaaauggugagaaugagaacucuugucuuguuccuuaucuuagcuuuuuaccauugacuauuauauuagcugugaacuuguuauauuuuuccuuuuauuguggugagauaaauuauuuuauacauaauuuguuaaguguuuucaucaugaguguugauuuuugucaaaugccuuugugcaucuguugaugugaucauaagguuuuugccguuuauucuguuaauguaguauaucacauuuauugauuugugaauguugaaccauccuugcauuccagggauaauccuuuuaaaacacuguugaauuugguuugcuaguauuuuguugaagauuuuugcaucuauguuuaagggacauuggauguaauucgcuuucuuuuuggagucuccuugucuggcuuuggugugagaguaaugcuggccacauaaaauaacuuuggaaauauucucuucuuuucaguuuuuuugaagaguuugaggauugguauucuuuaaauguuuguuacaauucagcaguggagucaucaggucugggguuuucuuugauggaagauuuuugacuacugauucagucuccuuguucauuauuucauuauuuguuaauaauucaguuuugauagguuguaucuaggaauuuauucauuucuucuggguuauucaauuuguugguguauaauuguugauuauaguagacucuuaugauucuuuauauuucuguaguaucaguugaacuguguccucuuccauuuccaauuuuacuuauuugaggcuucuuuauuuuuuucuuuaguuagaccagcuaaagguuugucaguuuaauuuuucagaaucuaauguucaguuucauugaucguuucuauugccuuucuaguuucuauuucauuuaguucuguucuaaucuuuauuuacugucacuauuucugucuuuauuuacugucauuagucuuuaugauuuacugucccucuaggaauaaaugaaugaagaaaugcacauauacuuguuguucuuguuuucucugcuuugaauauccucucuccauuuuacauuccacaacucagucuauucuuucuuuaagaccaagcucagauacaccuuuuccaggaauuuuuuuuuuuuaccucucauacuucuaugaauuucccuucuuuuagcaccauaugauauuuguugguuuguuuggcuccuucuuguguuguagacucuguaaaaacaagguucaugcuuuaaguguuuuuguauccuaauagcuaauacauaauaggcauuuaaguuuauuaaauaaauaaaugaaaaguugaugagugauucccuauuauaaggaauaugcaugaaaauauuuugacaguuuuaguagaugaggaguuuaugaaaauuaauauaaugaaacuuaucuaagagcuguaugaaaauuauaggaguuguagauaugcggcauuauuucugagggcucuguucuguuccauugaucuauaucucuguuuugguaccagaaaauuuuugcaaccuauucaucugacaaagggcuaauauccagaaucuacaaugaacucaaacaaauuuacaagaaaaaaacaaacaaccccaucaaaaagugggcaaaggacaugaacagacacuucucaaaagaagacauuuaugcagccaaaaaacacaugaaaaauugcucaccaucacuggccaucagagaaaugcaaauaaaaaccacaaugagauaccaucucacaccaguuagaauggcaaucauuaaaaagucaggaaacaacaggugcuggagaggauguggagaaauaggaauacuuuuacacuguuggugggacuguaaacuaguucaacccuuguggaagucaguguggcgauuccucagggaucuagaacuagacauaccauuugacccagccaucccauuacuggguauauacccaaaggacuauaaaucaugcugcuauaaagacacaugcacacauauguuuauugcggcacuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaccaucauucucaguaaacuaucgcaagaacaaaaaaccaaacacugcauauucucacucauaggugggaauugaacagugagaacacauggacacaggaaggggaacaucacacucuggggacuguugugggguggggggagggaggagggauagcuuuaggagauauaccuaaugcuaaaugacgaguuaaugggugcagcacaccagcauggcacuuguaugcauauguaacuaaccugcacauugugcacauguacccuaaaacuuaaaguauaauaauaauaaaauaaaagaaaaaaaaaagaaagaaaaaaaagaaaauuauaggaguaaaguguuacuguauuuuaaauaaaaugauaucuacaauuuuaaacuuggagucacauagugguguagcauguagaaguggaaauucuaugagauccugagcacuugcucuguuuugugcugugaucuacuuucccugacauaauaagauguugaauaaaaggagugggaccaaagugaaauauuuccuuuuauguuagcuacagauuuucagaagauauuuaaaagcuuuuaacauaaaaaauuguuacagauuucuacauuuuccuauuauucuuuuucaugauagugauucaugguauguaaucuauagcuaaugucagcacuuguauuacuaguaaaugaagauucaacaguuuuggaguguuaagaaagauuugaguuaugaauagauaggagaugguaauugcaucaagcauguauuuuauaacaugaaaaaaugauaaaauguaaugugacaugggggaauauagagacauaaugacagaagaaauguacaagaggagacaguuuaucaggauaaaggauacuuuuucucccagcaucucuuguuaacugauuucaauauccuaaauaguguuucucagaguguagucucagacugcuugcucucuuaugguaagacugacuuaccuggagagccuguuaaacaugcauauucuugagucucaccuucaaaacuaaugauuaaagaggccuggauuaaagcccagaaauauacauuauuaaugaaaugccauaaaaaguaagaacacuaaaauuuaagaaacacuuuuuaaguauucuuuacucauagcucagagauaguguggguucaguuccagaccacuacaauaaagugaauauugcaauaaagugaauuacacaaaguuuuuuguuucccagugcauauaaacauuagguuuauacuguccuauagucuauuaagugugcaauagcauugugucuaaaaaauguacauaccuuaauugaaaaauacuuuauuacuaaaauaugguaaugauaaucugagcuuuuaacaaaucaucuuuuuuuuuuuuuuuuuuuuuuuuugcugguggagguucuugccucaguauugauggcugcugacagauuagggagguggcuguagaagguuggggugguugucuuuuucuuaaaauaagacagcaaugaaauuugccacaucaauugacuccuaccuucaugagagauuucuuuguagcauauggugcuauuugauagcauuuuauccacaguagaacuucuuucaaaauuggagucaaucuucucaaacccuucugcugcuuaaucaacuaaguuuauguaauauucuaaauucauuauugucaacacucuucacagcaucuucaccaggaguagauuucaucucaugaaacuccuuucuuuccucauccauaagaaguaacuccucaucuguucaaguuuuauuaugauauuacagcaauuuagucacguauucagguuccacuuagaauucuaguuugcuugcuguuuccaucacaucugcaguuacuuccucgaagaagucuuggaccccuuaaagucauccaugagagcugguuggaaucaacuuuuuccaaacuccuguuaauguugcuguuuugaccucuuccuaugaaucaugaauguucuuaaugauaucuagaauggugaauccuuuccagaagguuuucaauuuacuuuccccagauuuauuggaagaauaacuaccuaugguagcuguagcccuaaugaaauguauuucuuaaauaauaagacuugaaagucaaaauuacuccuugauccauggguugcagaaugaauauuguuuuagcaggcaugaaaacaacauuaaucuccuuuuauaucucauuagaguuucuuggguggccaggugcauugucaguaagcagucauguuuugaaaggagucuuuguuucugagcagcagaucucaacagugggcuuagaauguucaguaaaacaugguguaagcagauguauugucaucugggcuuuguauuauuuauagagcacaggcagaguagacucagcauaauuuguaagggcccaaggauuuuuuaaauggcaaaugagcauuggcuucaauuaaagucaccagcugcauuaucgccuaacuggagaguuggccuguccuuugaagcuuugaagccuugaagccaggcauugacuucuccucucuagcuaugaaugucguggaugauaucuucuuccaauagaagguuguuucauccucauugggaaauguguuguucagccacuuucaucaauaaucuuagcuagaucuuuuggauaacuugcuacagcuucugcaucagcauuugcugcuuuaccauguacuuuuauguguagagaugguuucuuucccuaaaucucaugaaccaaugucuccuaccuucauaauuuucuccuacagcuuucucacaugucucacccuucauauaauugaagagaguuaggaccuugcucuggauuagucuuuggcuuaggggaaugucauggcucguuugacuuuuucuaucuagaccacucaaacguucuccaucucagcaauaaggcuguuucaccuucuugucauucgugugggcacugcaguagcacuuuccauuuccuucaagaacuuuuccuuugcauccacaacuuggcuaauugcuuggugcaagaggccuggcuuucaggcugucucaguuuuugacaugccuuccucaacaagcuucaucauuuuuagcuuuuucccuuggaugcguggaggucauuguaagguuauuaauuagggaauaggaaagccugaggagagggagagagaugggagaauagccagucaguggagcagucaggacacacacaacauuuaucaauuaagcuugcugacuuaugugggggugguuccuggcacccuaaaacaauuaugauaguuacaucaaagaucacugaucacagaucaccauaacaacuauaaucauauaauauaauccuguaauucuaauaugauuauaaugaaaaaguuugaaauauuguaagaguuuccaaaauaugacacagggacacaaaguaagcagaugcuguuggaaaaauggcacugacagauuugcucaauggaggguugccacaaaccuucaauuuguaaaagcugucuuugaagugcaguaaagugaaguucaauuaaaugagauaugccuguauccauuguauaauaggaaguguuuugugugggguacaucagagaaugaagaagaagacaaucucugacuuugugaaacuuuuauuucuaauaacaaauuauaauuuaaaacuaauguugaucuucaaagaucagaaguacuaugggaaaguagauagaacaggguauguuaaauggggacuaccagaggugaggguaggauuacaauuuaaaauaauauagucaauguagauuuccuggaauaugugucacuucagcgguauccugugggguggccaaaaguggaaacagagagaaagaagauuuagaaaacuauugcugucaucuaggugagaaauugauggcaguguggaacuguugauugaagauaugaugagauuuggucagaauauggguuuauuuuauaaauaaagccaauagauauucugaaggauuugauauaaagaugagagaaagcagagucauggaugauuccauguuaucucaucugagaaacuggaaggaaguauuugucucaauuaaaauugagauugggaagacugugggcagaagaugauuucgucaagaagaacaagaguugaguuucagacauauuaagucaagauaucuauuggagaugcaagcaggauauugauuagguaaguggauggauaaaggaggaggggagaauacuggacuggagguauauacauuuuggagucaucagcauguagguagaauuuaaagccaucagcauguagauuagaugagauuaccaaaggaaaaaguauaaauagaaaugauaagaaaguaguauaagagggcacuagcaacggagguuaugaaagaguggaugaacaauuagguaggacagaaaccagaagaguacuuuauauuagcagccaacaagaauaccaaagagggagggaucaacacugucaaaugcucaugacaggcucauuaaaacaaggaccuagcauugauuacuggauuuaguaaccauggauauaugaugaccuuagcaagagcaauuuugcugacguggugagacagaaauugugauugaagcaugagaggagaggacguagacacaaaguacugacagcucuuuugaauuuugcugugaagaauggaauagcacauaacuagagaaguaaguggggucaagagaagaaauaacauguuuguaugcugcugggaagaucuaguuaagaaauaaaacuauauucagaagagagaaggaaaaauuguuagagaaguuagucuuugcaagagcacaggcaguuuauucauaacaggagaaaaggcagucugugagcgcagaugggugagguagguaaaugugugacuuagagcuuguagaauuucucuuuuaauuacuucgauuuucucuuuuuuggugaaauuaggaagaaagaucgucaacugaaggagaaugggagaggucguuaaacauuuaaggagaaagaagauaggacauugugaaauggauggggagagugaauggagugacugcaaaguaaaauagaauugcuugguauucaaauccuauuggagguugagguuuauaaauuuugagugcaaauagucauuauggcugaugggauuuucuccugauacauggagccugccacaggccugcugaguaccugccuguuccuacuccaguguggguauuuacucuggcuauucccuuugccuggaauccucuuuucccauuaaaccuccucauggcuuugaagacuuggcuuaaaugcugucuucaugagaccuacccugaccacacuauuuaaaauagaaaguuccuugcccuagauuuccuaacuucccuuaggaagucuaucuuauucucuaacacucaucacuuucucacauacuacaucauuuguuguuucuuauuucaugcuaaaacucucuuccccuaccuccgcuacauguuuaagcaucacaagggcuuggauuuuugccugcuucauuuauuccuguauuucaggugucuaggaaagugccuggaauauagcauauauauucagcgaaauauucccugaauaauauaauuaguugauucuuuuggucuggugaucauaagguucagcagacuaaauucuuuagcacauuauuuaaugucaauugacauauccuugaaaguaguauuguugucuuauuacuguuauuuuagguuauuaguuuuaauaguacauugcacugagugggcucuuaauacucuucauaguguuuuccuguucaugauaccaugguagucuaauuuaguauacuggagccugauagucaucucauuaccuaauggcauaaaaauaacaauuuauuucuauucucccacauacuuaauuuucuuaguuugagcugaccuaccuugcuuauucccacuuguuguaggcaguuuguguuuauauauagcuacuaacugaauggcuugcauuuagcaggugucuauaaauaucuguugauguaauuuauuguaacacuucaguguaguuuucacuaaccugucaagguuuacugaacauuucuaagaagaaauauuuaaauuagacuuauuaaauuuuuagcccggagcauuauauaaaaaggcaaauuuuaaagauucauaagaaauuaguuuauuuuugaaagcaauuuuuuacuguauuuauuuuuccuuaaauugcugauugauuuuuaaaacuauuuuucucuagcucucaagacuugaaucuauuaguuaccucuuaucuuuguaccuaagaaggguuucuaaugugagauaaauuucugagccaugguaauguuuccuccaggcugaagaaggaauuuggguguguagauuuguuuauuguguugcuucagcacuucugcagcuuugcuucaguaacaggacugccauguuaacacaaaaaacaacacugaaucuugcuacuuccucagcucggcagagaauugcaccacugccucaucucucuaccagaaucuuuuuuauaaggauuuaaaaaagaucaaauauuucuuuuaaaaugauacuagaauccugaaauucaguugucauagaguuuugauggagugauugcaauuaaauauuuauauaacaugugucuagaccacuaagggaauuagaacacugauaauagcauaacuuguuuuaggauuuuuagauucaaugcuggaaauacacugacugguaaauaauuaaagaauuguaaaaggcauaugacuuaucucuuagaggacauauacauuccuaccaguuuacuggcagcuauauugaaguguaaucugugacuuugaucaaaacauauucuuuauauuuuuuggaaagaagccuccuauggagucuauucuuuauauuacauauuugaaacauucauuuuauauuuaauuguauuuaaaaaaugaauuugaauagugaauguuaauuuucauuuaacaguauuacuuacugaaguauauuuaaagcaacagauaauuucuuuaaauugacucagugucguauuagguggcuauuggaagauaaaaacacuucuaaaaaccuuagugacaucaauaucaaaaagaagagccagaagcaguuuugcugcuugaaaauauuuaucuuguaaccugucacaguacuuuaagaucaugucauaagcaagguugaaaggaaaccugcaaaccugagugcccuccaguauaauggacuggacuaauuauuaaugauuuuauauauauauuauuuugauguaacagacccgugauugaaaacuagagcguggccucugguguuauguaacauguauauuuguuuuuguccacgguuccuggcucauagcuccuaaaauccuugucaucuccgaaagcaaaaagaucaugucauaaagauuaacaaaaucugguucuugcaauuguugaugauuuagagggaauaaugucauugaucuugagaauuacauguauuauuauuuaaaucaauuuuaucuauuuauaauuuaugaaauuauggaauccauacuaugggauaauaucuaugaauuuuuguaagauuuccaguuauguuauuuauguuuuggugugauuaacauguuuagaucuagauuuuaauuuuuuucuuuuggaauaaaaagaaaaauauuaagauuuauauaaaagcaucaucuuaaagcaaauucuuaaguucuuuuaaaaaucuacuugcaaccuaauuuuauguuauaucgaugucacuuuuauuguuauuaacaaugcuauuugucauuacuuauaauaauaaacuaauucuuucaaagcuuaugucuuccaauuaccuguagauauguguuuacuaaaugaaauagguaacuguuuauaaggcaacaugugauagcacauuauagagucacagcuuuuccaacagagaugauuuuuuauuaguucaaaauuauuucucugcaucaguaacuaaaaauuuucuuaucucuuuuacuuauuaugaaaugcuccagaguuauuaaagugguauaaccaugaaccaacuccacuugggggaaaaauagcuguuauugaauaaaaauagaaaaagguguuugaaaaacuguuaaauucagcauucuucucauuaauaacgcuuuucaguuuauuccuggaugucuauuuauaugcaucuacauauaauauauguauguauaugcaugaaaucaaucuuuuguuacaagaacaaacauuuucacucauuguguacauuggugucugccacugacaggauuguuugcaaagucagugauaacacaugucauuuuacugagugauuaauuucuguuggcucaaaucacaagguuaguaagacagaguaguuacucauacucaaaaaugcauaaucaguaaauaguuuugggauuuaucgcuuuuuagacuugaacuguuccacuuauuucugaaauggauggauuauuuccaguaaacacaaaaaugaaaaccuuuuagcaagucuucuagucuuaaucuuuuagagcaaauuaaguccuuuaaaggaugucuuaguuuguucuauuugucaguaauguauuacuuucacuuuaucauuuugcuuucacuuuauuuuuaaaaaaauuauaacuaguccaucaaaugagaucacuuugauuuauaauacuguguuacaaaugugugcaagucaaauuuugcaugcguuuuaaaccaccuuauuuaaaaauuaccauuauguauagcaaagaugccaacauuauaaguuccuagcuuugaccucaagauagaaugaaaugaauuaguucuaugcauuauaauuauuugccuuuaaaacuggguagaaguauaugaacuucagcauuguuaaaguguacuuccgucuuuccacaacauuuacucaguucaaacuuuauggcagguauuuugccagguauugaagaugcauacaugugaaagacagugauccuucccuugggaagcucauaaaaauuggacagagauagaaaagguggugguacuggggaaaguggacuuuauuauuuagcauuuauuggguguacacaaugcagacacuuuauauuauuuuaauuagcucuuugcaauaccgcauaagguauuuuuauuacucccauuuuacagaaggagaaauagucuuagaggugacaaguggcccaagaucauaaaacuaguaaguggccaaguugugaugcaggccuuugauacuccacacuccauguuaauuuauacuauaggaaaccuuuuguaugccaagcauaaugaagaugugaaaauggguaauguaugguccuuguccucaaauaguucuaaguuuugugagaacaacucaugcucuaaaaaaucuaagauuccauuauuuuaggcuauguuuauuuaaaccugucuuaccacaguuuucacucaaaagcauuagaugaugauaaaaggaugauuaaaccacauuuuuccauuaauaguuguuuccauucauucauuauuuuagacucagagguacauauguagguuugguacauggguauguugcaugaugcugagguuugggcuucuaauaaucucauaucccagauaaugaacauaguacccaauaaguaguuuuucaaccucugccccacucccaccuuuccccacaauuuggacucuccaguguuuauaguucccaucuuugugucccuguauacccaauguuuacuucccacuuuuaagugaaaacuugcaauauuugauuuuauuucugcaugaauuugcuuaagauaauggccuccagcaucauuuauugguugcaaaugacaugauuucauucuuuuuuauggcugcaaaguauuccaugguguauauguaccacauuuucuuuauccagucugcugguaaaaggcagcuggguugaauccaugucuuugcuaugucaauagugccgggauaaacauacaaaugcaagugucuuuuuggaggaauuauuuauuuuccuuuggcuauauacccaauauggggauugcuggaucgaaugguaauucuauuuuuaguucuuugagaaauguccaagcugcuuuucacagggccugaacuaauuugcacucucaccgacaguguauaaguguucccuuucuccacaaauucguuaacaucuguuacuuuuugacuuuuuaauaauagucauucugacugcugugaggugguaucucauugugguuuugauuugcaucucucugaugauuagugauguugagcauucuuucauauguuucuuggccacuuauaucuucuuuugagcagugucuguucauguccuuugcccaauuuuuaauggaguuacuuguuuuuuucuuguugguuuaaguuucuuauagauucuggauauuaguccuuuguuggaugcauaguuugccaguauuuucucccauucuguagguugucuguuuacuccauugauaguuucuuuugcugugcagaagcucuuuaguuuaauugggccccaauuuucaauuuuugguuuuguuacauuuacuuuugaagacuuagucauagguuauuugccuaggcaagugucuggaaagguauuuccuagguuuucuucuaggaagaaagguuuucuucuagggagaaagguuuuuaguuugaggucuuacauuuaagucuuuaauucaccuugaguuaauuuuuuuuaauauaucuugagauguaagacuccaguuucauucuucugcauaugguuagccaguuuuccuggcacauauauugaaaagggugucuuucaccauuacuuauuuuugucaauuuuguuaaagaucaguugguuguaggugugcagcuuuauuucaggugucucuauucuguucccuuggucuggguaaagcacauuuugaacaugaaucuguugauucauuuucuauucuuucuuaauuuuuucuguaagagauuuuugaaucaaagucuuauaacuggugugacuuacugcuguuaauucucuuccccacccccucuuuuuuuuuuuuuuuuuuuuugagauggagucuugccaggcuggagugcaauggugcaaucuuggcucauugcaaccucuaccuccuggguucaagagauucuccugccucagccacuugaguagcugggacuacaggugugcgccaccacguccagcuaauauuuuuuguauuuuuuaguagagauggaguuucaccauguuggcuaggauggucucgaucucuugaccuugugaucccuccaccucggccucccaaaacgcugguauuacaggcgugagccaccacgcccagccuauuaauuaucuuaaauugcugcugaggaauauuguauuguccuauacaacucaucucaauuaguuuuguucauuaaccguucaaacagaaaaccaaggaaguaucugaguuucucuuuuuaaagaccagcuacuuuauuuuaguucagguaaaauuuaaauuucuaggguaaaaaauggucaggauuaguuaguuuuuggaugcauccaaaagauggaaguuuuaauccaucuucaaguccuccuugcaaaaagcauguaaaucuuuccuauguuauccccugccucuuaagcaaggaagacuuaaagauaccucaucauaauuauggauggaguaaaccacaacauaucaaauucuaggugccacaaaucaacaaaauaaaagguaaccaagugcugcuaguaauacguguguguguguguguguguguguguguguguguguguguguguguguauaaucauugauuuucaccuuggguuggucauauaaaaauacccaggauacuuuucaaaugcagcauuaauacugugagauucugguaugcuauguauguuggaacaggugaggacuggagcagaacaggcaauggaagauagucuccaggguaucuggauuucugcacuucgaaaaagaucuucgggugcuuuugauaguuucaguuucccacuccuccaaccucuuuuuuaagaacacugaaaaauauugccuaaaauaaccucaugcauaucaagucaguaugcauuuaccucaacuguauuuaacuuaauaaucauaauuccugucauucagugagaauguaugccaggaacuaugaaaguuguauugauuuuauuguaaaugguuaaaauuauuuggugcucuauuaugcuuuagaauauaauagguuagacaaguaguguuuuauuuuacugaaugaaguuaauaagcugaaaacagguaaugucuaacaucucacagauacuugcugugucacauuuccuagguuaaucuaauuuguuguuugcagcaacaccgugaggcagguacuggguaaacaggccuggcuggggaagacagagccccauggguaaauggcuuggcaaggcaacaguaccuuuguacaaacuccucuguagagauugugcauugagcaaccuauccagagccuaugaucuuuacuacugcauuuugcuauuuuuugcuaauaaguuagaguuagacucuuugcuguacauuugcaauuuaauuaauuagcugcugucuacugagcaccuguucuuuccauuguuugagaauuuucuuguguguguguauauauacaccauauauguguaauuuauacaagagucuguuauuaauguuuuugauguaaguaaaaaucuaaccuuauaaaaugaaaaauuaacauuuuauuggauaacauuuuauuugauacauuuuauuugacacuuuuuaauucuaguuuaucgauggucgacuggcaaaacuaaaugcaggaagggguuucucugauguauuugaagaagagaucacuucagguggcuuuuguggagguaaagacaaguuacaauaugauuauccauuuucucaauaacaauuuucuuggucuuugcacuugugucugauaaaaccuauuucauaaacaacuaaugauuuccuccuaaauauguaaugucuuaaauacauuuuucaucuuauaaaagcuauggaauuagcuuauuuugccugauaccuguuacucaaggcauuaaguuggccuccugaauuggcagcuguuggccucgauaaucucuuaauauugcuggaaauuaguaauacagaaauccaaucaacucauaucuuccugucuuuccuucugaauaguaguauucucugcuagaaaacuacuagugaugguuauuacugaguaugaauuuaagaacugagguuaugauugguaauacaauccaaaaagaagggucugaacaccaaaauucuuuauacauauuuaaguaacuguauuauuauuauacagaugucuuuaccuuuuugacuuuauagaucacugcagcauuaagaaaguuuccaguuuaccauuccauaaguacaauuaauccuucuaguguaaauguucaaauacuguuauaauuaucuaggcaauuaauaauuuacaaacugauauuuuugcacgauuguagugguguauagucuugacuugcagagcauuuugcuugaguccuugaaaugucguguucauucauuauuugcugagugcuuacaauguauuaggcacuguucuaaauauuaaguguacuaaauaaacaaaaauccuuguauucuguaucuuaguguguuaauuuuuggccugguauaauagcaauuuuuuaaacuucuuuguauguuuguuuugaggaaaaaaaacuucagucuauauguaaauaaauagaugcuggaauucagaaaugacacaugaaaagacaaaacguaauaaguacucaucuacacauuucacaaaauuuaacguuauuuuuaagauucauuuucccaccaugaaaauauagaaaccauugagauaauugguucauuaaaggagguacaaaugaacucaguaguugcggaccuuuaucugauguaaguguagcauuucauugaaagcauuuagcuuggggaaaaguuaguuugcuugacucagaaaguaagcugaauguggaaucauucagcuccuugcuuccuucaguucauggguaaaaauuuagcuucaauggaacuuuuguguuaaaauaacacuuuuuuacuucucaacucagacaagcaaaauuuugucagcccauggacaaguugcuuaaggcaucuauucgguauuuacauaacugcugucucauuaucuuuaugacccguggggcuaguagcuuuuauagaauugaagaugacauuuugugacaauaagaggcuagaacuaugauccuuuuguacaguuaaauucuguagucuuaaccauugguccagguaccucugaauagaguagagauagguggcuuuucuggugggagggcccacuaaaauuuuucacgaaaagccuuauuguuuaaaaaagauuaggagaauaugauuaccgauaaguaucugacuuagaaacugcugcauuuucaauacaacuuaaugcccacuacuuuguuguucuuuauuaaaaugaaaagguuuugaacucuuauuuuaauuugagagagccaguacuuaucuaaaaggaaagccuaauuugacaaauauuaauuccagugaguacagcaagaaaguccguuagaaauuugugccugucaagcauuauuuuuaaauuauucuguguuauguuauuuuauacauagacuuuuuuuguagaugaaaauaaagcaaaauguguuaggauuugaaauaaaaagaugacuuauacaauaaaaauuagcaguguucuaacuauuaauuagaagauauccaucuaucuaggggguguguguguguguguguguguguguguguguguuuauaaaaugguuccuagaggucaguuccaaacauacgucauucacauuacccuugugagaaagaagaauauaucgaugucaugaaauuaaccuguucuucaaagaaguaaacugaucuaacuuuguuguuuaucucauaauaauaguaauauaauaauugcucauauuuauugagcacuaauauguggcagaaacuuucccaggagcucuacaaauauuaucucauuuaacccucacaacacccaaggagguacuuccuuuuuuuuuuuuaauuaaaguuuuaggguacacgugcacaacaugcagguuaguuacauauguauacaugugccauguuggugugcugcacccaguaacucgucacuuaacauuagguauaucuccaaaugcuaucccucccccccccccucaccccacaacaggcccuggugugugauguuccccuuccuguguccauguguucucauuguucaauucccaccuaugagugagaacaugugguguuugguuuuuuguccuugugauaguuugcugagaacgaugguuuccagcuucauccaugucccuacaaaggacaugaacucaucauuuuuuauggcugcauaguauuccaugguguauaugugccacauuuucuuaauccagcaaaggagguacuuucauuaccucauuuuuauugaguauucagcucaauaauuuacucaaggucacacagccaguaguggccagagucucaauuccacaugugucuauguggcuucaaagauauacuguuuuuuauaguagauuuucuuaaugcaaaaacauucaguaaacaagaguaauacuuaacccuuuccuacucugauugaaucaaagcaaaauucucaucucuuuugaauuucuuguagauuuuuuacacaugaaguccuagaaagaccacuguggcagaaauuaacauuaacuaaagcuaagaaaaaauuguguuccuuuaagcaacaauaauuaggaaauuugagagaaacaucuauuuucuccucuuuaucauugcaguaguaguuuauacacuauuuuuguuaaugccgaugguuaugauaaaaugaauaugaauaugauggagguuuaucauuauuguggcucugauuaaaaauauacagugcaggacaaucagauaaggaacaucuagauucacauuugaaucuggaacuguaugguuaaagaaucugugaauacaugcauuuuuucaaaaacugccucugcccugugagcccucaucaggacuauuaaggaaauccacgucauaccuuauuccuucaugagacccuugcaaaaucuuccaccuuaacuuaaaaggaaaauuuuaacuuaacuuaaaaggaaugugugaagggaagaguaaccauggaguuuaaaagauaauaaaacaggacaggaguagaacaaaggaugcauuuaaguaaacacaguguuggucugugaaaaagcagguaagaaauauugaguaguuaagaacauauucuuucuuuaaauacuuuuuuuucauuuaaaauaaaacuaguuuuuacauuuacaucaacuuuaaacaggagaaauauuuucagauucauuuuaugaggaguaugugguuacucucuaucacuagcauguguuucuuccuuaguuuacacauauaaucugaugagucuuuuauuuguucauuuauuuauuuuuccauucuuauuuaguuuuacugacuaagguaucaaaggaauuugaagacgugguagguaauaucaguuuaguggcauuuuucuggccuuguugaacaauuuagaccaauuuacauuuugagauaaaugaguacaaauuacuggaauuuaagcaaguacauuugaggagaaagucuuggcauaaaugagaaauagauauuuuguccuuaagugugagaaaaucacuaguuuuauuaacaaaaauaauguuaagaauuuccucaguaaugccuauuauugccauaauccaguuauuuuaaaagaaggauucugagggauuucuuuagcauucaaauuaauuuuuagaauaacagccuuuuucuaacacugcuaaagaauaauguacuuuucucauaaauauuguggaaauaggaaccuuaaaucauaaaagcaguaaaauuuaaaggcacaauuagcccuuaaaacuuuuaaaauaggaaucuaccuaaauuguaccauguuuucauaacaucgaagcaagggacuucuucuuugccccuauacuaugaaauuuuagauuauuaccgguaauucucucuauuaaccuucuuuuucaggguauuagccuugagcagccccuuucccuuucaaauauaauugcuuugggugugauacagaggaaacucuguauaacuuaaguuuuaaucauauuuuauuuagcagucuuagagggaguuuuucagaguugaaggaauaaugaaccggggauuaaauuccuagauucuuauucuguuucaguugcuagccuugagaacauggcugaauaauacaucaucauagaaccucaguuuucuauuuuggcaaauuauuuauaguaauaacgaucauuuaugauauuucuucaauauacuauguaccauacuaaacauuguuuaaucguuaucuuucauccucacaauaauccugaaggacaaugacuauuaugcuuauuugaugaaugaagaagcugaugcucagccaaguuaaggaccucaucccaaaucacauccuucacaaagauagaguaggccugagcucuaaagguccauuggacuccaaagcccacuuccuucucauugaacugacugcuuauggcacuguuugccuauuuuacaguagaaaaguacaguucaaauaauguagauaaaaacaugcgaugacuuguacagagcugaaaauuagcuuuuuuaaauuccucauaguucuaaauaagacccuaaccuuucuacgauaguuugaaacuuuuaucauagcuaguuucuuugugguucagagguuuaaaagaauuguuuucuggauugacaaagguuacagaaugcuaaacugguguuuguuucuucuuccacuuucuuacauucauuuugggaaaauaauuaaaacacuuuccagaauacugugaauaauaacaaagucuuaaauaugugauuuccacucagccauuuuuaguagagaaguaaaaaguauaugaacugaugagagcuuuuuaauacagaaacauauaugaauaaucuggaugaauaaagaucugcaggguuuuuuuuguuguuguuuaaaaaaucuccuugagaaauaaauugguagaauaacuuggaauguuuuauuauuuuacaagggaaauauacuuuuaaaaguuuggucaagccaaauaccaccugaaacucacaccuuuuaaacagggcaacuuauuuuuacaaagguuauuuuagguaguuacauuuugcuguaguuauuucacaaguuaagaaaaaaaauuugucuucauguuucauccuccagaaaaggugcaaugcuguguucugaguagucagagauguuuuucagaauaaaaauuguuuuuugauauuucuuuuaaauuagaguaagauuuuaaauacagaagugaauccagagcuggacacuucuugccugauguugauuagggaugcaaagauaacagcuagaaagaaauuuuggggcugagaucauuuugucucuauuuuguaagagcaaggugauacaucuuuuaaaauccacagccacagaguagaggagaacaguauguuuuagggguucuuuguauuggauagugucugaguagccacugggacuuuaaaaaaaaaaaaaagagauggggucuugcccugucucccaggcuggagugcaguggcauaaucuuagcacacugcaaccuugaacuccugggcucaaacagugcccuggccacagccuuucaaguagcuggcacuauaggugggagccaccacaccaggccugggauuuuguuuuuuuauugugacuuuuuaccccugcgacuuagggaguauuuaagcuuuuaaacaagaagguagcugaaaucuaacugagaucaguugaugggaaagauuagguaaguuguauauguauuucuuuuuuuaccuucugauaucaucuuauugacuaaauuauuuaugaauuuggaaccagauauguugaucgcuggauuuuauuagaacuacuuuucaacauugcauauaaaauuugccuacuaaaaauugugcaaauacuaguucuugauaaauuuugguuuacagauuuauuuuugaucaaccauuccuggcaucucauuuuuauauauuccagggaacccgaggucauaucaacaaugggugcauacagucaagguaaucauaagcuuucaaauguuauucuuucacucuaauauaaauggagaaauguucagcaaaaguaugcuguuuauacuuaugcuguuuauuugaaauauuugaaauguuuguauauuuugucacauuuuaaauauucuuauuuuacguuuauaguuuguugauacucauuaagauaauuuuuaaauggaaaguuuugguccaaagauaaauggcucauuuugaaaagcaagauuuuacugccaaauguuguuuuucuuauauuauuuuccagaagaagaaauuaggugggguagaaggauuugauggcaauuuuauaauuugugguaauauaguuuuguuaauaugauuuuuaaauaugaaacuuucucccccagacugagacuuuauuugcccgauauuaaaacagcugauaaacuuguauuucuuucuuauuaagcuuuaaauauauucaaauuacuagucauauugcucaagucuaccuaagcuucaaggaagaaaugauuuuuaagugauguauuauaucaacuaaagaacaagguggaaaguguacauuuuguuugaaauuauuaaaguacauagaaacuugaaaacacugaacacugaacaugaaauaauuuguauaggucuuuaaguugugaguaaagcccuuuuuuuaaauaugcaacuuacuguaauacuuuguuuucaggauauuuuagcuaaaaguuuuuggaaauauguuucuguuuuucuuuugcagaaaggaggugcacuguucaacacagcaaugaccaaagcaaccccugcuguacggacagcauauaaauuuguaaguuuuuuugauauuuaacaauccuauuuaugaaauuauaaaacauuuuccuaggugauagacauauaaauucugaauauuuucuauuuuucuuuuaaauaaaccuaaaaaaaaauuaggauuaauauugaccaaagcaaauucaauuguuaaaauuauaacauugcaugcagaggguaguuucuuuuauauaaucuaaaaaugguucucauuuuauuccaaagcuaucggcaaaguugugcagcaaauugaaacaguuauugaugggguaccauuuuguaaaaugucauuauuucauuuaacaacauuuuacauucuugcuguguacuugcggcucaaguagaaaaaaaaaaagaaaaauauagcgaggucuuuucccucaaagaugcauugacuguuuauuaacauucuucagugagucuccaaggcaaguuuguccaacccauggccugugggcugcaugugaccuaggauagcuuugaauguggcccaacacaaauucuuuuuuuuuuuugagacgaagucucgcucugucacccaggcuggagugcaguggcacgaucucggcucacuguaaccuccgccuuccagguucaagcaauucuccugccucagccucccaaguagcugggauuacaggcacccaccaccaugccuggcuaauuuuuguauucuuaguagaaacgggguuucaucauguuggccaggcuggucucaaaccccugaccucaagugaucugcccgccuuggccucucaaagugcugggauuauaggugugagccacugcgcccagccccaacagaaauucuuaaacuuucuuaaaacauuccaagauuuuucuuggaauucuucuucuucuucuucuucuccuucuccuucuccuucuccuccuucuuucgucgucgucgucgucgucuuccuucuuccuucuuccccuuccuccuuccuccuucuccuucucccuucucucuucucccuucuucuucuucucuuuucuucuucuuuucuucuucuuucuucuucuucuuccucuuccucuucaucuccuucuccuccuuccucuucuuccucuucuuccuccucuuccucuucuuccuccucuuccucuucuucuucuuccuccucuucuucuucuuccuccuccucguccucuuccucuucuucuuucuccuccucuuccuccuccucuuccucuucuuccucuuccucuucaucuucaucuucuucuuuccuuuucuuuuuuagcuuaucagcuuguguuaauguuaguguauuuuauguguggcccaagacaauucuucuuucucuaauguggcccaaggaagccaaaagguuggacaccgcugcuguaagacuugcagaaaaaaaauaaugggaauaauaguaagaauaauaaaguaaauaauaaaugauaaaguaaaaaaacucuuuaauaugacaauuaagacccuucaaaacccaacccuucaugucuaguuccuuuucccccuacuccucagaacguuccauaucucugaagacacuuagcuacuccucauuucaugaaugugagauauucuccucugcccuuugauucuugcucaagccauuccuauuaauuggaaugucaguuucuuggccuuuauccaccuagucaacaccaguucauuuuacaggacuuaguucagacauuauuuccccugaaaaaauuuuucugaaccguacacaaaaaaagcuuuuauacauauuuuugucuucucaacccuacacaaaaauguuuauauacguauuuuuguaucuguaggaccuucuguuucaacacuuguuuugucuguguacauuucucucucaauacuagucuaguaacuucccaggagagaagcuaguguguuguguucaauaaauuuuuuaaaauucaauaggucggauauuuuauauuucuaaaaauauuuaaggcaaggguuuugauuuuguaagaauuugucuucaaaagcuuuucucgguaagugaguugaugugauugaauuaauaauaaaauaguauauuuuaauaaaaguuuagaacuucuguuauuccuugaguuaaaauugugauaugaauguggccacccuuucuguuuaaaaauuccauucaaauauuaaauuuuauaguagggaagcuaaucuauagaguugauuaaaaaauacagucccaaaauuagaauuauuugaucccuaaccauaaggccaaaauaagacaagguuaucauuuucccuuagaaaccucagccucugcguuuuuuuugguuguucuauggcuuuccuaggaaaccucucuggugguuuaagugcaguuuuugaagagauuuuuuuuuacaaugaaauaguacacaacuaccaugugaaaaagcaaaguaauguugauccuuguuucucacauucauuuaagauucuaaaaaugguuucacagucaauagcccuucauuuucuucuggagcaggcaguugaggguuuuuuuuaggcuuagagaaguuguauuguuuugccaaauaugugucuugccuuaauuucacucauauuuuucacaaaagcgcagcaaugaagcaaacauguucaaaacccuauucauuauuuuaaaauuuaucauucuaaucaguggaguauuuuauuuugaacucuucucugcaaggaaguaaaaucuuuucaaauuaaaaauucuauucuuugggccgggugcuguggcucacaccuguaaucccagcaccugggaagccaaggcagguggaucgcuugaggucaggaguuugagaccagccuggccaacauggugaaaccccaucucuauugaaaauacaaaaauuauccagguguggugucgugcuccuauggucccagcuacuugggaggcugaggcaggagaauugcuggagccugggagguggagguugcagugagccaagauugugccacugcacuccagccugggccacaaagugagacuuugucucagggaaaaaaauaaauaaauaaauaaauaaauaaaaaagguuucuacucuggaggauuguucccuaaauuaauuucaggugaauuaagaucuuuagaauauaccuaaucacuuuuuuaucauuuaucuugugaucauaucaucccugaaucaggagguuuggggcagguaagucagucauucugugaucuuuguaauuguuucuaaaacugaucuuuccagacugcucauuuucugaaauguguacucugaaauuccuucuuugaccacaaauugcuaugaauaaaacuccuaauuucuguugugugguauaacagaauuuacuuaccuugguuuucuauagauaguaaauuuuucaaaaguaggaaucauguuuuuaccucuaucucauuuauucaauaaauuauuugagugccuaucgugaacuaggccuuauacucaucauuggaguuauagcagaacaugaagguacaguaagagauacugucccuacuuuuauauuuguuuuccuaucacuuugcucugcacuuugaacauacuacagaaauacugaauauguguuugucaaagcaaauaaugauuccauccuguucuuauaacauuuuuauacuuauuuuuauaguuaaaauuuuuuuuccuaugcuuuucaugcauauguuuuucuaugcugauaggggccauaaagaaaacuagaguuaucauacacacuuguauaaauuuaagaauaacagcaaaguggaauucauauuuuauuuggcuaaacgguuuucagagucaucuuucuuguuaggucuccauuuuaaauuauuaccaaagccauuugcuuggagcauuucucuggagaauacuugcauuguguuaagcuucaaauugguaaguugaaaaggauagagagaaccuauauccggccuuccagguuaucugaaggaagucagaggaggacaugggacaacaauuauuuuaaugaaucagugcacuauggaauuauagaaccauggaagagacugacacuaguagcuucaacucuguauacuaaagagcaucugaaaagauuagugugaucaaguggauucgaggauaguuagcuagauuacagucucccugagucacuuuccuuauuuuaaaaugugaucauaguaguacuaaucuuacagaauuguugugauaacuaccuaagauaaugcaugcuaagcacccagcacacagucauauauuuaggaaacaaaauaaauaugaauuccuuuucuccucuuuuucaccuuugccacugugaguaggaauuucuaguggaacaaaggcuaaggcuuuugugaaagcccccaguugucuuuaguuaaguuauaccccacaggaaucacagcaggaugugagaaacucaaaugcuggggccagguucccugugaaacaugaggauagcuuuaaauuguuaaaugacuuuuaaguuuuaccagaaaaacuauauaugaaauaccauuccauuaagauggcucugcuaauaaaauucugugucugccuguaaaagcucuuaauaaagcuuuguaaaauugccaaaguuuuuucaaguucaagcaucuacccaaauaauuugcugcggggauguacuuucucuguuccuccaguuuguuacaguuuuaacauuguaaucugguuuauuccuuuuguguucuuuauaguuuaggaaacaaaauagucuaaauguuagccuuuguaugauacuuguauacaaagaagagacuaaugguuuuaccaacugauuuagguguaauaaaauaguaagugauaugcguaucccugaaaauagaauguuagauuauaaucuguucuuuuucuaaaucauaugaauauuuaguaauugucauuaaauuugaucuuguauacuuauucuuuaaaugguaauggaaccauccugagccaggcacauucauuaucauuuucuaggcaaaaaaucaugcaaagcugggacuaaaggaagugaagaguaaacuaaaacacaagguaugucauauucauuuuuuuccauuuuaccuugauucuuguauuaguuugaaguuuauacuuccaaauuagaaauuuguguuuuuaaugacauuugaaauaugcuuagcccuuuguucaagaauguauuuuuuauaacaagcccucuggcaacuaucugcucuucuguaugcauucacugaauaaucucuuuacuguuugaauauuuuaucacagaacuauggaaaucuucaaagauguuuuaacaggauguauguuuucauaaaguuaauugccuugauaucacaauugaaguucuugcuuuaugcuaagaauauuuuuaaaagauaucuuuuguguagaaguaacccaggaaugccagcauuuguuuugauagucucauuccaauaguaguuacuuuaaaaugaagaauguucuuaauuuacaaaauauuauguauguauuuaaguuaugaauauugcagauauguaaauauguguauauguguguugauuuuaauuuguaucuucacagauuuuauuaucaguuauguuuugaauuuuuaccuuuggagaaaacauacuacuuaaaucuuccaguguagugauagcaaauuaucuuuauauaaauuuuauucagauuauucaaaguaaucaaagauuuuuaauuauuuuuauuaaauuaaauuuaucaguauaaauaauuaagaucauuaaccuuauuuaauuaaauuuauuaauuuugauuauagaaaaaugcauuuucuucuuaaauagauucuuuacacuuaaagcugaaguguuauuuugcuacuuguauguauaucagauacuuuguuuauuaaucuaauacguuaguaauaaaaggaguacuuuacaauuauugccuguauauuuuuucauguguaggaaaaugaagaagauuaugggaccuguucuaguucuguacaauauacaccaguuuacaaauuacacaaugaaaagggaggaaacucagaaaagcguaagcuugcucagguaaguaagguuauuuacccuucauucccccacauucucaaauuauauaauuccaguaaauuauuuaggaacaauuuggauccacuaauuuuuuaucuuauaugaaaaccugcaguauuggucaaggggaggaguuaguggaaccugggaaggcuacaaggggauugagagucaaauguuucagauaucggucucuacaugcuuuguuagcccaugcccucauagaucucauaguccagugaaggaaaagacaauugaaugugugauucuuauagagugugaauagcuugaugauaaacuggaaaucauaggauuccuuuacuacaaaaauaaaaucaaucuuauacauggguauuuggccauuaaaauagucuauagaaauuaaaaucugaacuacuauaagucuauccuauucuaaaguuagauuauuuuauuugcuauaaauaguuaaagcuucuuuuuauaugcugaugcuacuuaaaauauuguuucaagugacugaguguucagaaucauagcuauaaguguuccugguuuuuuuuucauaaguacauuuaugaaggcucuaacuaaacaaaauugguauauacaaaauuguaucuuaaguggccuuagaaaacuagcuucaaaaaagaauucuugaguggacuguagcuacaaaauuacagaacuggaaguggcugcaaagcuucauuuauaacaguugccaagguuugcagaugagaaaguugauagcuagaauggucacaacacuugccauaagucucauaacugaucaguggcagaaggaggcgaaaagccaucucugaugcucaguuagcuuuccuggauagccaggcaccacagaaguauacauggccauaaggugcuuccagggucuuugucuuugagcccauuuugugcugcuguaccagaauaccugaggcuggguaauuuguaaagaacagaaguuuauuucucacaguucgggaggcuggaaaguccaagaucaaggcacuggcaccuuaugaggcccuucuugcugugucaucccaugguggaaggcagaaaggcaagagagaugagggggccaaacucacccuuuuauaacagcacuaaucccacccaagaggguggaacccucauggcccaaucaccucuuaaaagucccacuucuuaauaccauuacaauggcaauuaaauuucaacaugagauuuugagaggacaaaauucaaaccguaacaacagucuuuaagaaugggaaaggauagugaagcuguacugaaacucuaguccuuuguaaaaaaaaaaaaaaaaaaaaaaaaaaucccauuaauucagucauucaucaacacuauaugccacacacuuuucuagauaccagguauauauaaaaggaaaacacaaaaauucucugcuuucaugggacuguuuuuguaacauacugaguauuuccucgugauuauucauuuauuaagcugauauuuucacauuagaauugugugauuguagcauacugauagucaguacugauugucuguucuaaaauaagcccuucaauaaaauaauuauucccgaagucagaaaccuuuucuuguuacugcuguuaacuggagaacauuuauuaaugugugaacuaauaauggauuugcuauugauuuuucuguuguuuuuuuucccaccacuaauauguucaauucuugucuguuuucaagcuuuaacaucucaaauacuguuguaaaauguuuauggcuuaauauggagcauuuagguuaucuuuaccauggcgaguagauuuucugugaaaacgaauaugagaucuuuguuaccuauaggauacuuuaagauguaaaaaaacauuauuuauauuggagaaacacauuuccuaaauaucaguuucaaauuacgacaacuacuauuagcuccucauauuuuaauuaauuuauuuuucauuacaaguugaugguuuauaauuauauaaauuuauagggucuaaaguaauguuaugauucaugaauguaauguggacuaauuaaauaaagcuaguuaacauauccaucaccucaaauacuuaacauuuuuugcgggaagaacauuugaaauuuacucucuuagcaauuuuaaaauguacaguacucuguuauuaauuauauucaccaugcuguaaaguagaucuuaaaaaaaaauuuuaaagucuucuuuccuuuaacaugcauagcauuuuuaugauaauguaauuaaaaaauacauuacugauuucuguuuuuguuuucuguuaacuucuagagacaauuucuuuuuuuauuauauauauuuaacguguauaacaugauguuuugauauacauauacauaacgaaaugauuacugcccucaagcaaauuaacacaucuauuaucuuaccuguuuuuuugcaaaguaagaacaccuaaaaucuauucucuuaguaauuuucuaguauacaauacaauauuauuaacuauaguccucacacuguacauucugauagagaaaauuguauuagguuacggaaaaccuuauagaauaauggguuccauucaguguauacuuacacuaagucuucagggcuacuauauauuaucauuaauucaguuaucugcauugauuagcauuuuaugguuuacaguagacaugacagcaauaauuauaacaggaauugagaggaguagggcuuauucuuuaagaauucuaacaugauuuuccuaccugguguauaagaauugauuaaacauacauguuuagaauugugaugcaaauguugauaauaucugaauaacaaucuuuaguuuucaaaugauaaauaucugaguuucaggaaacauguauacccaguauguauguuucuuuguauucguuaugugucccauuauauaaauagguaaauauaucuguguguuguauguaucuuuuuuuuuuuuucucugagacggagucuugcucugucccccaggcuggagugcaguggugcgaucucggcucacugcaagcuccgccuccuggguucacgccauucuccugccucagccucccaagcagcugggacuacaggcacccgccaccacgccuggcuaauuuuguuuuuguauuuuuaguagagacgggguuuauguuagccaggauggucucgaucugcugaugucaugaucugcccgccucggccucccaaagugcugggauuacaggcaugagccaccgagccuggucuguguuguauauaucuuaauagcaaaauuuuuaagaguucauauccugccuacuaauaucuauuauaauuuaggauuuugcuugcauuuuuuucuguaauugaaauuugauuuuuuaguuuuagauucacauauguauuugacaaagagcuaaauuuugggcccucuagcaauuguuuucugcuacauuucacccuuaauuuuuuucccaaggcuuccagaguccaugcuaucuugcauuacuaauguuacuucuuugaauugauguuggguuguuacugcuuugaaaugauagccaauugguggccaacaguuuauuuauaaaagcagagcggguacguuuacauugaaauuaucaucaaauccuugauuuuaauuauuuaguuuuaauaguguuagcaaacucacaaauuaaauaaaauaauaucaagccauuuauuauaaggauauaggcauucuuuaggacaucuaauugcaggaauauaucuaggcuuccgguaggauuagaacuaggaaauggaaaaaguaaucagggaagaauaucagcuucucucccuacucaucucaugucaucucaucucaucucaucucaucucaucuaucucucucucucucucucucaaucucucucucucccucucucccucccuccgucucucucccucuuuuccucucucccucucugucccuuuucuucuuccucuucuuuucuccaucuuccucccucucccauccccuguuccuucauuucucuccuccccucccacucccccuuuaaugcuuggccuguucuuucugcuuauuuguucauugugcauucuguagacugguuuucucagcuucucuguguccuugacacagaucuuauaggcccucaguugaagcagccacuagaaauggauaauaauucuagaauccaguuccuuaaggaagaauguaaucagcucacuuggaccaggcauuaauucuucguucaauaaacuccagccagagaggcaaggagaguaccauguuaccaaggacacaggaagggcaguagaggugaguggggugaacaggggaagcaguucucagagaagugguuuuaaggacugugacaauaucucacaagaugucuacuguuucugauugcuucacacuauuuugcuuuucaauguuuaauuuaccuacaguuaguguggucaaaacauauuaaaugaaaaaucccagaaauaaauaauucauaaacuuuuaaugacaugcuguucugaguauuacuauaauuguucuuuuucaguaucaguuauuguuguuaaucucuuacugugcuucauuuauaaaugaaacuuuaucauagguauguauguuuaggaaaaaacauaguuuguauaggguuugguacuaacuguacuuucaggcacccagugggggucuuagaacauaucccccguggguaagggggaacugccauaaugcuauuugccaaaaagucauauuugcaaaauaacaaaaacagaucugcauuuuuaaaugccuggaggcuggaaauuuguaccacaaaucugggguuugauaaguuuaaggucagccuacccuaauggauugauguugccuucucuccugagaauugagccacuuacacuagcaaaaaaggcuacagguggaaaugaauuuaggguacuauauuugcacauugggcaaggaaaucaaaaggcaucagccauagucugcugccuuuucuuugcagucugauauugcagaagcuucuuugguucacuuuucuggagauaauccagccccauugauuuaagugaaauaugauacaguauguuauggaagaggcagaaagcugaugcuagagccacgggcauacugucgcaugaugauuaccaaauccaggaauucucuuacuccuaacucuccaaguauaauaauauugguaucugaguauauuaagauuuucaacuaaauauguaauguuucuagaaauauuuggaugugguuaaagucuaguuaucagcauguaugucagagaaacuaaugucuauucauuuauauucuaccuauuuccaaaaauacuuuaauaucuuacaaagaaccuuaaaaagauuaaacuguauuaaaauuagguaaguuuuaaggcagagaaaauguuaaauguaguuaagaagcuguuaaggccuauucccugcacagccaaaaagaagagaaaagcacagcuacaugauucauaauccgcaaaguuuugguuuuuaaaaaguugcuuaugaauuacccagucauuccaaagaaauagguuagauguuuuagauccacaaaucuuuucagugucacaagaguucacauucugguggagguaccuagcagagacaaagacuuuuguuuuggaagacagaaauuuaguuuucuucauuuagucuuuucugugcuguuucuauuauuugaaaugcucagucucauuaauaccucucucaaagacagcuuaguuuacuagcuguugaaccucauuaaaaaaggugaaaacagguacaaguggaaauaauauacacucuuuucuuccuacuguaaggcuacugaagaguagcaucacugucauguuagaacuggcucaaguauccaaauucuuuuaaaagauuuguuuugagaagugucuguucauguccuucgcccacuuuuugaugggguuguuuguuuuuuucuuguaaauuuguuugaguucauuguagauucuggauauuagcccuuugucagaugaguaggaugcgaaaauuuucucccauuuuguagguugccuguucacucugaugguaguuucuuuugcugugcagaagcucuuuaguuuaauuagaucccauuugucaauuuugucuuuuguugccauugcuuuugguguuuuggacaugaaguccuugcccacgccuauguccugaaugguaaugccuagguuuucuucuaggguuuuuaugguuuuagguuuaacguuuaaaucuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucagauaguuguagauaugcggcauuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggcaaugcgggcucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguguccucuuuuauuuccuugagcagugguuuguaguucuccuugaagagguccuucacaucccuuguaaguuggauuccuagguauuuuauucucuuugaagcaauugugaaugggaguucacccaugauuuggcucucuguuugucuguuguugguguauaagaaugcuugugauuuuuguacauugauuuuguauccugagacuuugcugaaguugcuuaucagcuuaaggagauuuugggcugagaccaugggguuuucuagauaaacaaucaugucgucugcaaacagggacaauuugacuuccucuuuuccuaauugaauacccuuuauuuccuucuccugccugauugcccuggccagaacuuccaacacuauguugaauaggagcggugagagagggcaucccugucuugugccaguuuucaaagggaaugcuuccaguuuuugcccauucaguaugauauuggcuguggguuugucauagauagcucuuauuauuuugagauacgucccaucaauaccuaauuuauugagaguuuuuagcaugaaggguuguugaauuuugucaaaggccuuuucugcaucuauugagauaaucaugugguuuuugucuuuggcucuguuuauaugcuggauuacauuuauugauuugcguauauugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuugguugugucucugccuggcuuugguaucagaaugaugcuggccucauaaaaugaguuagggaggauucccucuuuuucuauugauuggaauaguuucagaaggaaugguaccaguucuuccuuguaccucugguagaauucggcugugaauccaucugguccuggacucuuuuugguugguaaacuauugauuauugccacaauuucagagccuguuauuggucuauucagaagacauuuaugcagccaaaaaacacaugaagaaaugcucaucaucacuggccaucagagaaaugcaaaucaaaaccacuaugagauaucaucucacaccaguuagaauggcaaucauuaaaaagucaggaaacaacaggugcuggagaggaugcggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaugaguauaaaucaugcugcuauaaagacacaugcacacguauguuuauugcggcacuauucacaauagcaaagacuuggaaccaacccaaauguccaacaaugauagacuggauuaagaaaauguggcacauauacaccauggaauacuacgcagccauaaaaaaugaugaguucauauccuuuguagggacauggaugaaauuggaaaccaucagucucaguaaacuaucgcaagaacaaaaaaccaaacaccgcauauucucacucauaggugggaauugaacaaugagaucacauggacacaggaaggggaauaucacacucuggggacuguggugggguugggggagggggaagggauaguauugggagauauaccuaaugcuagaugacacauuagugggugcagcgcaccagcauggcacauguauacauauguaacuaaccugcacaaugugcacauguacccuaaaacuuagaguauaauaaaaaaaauaaaauaaaauaaaauaaaaauaaaugaaaaaaaaaaaaaaagaaaaaaaaaaaaaaaaaagauuuguuauguggugaauuuaauugccuaaaggcaaauuucugcagggaccuuugugauuuuuguaaucuagauaauuuucauguuccuacuacuauuuuucaaacuucaauuuuuauacaguugaaauaguagaaaaaugcccuagagcagccucagaagaccuggaaaagauggacaguuuuuugauaacagugaggcugucuguguauguuuguauuuacgugauucauuuaaaacuuccaacaauccagucagggcaagaauuauuauccgcguuuuucagauuuagaaacaaauggagacuaauaaaugugcccagaguucuacaaguaauaaauagcagaauaggaauuaaaaagcaggcagacugauucuagaacuuagguaccuaaccacuauugucaugccuuuauguuggauggagugauuguagaagagggauaguuagaaauaaggauauggaguuuagagccagacagaacuuaacuuugaaaaagguacuaggauuuaacauugagcaaaacaaaauaucccuaagccuuaauguuuacauuuguaaaauaauaauacaaguuauuuucccaggaugcuauaggcauuauagauaauguauauaaaauaucugccacauaauaaguacuugauaaucgguagcuguuuguuuaugguuaccauaucauauaucuugaacuccaggucucuguagcaguggcaccaucugauuucucucuugguaguuauaguccaggaucacuaauaaucucuaaucacuaaaguaguuaggacuccuaaaauuauccaucuucauucuaaguagggaugaucauagaucccaguuuaugacuugaauagaaauauaaaacuuauuguaccaagaaauaucuuauuuauaaguuuagaagaccuugaguaugucauuuuauugugaguaaaauugaguauagucuucacucauccuauuccuaguccauuugauuauucauuucagaaguggaucucaguugucuaaagaacuuuacauuuccaguuuccagcuagacuugucagugagagacuuuauuuucaucuguuuuucaaaagaugaaaaugggauuaugaucauuuaaauuccaagaauguauuuuaaaguaaaacauuaugaaguuuuacaaucugugugcuguagaaaagaacaaaguucuaagccuguguuuuaaaccuguuuuccauuauuuagcuuaucuuuggaauagauugugaaucuauaguccacauccaacaaauaguaauuugugugcuggucugcuaauuaguauggcuguugcucguuuuguugaugaggcuuaaauaaaugucaaggguacagccaugaagaucucccaauuaggcuccacauuuguaaaacccaacccuuuucccuuuuguguaaagaugacaguuccaacagcagccccagccuaacaggacuccagggaaaggauccuucucugguuuuauugaaaacagggccagugaguccacugagaauauagccacuggucauggugcagaacagucuuaauccuauguacuuauguucuuucaucaguuuuauuuuagaauagaauacuggagacuuagugaaaaauauaagauaacauaaaucuauaaucugagauuauguuuaaaaauacuuacuuguaaacauuuacuaacauuuucuuuucuaagaauaagaaauuucuuuaaauaauauguaaaaguuauauauaucugagauauugcuccauauuagccaugcguggcuuagucuagcaguuauaauguguauguuucugugugucuucaugagacucacagacaccucaacuauacuagugaacaagcaugagagcuuagcuguauuacaagucgacauuaacagauggauggcccuaagcaaggcaaaaucaccacaacaaaaccuagggaaagugggggacugaagcuuuuuguuguuaagcccuauuaaaacccuggcacacgcauaugcacacacacacccacccacccacacauacacaugugcgcgcgugcacacacacacacacacauauauauacacacauauauauacauauauacacauauauacauauauauacauauauacauauacacacacacacacacacacacacacauauauauauauauauauauauauauauauauauauauaucacucuuaacuauuucaugucgggaaaaauagcaauauuuuuagauuuucaaccuccaguuaauuauguaaaaacagcaugagaaaaugaguggaaaguuauuuuucauuugcagugugauacaaagcaguaugcuuguugauaaauacucucacuuggaauguuacccaaauaaaguguuuacaaauagaaauauguuuaauagucauaauuucuacuauuagaccaagcacuauuaaacugguggacguuuauuuuacuuaauauagucacauacagacuaauaguuuugagguauaaagaguuaucuuuugaaugcacaaauaagaauuuuuuuuuuuuuuugagaugagucucgcucugucacccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaucucgugauccgcccgccucggccucccaaagugcugggauuacaggcgugagucaccgcgcccggccauaagaauguuuuaagcauaaaauauaaucugugauuuuauauuuuuauccauuauacaaggugauaucacacuuagaaaugaaacuuuuugucuuuuuggaucuuuauguauuuaaugguuuauaaaacauucuaauggauuuguggaacauagcacaauagcuaugaguucauuuuauaguugaugaguaacauacuuuuauauuuuaaaauaugcucagaagucauauauacuuuuaugcaugcagagacuuacaaguaaagcauuucaaagccauguuuugauugaacagggacuuaagagaaaucucaauauguuagcaucuuauuuaaaaauaugagcaaucaaauaguuuauuuuuauauauaauaaaugucauauuuuaaaaugcuacagauguaauuuucugugaaacuuauaagaaaagaauaucuuagguucucuuaaauuacuuaguuccuaagcauaagaaaagaugggauguccacaccuaguagggugugguuuauaguauuguauuuaugaaacacuuucauucauaggaauucauuggacucugggaauaaaauaaauguaauuaaauacaauguuucuuguucggaugauguaauagauuucggaaaacuguauacuuguugggaucuuuggaaaaauacuaucuauugaauaguuugccuuacuggucaggaaagaaaugguguacucaguguuuauagaggagaguaaccacuuacuuuugaccaaaaaaaaagugauuguaaaucaaaaaaagaaagauaguuguuacauggggugagaguggggcagaaaauuagaaagaauacuuuacuuuguaaaauaaacguuuacaaaauaauacaaauaauugaaucaaaucaugauaagcaagacaaucuuuauuuuuaucacuguguaauuuggcucaguauugagaacacuguuaucaagcugaaauguuaaaguaauaagaaaauauuguaaaacuucaagcgauaggccaggcacagucgcucaugccuguaaucccagcacguuuggaggccgaggcaggcggaucacuugaggucaggaguucgagaccagccuggccaacacggagaaacuccaucucuacuaaaaauacaaaauuagccaggcauagugaugcaugccuauaaucccaacuacucgggaggcugaggcaggagaaucacuugaacccgggaggcagagguugcggugagccaagaucaugccaaacucugccucagaaaaaaaacaaaaacaaaaaaaaaccuucaagugaucaacucuuuugaaauaaguuaagugaauguucuucuuuuaacacacguccauguccauaaaaaaaauacugccuaaaugaaaacacauuuuagcagucagcguuccaaagauauauguagacuaauuauauuaauacuaaugucaauaauuuauaaauugaucuuuugaguucacuuugaaaaauacacucuccauauuguuaaugugacagaaaguuauuuuucucuuuuguuucucuguugaaauaauauuaauuuccaaaauauuaaauuugauuauaauuaaauguuuguuuuaaaucaguuauggauuacaagggugcccucuaguggacauuauguaguacuuuccuuaaaagaagauaguuacacaaaaaauuuuuagcgccuuucagaauagugugucuuuuagaaacacaacagaauacacauugagaccuuuauauugucauaagauuauucaagaacauaauucuaucaaauaaauaauucaaaaccagcuccuuucaauaacuugcuuggacuucauuuuuaaaauguuuagcucugcugaacaauacuaguauauuaauaacauauaauggaagauaaucuuuuuaugugaacauguucaguauauauuuugagacauuuuaaaguugacauguaccuuaauguuguaauuuuacucuucaaauuuauugccagaaaugacugacauuuauuacaaugucuugaaacaaaaacaaagguacucaauuucuccauuuaguaaaucuagugaauacuaccauucuagacuuuacaucaguaaucacaucauuaauauuuuuuccucccuauauucuguccuauuugacuuuguuuuuuuucccuguugccuuuuuuguuuguaaggggucuugauuaaauuaacaacaguucucuauuccaaaagugccuaccuuuuguaaacaaauuauuauuguuuuccaagaaucuuaggauaaagaaaugcugauuuucuucugguuuugaauauagagcugcuuuuaaaguuugucagagaucaaugcugguguugaugaaaggaaaaaccagucuuuucuuuguagggcuacugcugcugccuauuagugucccccaagagaaaggaauuuucagaaaugucaauagaucucuaacuauggggguauaauaggaucuuauaauuugagcuggauuuguaucugcuacacauuguuauauuuccuaacauguuuuccuaacauaaaacacuagaauaauacauaaauaucuuaaguuggccugugcgccuauacuaauuacaaaauaggacuauguuuuucaaccuucucugaaguuucuuuauggcuuuucuaacauaugaauauaauaucaguuauuucacagaucuguucucuuuuugccuuuauuagugucuuugacguuuauaguaaaugcuuuugaaaacuaguauuauuugauucugacaccaaaauauaauugcaauuucuguuaagaccuuugauucauuuaacaccagaagcauuuuaauacucuacuuaugugugauuccacacauacacauuuauguucauuauauauuaauaugguaaaucugagaaauaaaaugcagcuauaauuauuuuacuaacaaauauuuuaacccuuagcuguauauuuuuugaaaacauaauuuacuaaggugauugaaaauaauaugguucuuuucuucaguacugacuucuaaauuauuuaucccagcuagaaaagucaucuucacauuaguuagugagaggaacugaauucugugucuuacugauaauacaguagacuugucauguauuaagaaaccuuuuuaaauguugaaauauugaaacccugucaacaaaagugaaauugcaaauagcuuaccauuuaucaaaggguuacugacuuauuuauuuuguuuugagaauacuauuuaauagucuuauaaaacuuguauuugcacugaucaauaaucuuuugguccugaaaaguuagugcagggucuuugguagaauuugcauuuucaaauauuaaagaccagaaaaaaauaaugaaacaauguauuuuaaaaauuuaaaauugauauaauuacuuggcauaugaacuaucuuuaaaaguuggcuaaaaguauuaacaguucacaaccauacuacauauaaacacaggugaauaaugagaccuccugugaauacaagaccuucuuucuaccuauuaacacacuucagugagagacagucuuuuagaaucccugauagagugcugccauugaauggguuuuuauguaguuucugauuaacaauggggaaaugaauuauaaacuacuguguuucugggaucuuuuagauagaaacuaaacuuccuaaucuguguucaguaaaagcagucuguaaaggggucaguucugauuucucauauucucucuaaaaucuaauaugcagauuucuuuagucaaauucuagaacagaccccaacuuagcauuaauaagcauuuaaugcauugugaacauaauggacauaccauaauggagagucugucuaauucaguucaacacaaccaguaucuagcgugugcugguuuacagcuuucgagauuguauaccuccucugaacaccuacuuugugcuaggccugcugaucuagagcuuucaagaucacuuaucuccucuuaacuuacuaaggaccauuauuuacaaauucagaaagacuuuacuucauugauguuuauuuuuacucuuccuuuuuacauccaaccaucacccucaucacuuaauagaaagacccccugcgggaauguaaagauuccaggcuuuguaguauaagagaucaggaucagaacagugugccgcuuggaugguaugugaacuugaguaacuuuccuaacuucucuaauccucuuagcccucagaucuauaaaauauugauaauuauauccacuuccauagaguuauugugaagauuagaauuaguguagugacagaauuuguucuuccagcagucaccagaaguuucauaaauauuaguaauauuguuuauauccugucaacuuuuaacaacaacauaccaaaaaaaaauuaaugaaugccaacuaugcguugggagcagaaugaauuagacugguuucuaauaucccucaguucuuggaugcucuguuuuguuucuucuuguugauuuuuuuguuugucuuauuuuuccugcucucuucuuccuuuguguuucauuuugaauaauuucuauugaccugucuuaaagagcacagaaucuuuccuuagucuuccaaugggcccaucagaagaauucuucaugucuuacaucauuugaguuuuuuuuaucacuugacuuaaaaaaaaaauagauuccauuucucugcuaucguuccaucuauucaugcauguuguccaucuuuauuuuucuugcuuuuucaugucuuauaauucuuaauugaacaauggaccccauguauagaaagaguuaaacagcauuuacacccagaaauggguagaaacaguuaaauaguauuuacaccuagaaacuggcaggcucuucuucuaucaugcuguuuguauaagaggcugaguccaucggaaaaugaacuggauuuugauuuuguugauaucauugccuguaaugggcugcuauuaucuugugcuuagaguagagucuucuaaagaagguacuggaaagcuuucucaguguucuugcuucacucugagcuaucagcaguccuggaaccccugagcuauauagaggcuuuucuuucaauguuuuugccccuccaaagcaguuaacaucugugacuaguuaguugauccuagccuuauguguucucuaugcuugucuuaagugggccaugcgcccccgugccuuaggagugggacuuucuuagcauccuuccacuuucuuuucauggcagagaaacuuccuuauaucugugauuggucuuagguggccgaggcuuuucugcccugcucagugguaguagaccucugcuugguaucaauauaggauucuguucuuaagaaggcuucuuauucuucccuagggcagauaaagguuuuacuucuacauuucccccagcagucuugggaggcagugaguuugucagcaguuuaaggcuuuuguuuuauauaaaugaauguccucaaaggucauugggacuucaugccugucccugugcagccugucacuuccugcaagccugaaccaccaaggggagugcuuuucagucuccuguacugcucccaauuuuucuuaugagcacgagguaguagaguuaccucaauuggaaauaaaauuaaagaaauuuacauauggaaaagagcuugcgugugcaaacucccccugucuuugagacgcucagcuauucuaagcugacauguuagcccaugguuggccuuuaagaccuuauugacauuuuagcagauuuuuuucuuaccuguuuauauggcagcuaccucuucccuugugcuuugccaauggugaaauuaauccugucucucaucucuccuuggaggagcuucuaauauaugaaauucaguuuacuugguugacuugcaacacaggucucauagguucaacaaaaauuaugauuuuuuaaaaagauuauccagcuuuuucucauuguuaggaugggagugacauucucuugcagguuuuaccuucuaaguugaaguggaagugauauuagaagcaaaacaaaugaaaagauaugauucuuagucucaaggauuugguaagagaggaauguacuuaaaauuaaacacugccuuuauaauggagaauauaucagaugacaguugagugguagagaaauaagugaauaaaacugacaaggauucugaaaucacuauggacugggagaauugguaaaggguccuuggauguguuacggccacaucagaaucuuuccuagugaccuagucucacauagcagucaccugcucaaggaauguaauucugaugcuuguguaaaauuuuguguccuuagccuaauaauaacagcccuuaaucaacugaauucaucagacuucaccaaauacguaucuugauaaucuuccaguuugccuuuuugcccugacacguauguuuucagcauauuucgcaaaguauguucagcucuugucucuucauccugacaucucaccuaccuggaacauuagcacucuuauuauucugaaacuaccacuugccuuaaaaaaugagauuuauagcuugccauuuuuagagcuagccuuucucaggcuaguucuuggacauuuauuucuucugggucucucuggacuuauuuaucuagcauaguuaugaugaaaacaguucuguucaugagucagaacacuuggguuggagucacauucugucacuuaugauuuaccuugucuugcccaagucacuuugcuuuguuaaucuuuugguuuccuaauauguaaaauagagaaaauguucaccaaauuuguuguauaguagauauuuaaaugaaauaaaauacaguacauaaaguagcuaacacauugaagcaagucaaucauggguaagucuuuuaacucuuuaguuauuaccuauacaaauuaaaacacaucuuuuuaaagcuuguuuugaauuauaaacugccaugcauuuuaagaugucacuauuauaauuauacauuauuauuuaauuuauucacauauuauuucaugcagguauuuuuuucuuaggcugcaaaauacauaagcuuggggauuuguuguagacuuuagauaagcaagguaacacuucuggaucucaguugccucaacuguaaaauggaggguaguacagauuguaccuacuuucaaaaaauuuauguauuacaagcaucuuaauuuucuuaugucuaaaaaguuauauuuucucauucgucugccuauaucccuuauuccuuccccucccaaaccccaggaauuuaaauuuacccugcauuuugccuuuuuaauauuugucugccaccuggugaucaaaaugguaacugcaagguuaacagucuccuuggugcaucaggggagugauuuucaucauucuacuuucugauucacuuucuggaaaccauugcagugaaaagaaagauuuauuuugcuuacuguaacgaaacuaaacuuauuucuugagaucuccucagacauuaaguucuaugauuuugugucuugguccuucuaccucugucacauuuuguguacauuuucuuacauuuuuuucuuucauauaaaauacuuuuccuucuugucuuuaccaguauauauuuuuucacuuaguguccaccuguagggucaguguuucuaguagaauaucuccucuaguaaguuguauugcaugcugauagccuuuuucauuaguuuaguaccuuuucacauucuuagcaagcaucccuuguuauacgaauguucacuucaugaauuuuuacauauauuagauguguacuugacauuuuacauuuucaggggagcaaaacuuuuacaauuauguguguuuaggcccuaggagcagucuaauugagguugugugacauccaauuccccauuuuauucuuaauucuuuguaucagaaugauauaaaacuuugcuuauuuuguuuucucaugauguauuuuacauccaaaaaaauguacccuuguuuugcacaguacugucuuucaagagaguuacuaauuugcacagcaucaacaugacuagugaaauaaccaguguuaaugugauagcuacaccaggucuguacaguucagaaacuucuauaccuucuuauuugaucucagaauuuaccgauguuuauaauauguaguuacaguuauauuauuagcugacuggaccuauuuuuucauuauuuaggaacaucaacaauuugacacuacuuaucaguauuaauggucauuuaauguaagauuuucaucuaugaucaaaaaguuuaucaauuauguucauacaaugaggaauaaaguuuuuauuuauaacugcucuacuauauguaguauuuuggcauuucacccuauauuuuuuaagugucuugagaaaagggaacaucuuuuucauuuauuuuguuaugcuucacagcauggaaggcaguaguaugcauguaauaagugcuuaauggauguugaagugaagagaugcuaagaacugaaagaaaaaugagauacagcuacugacuuucagggaauacgcaguagcagcuuucaguagguucucaauaaauauuucuugauuagauggauuucuauugcucuucauuaucaggaccuguaaguccagaggcuaucccaugccugccugccccuacuaaauucucaucucccauacuucccugcuaaaucuaugauuucccccaccuuacuauuauaaucccccuugaauuuaaauuuccagcuuuugccuucuuaauauaugucugccaucuagugauuaagaggauaacugcaagucuuaaugggccccuuaaaaaaucccauguaccaacauaagccccaauccacaaugcaccaauaguuaccuuucauuccuuaguauuugcccugauugucccaccacuggacauuugcacauauugcuacaucuuccaucaucuaacuaaccuacuaacuuuucagagcucaacucaaauaucuuucagggaaagacuucccuugaccucccacacuaggucaacuuccugaagggcuuucauagcaaucauaguuuaguacaaauuaaccgaagucauaauuuuuaugcuuauuuguaugacuguucaauuuaauucaugucucauuuacuagaauauaauauccaugaggacaaggggccucuucuuaguuaucacugugcucuagcguguagcccaaugccuggcacaaagcaggcauuucuuuaaucuuuguugaaugaaugaauauaauacccuucugugccucauggacacuaaaaauguuuaugucagugaacuaguauaguacuuuauccuuuauguuuuucuuaucaguucauuaauagguucucagcaaaaacuaccuacuauguauaaagauauucauuuauucagaaaacauuucugccugaccuaaagaauaauuuuacaauaaaaauaaacuuaugacucauauuuuaauuagcucauuaauuaauauggaaaccccaguaaggugguauaaaggacaaucugaaaaagagaaacacucgaguacugaaauguauaugcugacagauacaaaaccauaauauccacaauguaauaauuacaucuucacuggacaaaauuuacuugcaucucuauggacaagaaacauuugcauuaccgucagucuuucacaaguuaauuucuaucuuuacagagcuauaaaaauagaaccuaugaauggugcagaccuguauaguaucagaaaaaccuggaaaagaaugcuagacagcacucagcauuccacugggaggauagcaauauuuuuuuugcccauuucaaagucuuucacaguuuucccgacagucuccccacuuguguucauaauaaucucuaagauuguucuuagucacaaaaagaagacuguucuuacuagauuuggccuauuuauguuggggcaaccagaaagcuaauuaaccauuuaagccuucuugaguuugcauuguaaaucuagagccaugcaguauugacuagcuaagccuucagaauuuccuuacuuauguaaauuuucauaagaaaccucagauugagccuauauagucucugcuauuugcuaucuugaagcuaagcaacuaagcccaagaaaacuugccaccauaugguuuaccugaaacaucuguaaauuaaggugaguuccucuugagauucuccaaauuugcuaagguuccugguuuucuagaaaaaggccuuccuuaccccaauaagguuggacuuucucaggcagacagcauguaaguuuuccugggaggguuuugugggcauuaacugcauaaauacaacaaccucuuuguuccauucuaguggauugucauuacugccacuuaagauaaggcguugguuauacaauuuguccaauuauauccuggcaagauaguugaagacaaugaaagaugcagagcacuacaaaacuugauaacccccacaggaccuucuagacagcauucauaauuccacuggucagacaccucauaaucauuuugcuccuuucagagucuuuugcaguuuuccuggaacuaguauguaugacacaaugugcuagauucugagggcacaagagauaaauuagcaaggcaaggggucugcccucaaaagccuacuguacggugggagagagaauguaauggcauauaaauuaauuggugagcaagggaguguuuccuggaaagauaaacucuugagccaagguuugaaggauaacuaaaaaacaaacaaacaaacaaacaaaacauggggaggcuggggggaagagccaggaagaaagaaguuuugguagcaugucagcccacguguaggacagaggcagaagacauugagaaguauacaagagaaggagacgguuuaguaguguggagcaaacaucuuuauggcaggugaagccuccagagaggcugccauagccagaucccucugugcaaggcaaguaguaugagcuuuauccugaagacuguaaggggccauugaaggauuucuuuaaauaggaguauagcaugauuagguuugccuuuuaaaaagaucacucugucagcaauuuacagacuguaacauucuacaagacagaauaauagagacucaauaugggguaggcaguuacuacguauuuuugaaugaaaaucgauguguauagacaaagacagugcaaagaggauaaauguaagagaaaaguguuucuuguaaaggaaucauaugcaaagguccugugcuaggacaaaucaggacaaauauaagggguugaagaaggccauggugauaccuuugguuagaacaaagggaacccuagggugcagaccuugaacuugcaggaccuaaugaaugaaaggcaagugaaugucauuuauuccuuuuuucuuuucaucagcaaauaguuauugagaaacuucuguaagcugcuauucuguacuucccccaaguaaggcaacagccacauuuaauuauucucugaauuucuagcaucucuuuaauccacaaacacccaguaagcacauccucauucaugcuacuacugucuuccaugcuaggaaggcauacaguagggugcaaagggcacaaagaaguaugaaauuugaaucccacuuauagagagcucugaguguaguggugcaggcagacacacgagcagauaacacaaugagauuaauaguacauuugccaaauguuuaccaaauauguggccauacagaggaacacuuagcagauaaagcuuuccagaggcuacauuugagcuggauguugaaggauaagucacuauacccaauuguguuaaaauaauguauauauuuuuuauuuuuauuguguggguucagauuauuuuucucuaucauagucauuuacauuucagguccugcauaguuaauaugcauguuuuuaauaaugauaugucugugauuuguuaaccuagaugaagauguacuguuacuggcuggguauuggcacccuuaagaauacacaauauguuuucugcagucuaaacuuacuuacuaccauuuccccacaaaagaccuuuauuuuuaagauugugaccaggccuuuuuucccuguguuguuauguuccgaacauggggaaaacuguccuuuauuuccccugaaagcacugugcuucagagucgcaacccaccagaacaccaucagcugcugagcuuguauggacccagauuaucucuacugcuauucuucucugucuuaaaugucgauuacauuaugauuaucuuucuccuuaauuuuuucucuuuuuuugugaccuuaacacaauuauguagaagucaucaagcaauugacauauucuaucaccuguuuggacguuguuauuucuuauauauaaacugcaguuccuaaugcagguugauauauauucaaugacuauuaauuagaagaagcuuauuucauauauguauauaauuuuaaguacauaaguacauguauaauaaguauggauaacacaaaggucaacacccaaggaaaggaaaacaacauauuaaucaguuuuacuucuguuuauaauuuaauuguaguguuaaaacuuaucauaagauauacuguuuaacaucccuauauagaaauggauagaaugcuugucuagcuaggaaacaugaaacuaaaauguaaauguaucugugaagcuuauaucaugacguagauguuugauuguggaaaaagcaguagcuucauaaaaaaaguuggacuuaaaaaauagagaugcuauaguauaugcagacagcuacagaauauaaagguaacuuuuguggaagaaaaugaacaagggacuugcaacacaauagggaaagacauaaguucuguuuucugguuccuaguuuugauaaagugugugugcuugggcaaauuauauacuucucuuggaauaacuccagauuuauuguaggguccauuagacuuagagcuguuuagugucaaaggcuugacuuaauuuaacuucguaguaucuguguguaugugagaguguuuugcaaaguacucuacaaauauaaacacuguugaguauguauuaucuaaucuuccuguauuaguucuuaaguagcagugauuuuaauugauagcaauauaaagucucagcuuccucauagacuuuguuucaguuuguuucauuuguaaacaaaaacuuaaaugcaggaccugcuagcugguauaaagccaagcauauacagagcucaguguaauacuaauggcuugucuucagaaacaaaggauuguaucauauuuugugaguuuuggagagaguacaugaaauguauuuuucccacagaaauauugcugugagugguggcuuuguucuuaggcuacucugcagauuucuguuuaacucauguaccuuaaacuuauagugauaaagugauaggccccaguuuuagacaguuagaggccccagauacauuucuaaucccugaacuuauggaaaccucacuacacauuccgaguagggguuauaagagcauauuuuacuacucauuccuuccuuuuugccacucacaagcaguggcauaaagggaguggaguagggaucaguccuauagguuccauaaauuugcuuacucuuuguggcugcaauaaaagaagacaauuaucuagauugggaacucaaaaucagaaggcagaaaguuauuccucucuggugucaugguugaagucuccaaauucaaguuuacuguuguucauucaaaaggaugguuugcagccauaagcacccauagcacccagacucgaaauuuaaaugccauuucccaucuacagaaaccaguguuuuuuagaagaaauggcugauuccagguuugaugcagaaaaauucuaaguugaaaugagacaucuuauugugccaaaaacaggaaacuuacuaaacacuucugaguuuaugucaaaggacacaggaaucaacuugaaagggcuaccacugguaacagauggggccauuaaaaaaaaacaacuuuauuuugaaaauuucaaacauaugcagaaggaaggagaagcuuacaaaaauccccagaaaccauuuauguagccuucaccaauuaucaacucauggccaaucuuauuucagucacagccucaccuauucucuuucuccaccauuaaauuauuuugaaauaaauacccaaaagcauaucauuuaaucugggaauauuucaaguuauagcucuaaaagauaaggacuauuuuaaaaacauaaucaugguguauuucaaagauggaacaauuugaacaucaagaagaagaauugugguggguugaacaacaucaaguaucuacuaauaaugggaauuuaaaaaaaagacccucaugacuugccuuuagagauuguuaggacacuagcuuagcucaucacucucaaaauuguuaaaaggaaagaaaucaaggauuuguccugccugucccauacauuguauuuuggaauagucaaauaguugauaagguaaagcucuucuuuauagaaugccagcaaauaaauauagaaggaaugcucuagaaaagcauaauucuuuagccccuaaugaaauaguggauuuagccagucguuaucauggaaugcuaaaaccuucaggucaaaaguugauaaugaaauguauaauggaucgcuugacgaaucauaccugaagucauuaaugaaucuuaguaccaccaaaaaugagauauuuaaacauuaugugccuauacauguuacaguaaaaaugcacauaucaauacccauguaauauucuugccaaaaucaaaggaagaugaaaaagaaacugaggguaagcuuccagagguagcuaccaauuuauaggaagugaggacaggauagcauguuaaaggguauggauggcuuauaggagagggaagguugaacugaguccccugaaagagaccugagaaacauaucuaccaaauacaauguuaacuuuguugggauucugguccaaagaaacguacuaaaaaauauggggagaaauagaggaauaugaauauggccugaguacuauaagauauuaaagaaaaauuauuaacuugcuagguaugauaaugauauuuugguuauguuuuuuaaaaaguuguuaaaaauacauagugaaguacuucaggugaaucaauagguugccugggauuugcuucaaaaacuuaaugauucaaagugugaccccccagauucagcaguauugaccuuaccuaagagcuuguuagaaaugcagaaauucagacucagaaacacuauagaaccagaaucuacacuuuuacauuuuuauaagucccuaagcgauuuauacgcacauuaagauuugagaagcacagcuuuaaaauacuugggguggaagagagugugggcuggggauaaaagaaacaaaauuggcaaauacuguuaauuguugaaacugugugaugggugcaugaggguauaauugaguauaagucaaguaucccuaaaucagggccugaaagucuaugugacugugcauauguauucaauccagugaucuguuggguuuuuuuuuuuuuuauugguuugagaaguuaguaaguguugagauaaauauaccuuauugcuucccuuucuuccugucccaguuugucaaguuauuggauaauauucaaaaacccugaaugcauauuucuugcaaaaguguuucuuaugaaaucacauuguugcuuuaaaauuugcuaaagagacuuauuuuaaacugcuaaugccaauuuauugucaaucucucucuccaggcacgcuuaaaaaggccucuuaagagccuugauggugcucuauaugaugaugaagaugaugaugacauugaaagagcaagcaaguaaguaauggauuuugguguccuauuaaguggaauggcuuaacagcagaaguuuuuggugauaaaggguauuucaaagaguaugcacucuuagagcucagauguugcccuuuuacaguguucuucagcaaaaggacccagugcuccuggaauguuaugggggauaucuugggacaggaaacuaagauggaccuuaaauaucuuguucuuggaaagcaauaaugucuacagagauaucugggauaguguuaaaggggcaauagaagcccaucuaaauuaggcucuuacucauucugaagagaggaagguuaaauaucaggaauggugauaauagucaauagaaagaaauggaauugaggguacaguagacuuaagucuauggugauaucagaagaugaaaauuuaauaaaaaguguuaaaaauuaauuuuaauauaagggaaauaauauauguuuagcuucuuacaauugauguaugacaaugacaaaaugaacauucuuuuuucuucauuaacuauaucucugucuauguaaaggaauaugcauucuccucuaaaauaagugauuaaauaaaggaaaaccauauuaaauauugaaagugaauuuaggcuauagcagacuuuccaaguaguucagucuaauauuccuaaaguaaaggucccaaauuccacagaauuaaacugugaaaagcccugcuucuacuuucaguuucauaagguaccguaaacuuuuuauuuguucuuaaugcaugcacaaaauauuuccauauuggaauuaguauacacaucacgguaaagaauuuggugaugaacuaauuauugauuuuguuguuaacucucucauuaauguaauguaacuggugagagauuacuuacaugcagcaaauaugguuauuuaccuacuacugcguguuuuauuuuucuucagguuaucuucugaagauggugaagaagcuucugcuuaucucuaugagagugaugacucuguugaaacaagagugaagacuccuuacucaggugaaauggacuuacuaggagagauucuugauacauugagcacacacagcucagaucaggggaagcuggcagcugcaaagagcuuggauuucuuuagaucaauggaugacauugauuacaaaccuacgguuaguagauuuuuuuuuacuuauaaaauuagaagaaaauauucuugccuuggcugugauuacuggaucuuauacucuuuguugguagaagcauuuaaccucuaaguagguaagggucaaaacuucaaaaauaugauaaaauuuaaucacuagaaauuauuucuauuauuaaaauucuaguauuuucccuuucauuuaucuaguucuagugguuauugucauuaauugaaauuauuuugucaagcaauaauguuuucuugcaaccuaauuuuauacuugucucuggggaauuuuuaaaaugugaaauguuuucacuuuuuccccauauuuccugaguuuucaaaaaaacuucaguaaauguauucauucaaaucauuuuucuuacccaaaaaugaacaugauuuuauuuuuuaacauuauuuuaugcaaauuuaacugaaugcuuaaaaacagcagagauagaaguaugaguaaugacaauccuguucugauaguaagugacuucagaacuuggcauuaauuauauaaucuaguuugaauuuguuaggugacagcugcaaggcaguggaaaccaaaguccauuccauuucaucccuguuaauagagccauuuggaaauguuuaaaauugacucucaaugcuguauuuucucugggaggaacuuaacgcuauuaacauuuauuucaaaagagaaaaaagaacuaaauuaaugcuuauuaaaaguuuucugaguuuguuguuucuucuuuuuuucagaauaaaucuaaugcuccuagugagaauaaccuggcuuuccucuguggugguucuggugaccaagcagaguggaaucuugggcaagacgauagugcccuccauggcaaacaccucccuccaucuccuaggaagcggguuuccucuagugguuugacagauucucuguuuauccugaaagaggaaaacaguaacaagcaccucggugcugacaaugugagugacccuacuucaggacuggauuuccaacucacuuccccugaaguuucccagacugauaaaggaaaaacagaaaagagggaaacacuaagccagauuucagaugaucugcuuauacccggucuugggcggcauucaucgacuuuuguuccuugggagaaagaagggaaagaagccaaagagacuucagaagauauuggacugcuccaugaaguagugucauuaugucauaugacaucugacuuccaacaaagcuugaacauuucagacaaaaacacaaauggaaaccaaacuuaaaucuugcauccaagcuucuauggagacauuuugagauucaaugcaaucuguauaauaaacagaauuauuuguaggaauggcaacucauacuauuuaaauuuuuuuuugcauuugcaacauuuuucucacuuguucauuucgaggauauaugaaaugcauugauuuuuaaauauaaagcgaauucuacugugcuuuuaaaucagguacuaguguguauguauguuuaaaguauguauugaccaugagauuucccaguguuuggugcuuaaugccguuuauuuuauuuaagcuaagaaugcauauguaacccaugcacauaaccaguagcuacuauacuaaucugguugagcaugaacugaucaagauaucaaaacuuaucaaaacuagccugaagcugaugaaacuguuaacccacuaauugccuuaaucuuaaagcuguuuuuuaagcauacuuaaauaauguaugaaaguauguauaaaguuugaaggauaaguuauuaguguucugcagagcaauaaugccuuuuucuauucaucaaaucaaggucaaaauucaucuuuucaagauuaaaaagcucucuuaauggaaauauuuaauuugcuuauauaaagcacuauagccauguuuuccaaaaaguauaaaaauauacacuuaccuuucauucagugaaauauaggaagugcugaauuacaaugugaaguuaaugacuucuguuuacaaaugagacacucuaacgaguuuucagucucucuguaugccuuugcuauuuagggguccaccccaagaaagccaaauacaacauaaaccguccugacaaaaaaaaaaaaaaaaaucuuuuuuuaacuaauaauucucuaucaaaaugcuucauaucaucaucucaaauuuacuuuuuaaaauaauugacuuuguauuuuagaaguuuuagauuuacagaaaaauugcaaagauaguacagagaguucccaucuaccccuguuacuaacaucuuacguuacuaugguacaucugccccaauuagugaaccaauauugauauuccauacuuuauucagauuuucuuaguuuucuccuaauauccauuuuccacaucaagauccuauucagaauaccacacuauauugaguuggaaugucuccuuaggcuccucuugccugugacaguuucuuagacuuuccuuauuuuugaugacauugacagcuuugaagaguacugucagauaaauuguagcaugcuccucucuuggaguuuguuggguauuuuuuucaugauuagacugggauuguggguuuugaggagaugaucacagaaguaaagugccauuuucaucaggucauaucaaggguacguacugucaacaugauuugugaaugcugacagggaccuugauaaccuggcugagguagcguuugucacucuaaaguucuuccugcccuuuccaugcugucauuuuuggaaggaagucacuacaugcaggagugaggagucauaauuccccuucuuuagggcagagaaguaucuacauaaauaacugggaauucuguauagaaaauuuguuucuucuuucucaaauucacuguugagcuuuggaauucaucugagaaggaaucauguacuaauuacuucaugauagacuagauuaccaggcacaaucagggaaaaaagcagugauaguaugguuaaauuguuauuagcauuuucaguauauccacuuuauacauccccaaucaugauuuuuuuuacauuucuuuuuagaaaagauguucaagaaaucauuaaagaaccccaauaagacuauauucuaaauauuuauugaaagaauauaauuucagcuaaaauccuagaagaggguuugaaauaauuuaaagaaaaugaccaaguuuuuuuaaaaccuacguuucaaaaucuaaauggauauguguuauuugggacacuuauucauuaugauuauauaagaagacaauucuuguuucccuuauaaguauggacuguauacauuaaggaaaacaauguuuaauccuuauuuuuuaauacagaagucucaagguucuugucaaauuuugccuuuauaagcuuauuacaaaauuacaacuuacuuuacugaaguuuauaauggaagaaguccauauagcaaaagagcuguuuuaaaucagaaggaaaaaagguuacucugguuguuaaucugcuuggcaaauauuccuucauaauuugugaaaagaaugcaaaucagcauuuuaauaugaauuuugaaaugagguaugguuuuuuguuuguuuuuuucagaacucagucugaaaaacaacugugaguguagcaugggucaaauuugguuuuuaguccauuugcuuuaucaacaucacggcuucagaaauccaaauuuuguucuacuuuucagccaccuuucaagguguuugguuauaauacuguguugcuuugaggauauuuagccacucauaaauaauugucucaagguauuuaaaagugauuugugccuuauuuuaaugcaaaauuagcaguuuuauucuauuuuaaaaacaaaggcagaaaaacaauucugcauguuauucuuuaaaaacauccagaauaauacuaccaaguauuuguauuucaaaccaguaaaauuuugaauauucaaagucugcucuuaaacuuagacuuccuaguauuauggugguuauagugagaaugaaauuaaacugggugaguuccgaaauaaaggaaaguguuauauucuacagugcccauauuuucuaugguaacuaaaucaaauauuuguaaguuccucugcuuuuugaaauuauuuuucaaagaagcaacaccuguuauacaacagaauuguauaaacuaaaaagacuuuuggccuugguacauagucuuuaucuggccugcaauggagucaugguucuuucugaaucccacucucacuuuuuucuuuuuacccuuagauauugcauccgugguauuucagggguauagagaaauaauauuggaauuuaggagcuauuuuuuuaagugaaaauauuacuaagugguaucuuuugaugauuaccuacuuuaaugugucuuagaaaagcaccaaaacauagcaugauuauuuuuucaguuaauuaaaauuaguuaauaacauguucauuuaaaaacuauucauugacuuuuuguaccagucauaugcaggguacaguaacugaggauaugggaaauaaaauaacugacauagucccugcucugaaggaacaaaggaaaaggaauugcaaauuuuuauuaaaauaauaauaauaauaauaauaauaauaauaauaauaauaauaauguguuuugccuggaaguuauuagcugagauucuaacacacaaaaaguucaaaaaaaaagaacaaaaacuggcugcuuaauuuaaagcaugcucuaaguaugaaccauaguaucauuucuaauuucauuaacuuucucaauuauuaugcuaaguauauuaugcugcuaagauacccacauuuaaggggcagauuuagagacucuuuuagaaacugagugucuuuaucuuauuaucagauaaccaggcugcacagggcucucuauaauggaaugaugcuccuuuucaauacuuagagccacuguacucaguuuaggaguaacugaagguguggaugcauguuaaugggaauccaauuuuuacuauuuuuauaugaauaacagcguucuguagaaacagucucucccuucuaaauaaaaacuaugugacugcuguuacuagugcuauucuaugcgaauauccuaauaauaggauucaggaauucuaaugaauuguuucuuaauuaaggugaacaaguagacuccugaucaagaggagaacacugugaaugucucauaaucaauagaccuucauucucuuguagaaaauguggauuuucaggaaaagacugauuauuuucaugaauaaauuuucuuauacaaauuccauuuuguuugacauaaaagacccugaaucuuaagauauuuguaaaucagaauauuuaagaauguaaaaugaauccccaaaucuaguuuccuccaaagcacuucuuaauguaggaaauaguuuuuacaaacccuaugucaguacuaauguuccugggucaaacccaguaauauuguuaguguauguuguuacaccuuauuuaagaggcagagugguuuugagcaagucaguuaacgugauuugaugaagaaauaaggaauuauauacauuuagacagaagaauauuuuauuuugaaaauaggauuucgugcaauaauuuuucuugcauaacuuaguucauauaaauauguacaucuguuuuucuggcagaugccuuaaggucauguuuuucaguauuugaguaaaucuguauguagcaauguucucauugauuucagaaaaaaauauauucuuuauauuguugccaggagaaauguuuuuguuuauuuaaaauuauuauggauauuguguuguuguaucauaacuaacugccucagcaacaauaaauaugcaauaagaaaauccuguaccuuagauuagauugacaauacuguuacuuuaaaagaaauauauacgguacaaauugcugauucuacauguguacauuuaacagauacucaguucugcaccaccuaaaucaaaauggcauuuguaugcugaugauuacauauguggauuguaguauccuuugugaugaaucuuugauaagauuuauaaagggcauugccaauacuuuuugacuguguaaauuaauuuuuuguaugauguacaguuuguuuaaucuuagagcuucuauagauuucuacuuuauuauacuugaaugaggcagaaaagcacuguggaaaaucuguagcucuggaugcaacaugcagacauaccaaaaaaauaauaauaaagcaagguacugaagagcaauguuaacagaaugcuuuauauccagaaugcuauguuuuuuucaagccacauuuuaguugaaugaaguaaaguuauucaaucuuuuauuuuaaaauauuggaaagucacaaaugauuacuucuuugauaugaugaaccuauaagucuauucaucucuguuauuucauuucucaaaugugagccuuguugagguccauuaucaaaucuacacuuugguugauuauaugauguuuaggacaaggcagaauuuaaaaccugcauguuuagugcaucacaugucaagucaccauccuucugacaguguaacuuccauaacguuauuuugagagccauuuaauaaucauauuugaaaaaguggauuucuugagucuguuguaguuuaguacuuacagcagugccuaaaacagcaacuaauaugaacugccugaguccuacaacauaaaugcauaaagcuuuuuuauguaaaagccacaggagggguucaaaauugaacuuuuccaaaguuuauuucucuugcguuagaugaaaaacuauuuaaaaggacugaaaacccugagcuuuuugcucgucuugguagcagauaucuguaaaaaccuacccagaauugugauuuuacuucauuguucuugcauccuugaggcuacaguauaaaucaucuccaaacuugacuacuauugggaagauguguauaaaagcaucgcuuugggaauuuuuuuaaaaauaugcaaaaauaaauauugaauaaaaucuacauuaccauaaaacacccaaaaaugcaguucuaaaauaaaauuggucacaauuaaacuuugcauggugaugacucuucuuuuacaauugcccaguuaucccccaauaguguucuagcuagacugcugugagaacccuaauaccuuuaucucugagcuuuguaacugcugcaguguaaauuuaagccugcaucuuucugacaggccuaccugagagguauacuuuauuuuauucuuuuauguauagucaacggauuuuauuaggcucuaaagucauaggagaauuguuaaguaauuauaaugucacuaagaauauaagaguuguacuauccaagucaaacaacuguguuuauugacccccacuuaagguuuaaggacagagaugaaauguagucaaguguacaugaacaauguuccagggaccagaaagaugagcuucucauccaagagcucugaugguuucaccuaaagcaaaggucaaauuccuauugaaauaagcacaacguuucccucugggugcagaauaucugggauuaauaugcugaaccuuucuuauuuauauagaagaagcaaaagccugacaauaagaaaagaaauauuaucccugcaagccuaagauuccgcuauuuuuguugauuuugauugugaaaacuuugccugccaccaucaaagggauuauuagucucauuacccucagugucucuguaugagaggccuggucacaucuucauuuuauagaugcagaaaaaaaaucucagcuuguguuuacauacaaauaaaauaaccuacguagaguaguauuaugguaguaggucugggaauuuccuuuccuagaaguaacaaugaauuauuauauaugcauacaauuuuguacauauauggaaaauagugcauuaauagcacaaaaauaagaguauauuguggaagguuccagaugaauaaaaauuccccagauucugccauugauuuggccuuuuuacuucaugcccccaaagcguuauuucucuaaaauaagugucuucuuagaaugaauuauucaauauuuauugaaaaacuucuauguauauagcagcugcaauauaguuugaaagagaaaauauuccuaaguaucuaauuuagugugaauucauggugguuugguguguacaacugcuuuaguuuggauuugugucccugcccaagucucaugucgaaauguaauccucaguguuggaggagaggccuggugggaggugacuggaucaugggggcagauuucccccuugcaguucuugugauggugagagaguucucaugagauuugguuguuuaaaaguguauagcaccucccacuucucucucucccuccuucuggucauguaagacgugccuacuuccccuugccuucugccauuauuguaaguuuccugaggccuccccagccaugcuuccuguacagccuguagaacugugacucaguuaaccucuuuucuuuauaaauuacccagucucagguaguucuucauagcaaugcaagaacagucgaauacaacaaccacaaaauauaauuauagaaucuuagacuuuuaucucauccacaggcucccaaaccuagucuuucauuagauuuaccuggagaucuuuuucuuaaagaaaaaaauacagaaaacacacacagacacacacacacaaacacacacaugcacacaaacacaaaacaaaugccuggaccaugcuccuagaguuucuggaauagguacuuaauuagucuuuuguagaguugaggaaaccaagauagaaaaaggauaaauuauauccuuaaugucucauagcaugaaaugaccaagcugggauuugaaccccacagcugggcuuuagcccccuugcuauuagacagaaguacagggccaaacucaaauggcgugacuaucauaaauucccuacagaacuuucuuuucuaucucaacuuucuccuacaaguauuggacaauccuuuuuugacaaaauauucuaugcaaguuucuuauuugcuuguuuguuuuuaucuugaguacagaauuuccuaaaucuuuuugggagauugcauuaauguucagucccucccucccucccuuccuuccuucuuuccuuccuucuuccuuccuuccuuccucuucuuccuuccuuccucuuucucuuucuuuccuucuccacacuuuccagcauaguuuauaaucucaucucaaauaaucugucuuauauauacauguucuccauggcaucuaucuccucucucuuucucuuaauuguauuugcgcauauuaguugguggaguggggaguuuuaccuggauuauuguauaacuauauuaaaaacuauaggagcaugcuugaggacauacaaaggcauaacuugugaauuuuuucauauggagccauuauugacacuuaaagcugcugagaacaucuaaagaucucuugcagaauauccacagaugucaucuacaaaguuguuuuucucauguucaagagcagcacuuaaacuacuuauucuucaguuuuguuauuuuauaaucaaccuacuuuaaauauggaguguauuucagauuuauguguuuuuuaguaacaccauuuaaacauuaauuguaaauaauguauuuaaaauauacaaauuacuuuuuguaacuccaguucuaauuuagggacuaauuuuaagauaucuauuuaucuaucuaucaucuaucuaucuaucaucuauuuccagauauauauccauuagauaucuaucuuaugaauauguacauauguaaucuuaugaauauauaucuagauauauaauauauaucuagauauaaauagcacacaucuuaugaauacauauauauaauauauaacauucauuuaguauuuaauucuguuuucuccaaaaucuaauacuuaaaauauauuuuugaaaaagagcuaaguuuucuuagauuugauaaacguccaaguuggauacaacccauuaggcaaaaaucccaacuuguaaaacagauguuagggagaaaugcucugcuuu

SEQ ID NO: 12879 - RNA, 7161 nt, Homo sapiens
ugacauaagugacuaaaaaacaauauauuucauggauuuagaaauucugacuagaauuaagauaguaugauuauucuguaucccuacuagaaauguaaagaguugaaauucagcuaccuuuaguacuaauuuaaaaucauuccuuacuuccucuagagcauuuuuuucugcacaauuagaauugaauuuuacuuuuuguaaguuuucuguugggagaaaagucucuuuauugaauuuauaugguuuucuucucauuacaagcuuaauauuacaauuuuuaauucagguucucuuaacauuuuguuugcauuuuaauuuagauuuguaagaaaucuuuuacucgaagaccacacuuggaggaacauaugauucuacauucucaagauaaaccuuuuaaguguaccuauugugaagaacauuuuaaaucacgguuugcucgguuaaagcaucaagaaaaguuccaucuggguaagcaaguuacuuuuucuuaaggcagucaugacaauuuuaauuaucacaucaugcuggaggagccuucuauagcugaauuacucuuuuucuucuaaaagacuuuuuaagagugguuuuagguucacagcaaaauugagaggaaggaauagauauuucccauaugcccuaugccuccacauaugcacagccucccccauuaucagcaguucuucaccagagugguacguuuguuacaaucgaagaaccuacguugguacaucauaaucgcccaaagacucuaguuuagacuaggguucacucuuaguauuguauuuuguguuguuuuagacaaaccuguaaugacggguaucauuauaguaucauacagaauaguuucacugccccgaaauuucccugugcuucuccaucugucucccacaccaaccccuggcaaccacugaccuuuguauuuuguuuguugguucauuuuuuuuagauaccucaucuacuauuugaugaucuuuuuacugucuccauaguuuuaccuuuuccagaaugucauaugguuggaaucauacacuguguugccuuuucagguugccuucuuccacuuaguauagugcuaaaugauacaauuggcccuccauaucuauaagugccaugucuguggauucagccaacuguggauuggagauauuaaaaaaaaauaacaaaacauaacaauacaacaauaaaaaauaauacacauuuuaaaauauaguauaacagugauuuacaucacauuuccauuguauuaguauuaaguaaucaagagaugauuuaaaguauaugggaugaugugcauaguuuccauguaaauacuacaccacuuuagauaacggacuggagcauccauggauuuugguauccugggccauccuggaaccagucccucauggauaccuagggaggacuuuauuccauugucuggauauaccacaguuuauccauucgcucacugaaggauaucuugguugcuuccaaguuuuggcaauuauaaauaaaauugcuauaaacaucuuuguguaggcuuuuauguagacuuagauuuucaauuccuuugguuaaauaccuuggaaaacaggggcuggaucagaugguaagaguauaauuaguuuguaagaaacugucaaauugucuuccaaaguaguuguaucauuuuacauucccaugagaaugucugucacuucauguucuugccagcauuugguguuuucuguguuccaaauuuuggccauuguaauagguuuguagugguaucucauugcauugauuugcauuuuccugaugcauauaauguggagcaucuuuucauguuuauuuaccaucuguauaucuuugguguggugucuguucagucuuuggcccaauuuuuuuugguuuuuuuguuuuuuuguuuguuuuuuugugacagagucuugcucuguugcccaggcuggaguguaauggcgcaaucuuggcuuacugcaaccuccaccucccagguucaagugauucuccugccucagccuccagaguagcugggauuacaggcgccugccaccauguccagcuaaguuuuuuguauuuuuaauagagaugggguuucaccagguuacucaggcuggucuugaacuccugaccucaggugacccacccaccucggccucccaaagugcugggauuacaggcgugagccaccacgccuggcuggcccauuuuuuaaucaaguugcuuacuuauuguugaguuuugagaguucuuuguauauuuuggauaacacuuaucagauauuucuuuucaaguauuuccuuucaucugugacuuuucaucaucuugacaguuucugugacagaggaaaauuuuaauuaaguccaauuuauccauuguuucuuucauggauugugcgaagucauugccaaaccuaaggucaucuacauuuuugugauucauuuugaguucacuuuugcaaaggauguaaggucugugucuagauguauuuuuuuuuuuuuugucuguggauauccauuuguacuaggaccauuucuuaaaaagacuaucuuuacuauauuguauuggcucugcuucuuugugaaagauuaguugaccauauuuauguaggucuguuucugggcucuguauucuguucuguugaucuuuuuuuuuuauuuuuuauuuuugccaauacuacacugucuugauuacuguaacuuuauaguaagauuuaaagccaaguaaugucagcccuccaaccuuauuuuucuccuucaguguuguguuggcucuucuggaucuuuugccuuuccauauuaacuuuagaaucaguuuguugauauccacaaaaugacuuucugggauuuugauugggauugcauugaauguauagaucauguugugaaguugagucuuucuuuccaugaacaugggauaucucuucauuuauuucguuuuucuuugauuucuuucauccgaguuuuguaguuuucucauauagaucuuguaccuauguuguuagauuuauaccuaaauauuucauuuugggggauuguugaacuacucuuggugaaccuugaguauuggcuuaggcaaagaaagucauauaaauugaaaggaguacuguauaugucacaguucuuggagauguguaaauguguuuuuuuguguguguugggggguuuuuuugguuuguuuuuuuuuuuggugacaaaugugccagugggcauaaacugugcauuuauucauaguugauguugcauagguuugugagugcuuagaaugagacauucuuguuuuggaaaaagauaauuuuucaaggaguagaauaaacuuaguauauuuggaaugcgcuauaguauuuaaugaauuaccucccuaaugcuuauggccaagguggagaguuguggucuagauggugguauacuuugguaaauuucugauuguuaaucccacuaaugaauuuugucauuccagguagagguccucuccauguucaguucauuacuuuuguuaacaacuuagauaaaaauauacacuucauugcuuaugaaauuuauagaugucauaaagcuaucaaggguauuuaguauaccagaaaauaaacauauuuaaaaaaucuguaugcuguacaauaggucaaaacaaauuaaguuaaaauuaauuaagaauaaauacaaaguuaggcugugugcggugacucacgccuguaaugccagcacuuugggaggccaaagcuggcagaucaccugaggucaggaguucgagacuagccugaccaacauggagaaaccuugacucuacuaaaaauacaaaauuagcugggcgugguggcggacgccuguaaucccagcuacucaggaggcugaggcaggagaauagcuugaacccaagaggcggagguuguggugagucaagaucgcgcuauugcacaccagccugggcaacaagagcgaaauucugucucaaaaauauaaauaaauaaauaaauaaauaaauaaauaguuguaaacuuaaggaagugaucugacuuuuagucauuaagucuuuaagaacuauaaaauaguuuaucauccaaacuacucacuuuacagaugaucuuaaaggcagaggcuuuuuggacacagugugaaccaauaaugugauaugauuuacaaaacaaauguaguuuuaaacuauauuaauaaaaguguauuuuucagaauuagggaaauaauagucugauuuugaauugaucuggaaaauugcauucauuucuguauaccacauuuaagauggauauugacaaauauauauuuuagagauggguaauuuuggugauguagagucuugaaaucuuaucaugugaaaaacaugguccuugaaauuuuuugucugggaaaggaagauagagcagcugucuucaaauacuuucaaggcacuauugcgcaacaagggauucuuaaucuuugugagucuaguauauaagacuaguauauguuggaagauuauuuaccugaagcuuaaucucuccaaauugccuuuacuaaguuguucuuucauaguauucaguuucagcacuucuaagaagccaucauguagaaacaguuuuuauaguuaccaaacuguaguugacauguucaugauucuguuucaugggagaaauuucuuuagaguuuaguuccagaaaaaguaguuuuuauuggagaauuggugcacuuccuucuuuuugauuugaaaauuuuagguaaucuuuuugguucuaccuuguagaaacaucagagggaacuauaauaacuuuuuaaguguuggaacuuacaaacuaaaguaacuugucuuacacaauaguuacuuucccaucagugaaauuauacaaguauacaagcauaugcugaacuuaccuuacuaacuguuagagcuggugaagagggcauucuucagaagugguugaacuggaagauuuuuaugacuuguuaagagauucuucuaucaugcugcagcauaccaauaaugagagguguuccagaaauguuaggcaguaaggcuuagcuccccugcuaucuaauguucauggcggaaaauauacaaggaaaguacauucgacauucaaaauaguaaauauuuauggagcaacugcuaaauguaugaucagcucuguguuaggaucuggggauacuauuucugccaaauuaaauuacggcgcaauagguaaucuaacuaguaaauaaaucauuacauuuuacuacuguacacccacaaauauuuuacaacugauuagguaauuuguaugauuuuuaauaagaguugacauuuacuggguuagguugacauuuacuagaagaaaaaguuuaauagguguggcaugauguagaaguggaaguagaagacuuucuagccagccuuguuuucugagucugacuuagccacuuacuaggugaucuggaacagccucucagacuuccaguuuccucauuuguuaaaaugaaguuaauacguacuucuuagauacuguugugaggauuauaugagguacuguauaagugccaaauguagagccaggcauaguuuucauucucuuucucugaauguauugucauuucuaguauuauaguuuucagucuuuccaagaccuuugagaaauaugguuugugacauaguagcuuugcauuuugggccacuauuauuaauaaaccaaauagaguauuguuauaaguauuuucuguauuuguguguguguacauauguauacauauauguauacaugcauauauaaaauacucaaagcaauauuauauauauauagagagagcuucuuuugcauuccgucucuauguuucuguucccuugaaucacuguacacuucagauaagugcuucaugcaguuugguauauaucacaagcaccuggagaccuuauuaaaacggauuucccagagugucugacucagauaggucuggcguauggccccaaauuuguauuugcauuuggaacuuguacaguuugcaauuugcacaaguucccagguagugcuggugcaaauggucuagauaucacauuuugauaaugacugcuuuagauuauucaaagcaauacucauacugucuacauuaggaauauauauucuguuaaaucagagggaaagauauguauuuaaugcaaucugaacaguuaaaggagaagaauuuuuaauauauaugaauauauaugugcaaaaguuguaguuuggcuuuuaaaagucagaacuuggccaggcauggugacucacgucuguaaucucagcacuuugggagacaggugggaggaucacuugagcccaggaguuugagaccagccugggcaaccuagugagauacugucuauauagaaaaaauaaauaaauaaaagaggggaggcugaaguggaaggauugcuugagcccaggagguuguuuaaaauagguuuagcugcaugcaaaacuggauauccaguauaggaaaaaaaugcaguuguuauuuucuuugaagaauccugauaaguaacugaacauuaaagagaaugcuucauuucuuccuuugcccagcugaagccgccagcuauacagauagucauauuuuauaaaaaguuuuacuaguagauauuucauucuuugacuaaccacacauuuugcauaauaaccuuauuuuggcacguguauuuacuucaccuuuuuuuuucagcuauguaaguacugacuuucguuuucucaauuucuuagagccuuuuuuugguucagaggagguggagagauuuuucauaauacuuaacacagugcuugaugugaauuaagaauaaauaaauacuuguugaaugaguuaauaaaugaguaaaauauuuagaucccaugaaaaaugaaauauuagagguuuuaaaugagaauccauuaaagauacuuaauacaauguacauuuugaggucaucucucauuucuaauguguaaaacacauugaaauuuacccagagcuacuguggcuaccaagcaauuuugcuuauaguuacguuucugaauuucagcaucuuaauucuauuuucuuuccauugugcuauuaugauuaauucauuagaauucuuucuucaguuuguccuuccauauacugagacaucuucuugcuaauauauagcuucuuugagcuguauuuacuaaacuucuuuuuuacgcauucuuugucuuucuuauauuuugucagucaguagaacacugucuug

SEQ ID NO: 12880 - RNA, 7161 nt, Homo sapiens
caagacaguguucuacugacugacaaaauauaagaaagacaaagaaugcguaaaaaagaaguuuaguaaauacagcucaaagaagcuauauauuagcaagaagaugucucaguauauggaaggacaaacugaagaaagaauucuaaugaauuaaucauaauagcacaauggaaagaaaauagaauuaagaugcugaaauucagaaacguaacuauaagcaaaauugcuugguagccacaguagcucuggguaaauuucaauguguuuuacacauuagaaaugagagaugaccucaaaauguacauuguauuaaguaucuuuaauggauucucauuuaaaaccucuaauauuucauuuuucaugggaucuaaauauuuuacucauuuauuaacucauucaacaaguauuuauuuauucuuaauucacaucaagcacuguguuaaguauuaugaaaaaucucuccaccuccucugaaccaaaaaaaggcucuaagaaauugagaaaacgaaagucaguacuuacauagcugaaaaaaaaaggugaaguaaauacacgugccaaaauaagguuauuaugcaaaaugugugguuagucaaagaaugaaauaucuacuaguaaaacuuuuuauaaaauaugacuaucuguauagcuggcggcuucagcugggcaaaggaagaaaugaagcauucucuuuaauguucaguuacuuaucaggauucuucaaagaaaauaacaacugcauuuuuuuccuauacuggauauccaguuuugcaugcagcuaaaccuauuuuaaacaaccuccugggcucaagcaauccuuccacuucagccuccccucuuuuauuuauuuauuuuuucuauauagacaguaucucacuagguugcccaggcuggucucaaacuccugggcucaagugauccucccaccugucucccaaagugcugagauuacagacgugagucaccaugccuggccaaguucugacuuuuaaaagccaaacuacaacuuuugcacauauauauucauauauauuaaaaauucuucuccuuuaacuguucagauugcauuaaauacauaucuuucccucugauuuaacagaauauauauuccuaauguagacaguaugaguauugcuuugaauaaucuaaagcagucauuaucaaaaugugauaucuagaccauuugcaccagcacuaccugggaacuugugcaaauugcaaacuguacaaguuccaaaugcaaauacaaauuuggggccauacgccagaccuaucugagucagacacucugggaaauccguuuuaauaaggucuccaggugcuugugauauauaccaaacugcaugaagcacuuaucugaaguguacagugauucaagggaacagaaacauagagacggaaugcaaaagaagcucucucuauauauauauaauauugcuuugaguauuuuauauaugcauguauacauauauguauacauauguacacacacacaaauacagaaaauacuuauaacaauacucuauuugguuuauuaauaauaguggcccaaaaugcaaagcuacuaugucacaaaccauauuucucaaaggucuuggaaagacugaaaacuauaauacuagaaaugacaauacauucagagaaagagaaugaaaacuaugccuggcucuacauuuggcacuuauacaguaccucauauaauccucacaacaguaucuaagaaguacguauuaacuucauuuuaacaaaugaggaaacuggaagucugagaggcuguuccagaucaccuaguaaguggcuaagucagacucagaaaacaaggcuggcuagaaagucuucuacuuccacuucuacaucaugccacaccuauuaaacuuuuucuucuaguaaaugucaaccuaacccaguaaaugucaacucuuauuaaaaaucauacaaauuaccuaaucaguuguaaaauauuuguggguguacaguaguaaaauguaaugauuuauuuacuaguuagauuaccuauugcgccguaauuuaauuuggcagaaauaguauccccagauccuaacacagagcugaucauacauuuagcaguugcuccauaaauauuuacuauuuugaaugucgaauguacuuuccuuguauauuuuccgccaugaacauuagauagcaggggagcuaagccuuacugccuaacauuucuggaacaccucucauuauugguaugcugcagcaugauagaagaaucucuuaacaagucauaaaaaucuuccaguucaaccacuucugaagaaugcccucuucaccagcucuaacaguuaguaagguaaguucagcauaugcuuguauacuuguauaauuucacugaugggaaaguaacuauuguguaagacaaguuacuuuaguuuguaaguuccaacacuuaaaaaguuauuauaguucccucugauguuucuacaagguagaaccaaaaagauuaccuaaaauuuucaaaucaaaaagaaggaagugcaccaauucuccaauaaaaacuacuuuuucuggaacuaaacucuaaagaaauuucucccaugaaacagaaucaugaacaugucaacuacaguuugguaacuauaaaaacuguuucuacaugauggcuucuuagaagugcugaaacugaauacuaugaaagaacaacuuaguaaaggcaauuuggagagauuaagcuucagguaaauaaucuuccaacauauacuagucuuauauacuagacucacaaagauuaagaaucccuuguugcgcaauagugccuugaaaguauuugaagacagcugcucuaucuuccuuucccagacaaaaaauuucaaggaccauguuuuucacaugauaagauuucaagacucuacaucaccaaaauuacccaucucuaaaauauauauuugucaauauccaucuuaaaugugguauacagaaaugaaugcaauuuuccagaucaauucaaaaucagacuauuauuucccuaauucugaaaaauacacuuuuauuaauauaguuuaaaacuacauuuguuuuguaaaucauaucacauuauugguucacacuguguccaaaaagccucugccuuuaagaucaucuguaaagugaguaguuuggaugauaaacuauuuuauaguucuuaaagacuuaaugacuaaaagucagaucacuuccuuaaguuuacaacuauuuauuuauuuauuuauuuauuuauuuauauuuuugagacagaauuucgcucuuguugcccaggcuggugugcaauagcgcgaucuugacucaccacaaccuccgccucuuggguucaagcuauucuccugccucagccuccugaguagcugggauuacaggcguccgccaccacgcccagcuaauuuuguauuuuuaguagagucaagguuucuccauguuggucaggcuagucucgaacuccugaccucaggugaucugccagcuuuggccucccaaagugcuggcauuacaggcgugagucaccgcacacagccuaacuuuguauuuauucuuaauuaauuuuaacuuaauuuguuuugaccuauuguacagcauacagauuuuuuaaauauguuuauuuucugguauacuaaauacccuugauagcuuuaugacaucuauaaauuucauaagcaaugaaguguauauuuuuaucuaaguuguuaacaaaaguaaugaacugaacauggagaggaccucuaccuggaaugacaaaauucauuagugggauuaacaaucagaaauuuaccaaaguauaccaccaucuagaccacaacucuccaccuuggccauaagcauuagggagguaauucauuaaauacuauagcgcauuccaaauauacuaaguuuauucuacuccuugaaaaauuaucuuuuuccaaaacaagaaugucucauucuaagcacucacaaaccuaugcaacaucaacuaugaauaaaugcacaguuuaugcccacuggcacauuugucaccaaaaaaaaaaacaaaccaaaaaaaccccccaacacacacaaaaaaacacauuuacacaucuccaagaacugugacauauacaguacuccuuucaauuuauaugacuuucuuugccuaagccaauacucaagguucaccaagaguaguucaacaaucccccaaaaugaaauauuuagguauaaaucuaacaacauagguacaagaucuauaugagaaaacuacaaaacucggaugaaagaaaucaaagaaaaacgaaauaaaugaagagauaucccauguucauggaaagaaagacucaacuucacaacaugaucuauacauucaaugcaaucccaaucaaaaucccagaaagucauuuuguggauaucaacaaacugauucuaaaguuaauauggaaaggcaaaagauccagaagagccaacacaacacugaaggagaaaaauaagguuggagggcugacauuacuuggcuuuaaaucuuacuauaaaguuacaguaaucaagacaguguaguauuggcaaaaauaaaaaauaaaaaaaaaagaucaacagaacagaauacagagcccagaaacagaccuacauaaauauggucaacuaaucuuucacaaagaagcagagccaauacaauauaguaaagauagucuuuuuaagaaaugguccuaguacaaauggauauccacagacaaaaaaaaaaaaaauacaucuagacacagaccuuacauccuuugcaaaagugaacucaaaaugaaucacaaaaauguagaugaccuuagguuuggcaaugacuucgcacaauccaugaaagaaacaauggauaaauuggacuuaauuaaaauuuuccucugucacagaaacugucaagaugaugaaaagucacagaugaaaggaaauacuugaaaagaaauaucugauaaguguuauccaaaauauacaaagaacucucaaaacucaacaauaaguaagcaacuugauuaaaaaaugggccagccaggcgugguggcucacgccuguaaucccagcacuuugggaggccgaggugggugggucaccugaggucaggaguucaagaccagccugaguaaccuggugaaaccccaucucuauuaaaaauacaaaaaacuuagcuggacaugguggcaggcgccuguaaucccagcuacucuggaggcugaggcaggagaaucacuugaaccugggagguggagguugcaguaagccaagauugcgccauuacacuccagccugggcaacagagcaagacucugucacaaaaaaacaaacaaaaaaacaaaaaaaccaaaaaaaauugggccaaagacugaacagacaccacaccaaagauauacagaugguaaauaaacaugaaaagaugcuccacauuauaugcaucaggaaaaugcaaaucaaugcaaugagauaccacuacaaaccuauuacaauggccaaaauuuggaacacagaaaacaccaaaugcuggcaagaacaugaagugacagacauucucaugggaauguaaaaugauacaacuacuuuggaagacaauuugacaguuucuuacaaacuaauuauacucuuaccaucugauccagccccuguuuuccaagguauuuaaccaaaggaauugaaaaucuaagucuacauaaaagccuacacaaagauguuuauagcaauuuuauuuauaauugccaaaacuuggaagcaaccaagauauccuucagugagcgaauggauaaacugugguauauccagacaauggaauaaaguccucccuagguauccaugagggacugguuccaggauggcccaggauaccaaaauccauggaugcuccaguccguuaucuaaagugguguaguauuuacauggaaacuaugcacaucaucccauauacuuuaaaucaucucuugauuacuuaauacuaauacaauggaaaugugauguaaaucacuguuauacuauauuuuaaaauguguauuauuuuuuauuguuguauuguuauguuuuguuauuuuuuuuuaauaucuccaauccacaguuggcugaauccacagacauggcacuuauagauauggagggccaauuguaucauuuagcacuauacuaaguggaagaaggcaaccugaaaaggcaacacaguguaugauuccaaccauaugacauucuggaaaagguaaaacuauggagacaguaaaaagaucaucaaauaguagaugagguaucuaaaaaaaaugaaccaacaaacaaaauacaaaggucagugguugccagggguuggugugggagacagauggagaagcacagggaaauuucggggcagugaaacuauucuguaugauacuauaaugauacccgucauuacagguuugucuaaaacaacacaaaauacaauacuaagagugaacccuagucuaaacuagagucuuugggcgauuaugauguaccaacguagguucuucgauuguaacaaacguaccacucuggugaagaacugcugauaaugggggaggcugugcauauguggaggcauagggcauaugggaaauaucuauuccuuccucucaauuuugcugugaaccuaaaaccacucuuaaaaagucuuuuagaagaaaaagaguaauucagcuauagaaggcuccuccagcaugaugugauaauuaaaauugucaugacugccuuaagaaaaaguaacuugcuuacccagauggaacuuuucuugaugcuuuaaccgagcaaaccgugauuuaaaauguucuucacaauagguacacuuaaaagguuuaucuugagaauguagaaucauauguuccuccaaguguggucuucgaguaaaagauuucuuacaaaucuaaauuaaaaugcaaacaaaauguuaagagaaccugaauuaaaaauuguaauauuaagcuuguaaugagaagaaaaccauauaaauucaauaaagagacuuuucucccaacagaaaacuuacaaaaaguaaaauucaauucuaauugugcagaaaaaaaugcucuagaggaaguaaggaaugauuuuaaauuaguacuaaagguagcugaauuucaacucuuuacauuucuaguagggauacagaauaaucauacuaucuuaauucuagucagaauuucuaaauccaugaaauauauuguuuuuuagucacuuauguca

SEQ ID NO: 12881 - RNA, 2658 nt, Homo sapiens
ucacaaguuuguuuccgcucaagaguaucccacaauuugauuuaugcuaaauggggagugaguggacaaagaagaauaucuaaggaaaccuaaagaaaaauagcaucuagagagaacaggaacacagaagaaauggauggugaaaaagaauugcugguggagaugaaugacaacuuuaauuuugaaaaagcaccugagaaaauucagucaguauaaaauaaacuuucuagcaauuaaacuacauuaaaaugugguagaaaaagagaggcauggccacuauuggggacuaaauaguggccuuggauaucauguagaaguaguuaucuuuggaaaaguaaaaauccaaagacacggagauuucaaaaaucaaaacaccuagaagacgagucuaagauauuuaaugugaguaagugaagaaccacaaggagaaaaagggaaacgauacaggagggcacaauuacuaaauacuauaggaaacuuuaguucgaaagggcucucacucuaauagguuccaagcaacaugggugggguuggaguguggggacacaccuaggcagauaaauuucauucaaauauuuauuguuacuuccugcagugacaaguacuguuuuaguugcugggaauacagggugaacaaagcaauguuaguuccuuuauuggguggaaggaaguaaaugaauaaauaugucucaggugguaauaaguaauacaaaaaaaaaaauaaagcauaguagagugacuaggcuauguugggauaagguaguggcaggauuuacuauuuuauauggauggucagagacaucucagauaagauauuugaucagcaauuugaagugagguaucuagugugguaaauauguggugguggggggagagcaagggcagggggagcagcauuccagauagggaacaggagguuuaaggcaggcaggaacauaccugccauuuaaaggaccauuaaggaauccacuuggcuaguguggagggagcaagaagagugagcaaugagggcagaggcaguagugaacaagauuacggagcuuuguagaugaauggaagccuuuuuggcuuuaauuugcugauacauaugggaagccauuugaggagcuguaagcagaggagugauacgugauuuaagaguaauugacucaaccuucuuguugguagcaaaggcagaagcuaggacaccagaucauuggauauugcaacaauauagacaagaaaugacacaggcuuggacccgugugguaucaguggaguaaaacaaauggugagauucuguaaauauuuugaaaguagauggauaggauuacaaugugugagauacaaaucaaaaacacuucuuuuuuuuuuuuuuccccucaguaacaggauggaguuucuguuuauacugugauggggaggauuguguaaggaucagauuuugcagugguagcagcuggaggaaucaauuuaguuucggaauguugaguuugagaugcuauuaaacauggaggagauauucaaauucuugaauuucaggguaaaaagaggaauuuacaaaggaaaaagaaaaugacaucucuagacuuuagaaugcaaccaagaaucccuuuuucagguaagaucauucaucuugaggauauguaaugauccaaaugauauaucuguauguguauaacuucacauaaggaaaauaacuuaaaaacuuuaaacagacagcaaauuauaacaaaggccuguauucucugauagagugacuggguauuuauaacauaaguguuaaguaaucuucaagcagaaaagauaauacauggaaaaaucucacacuaguaacuaucaguacuaaaguaagcuaucuuagcaaaacuuagaagugacagcugagccagaggaguagagugagugaaagcauucuaaauuucacaacccuagugacaacaaauguuugccuucauggaagaacaacauuuguucuugcaacuaaucagaacuuacauauuuuuaacaaguagcuuucuaaaagccacuaaagcccuuuggaauauuuuuuaaaacaacuucuuuugagguuauggagauuuuuaaauaggucaggaaauuauuucuaaguuguuauauugugaagauaaaaaaguuuugguagguaauauguuugcagccacaaaagcacaaaauacaauguuuuuaauauucaagauguuucaaaauguucuuuacguggcacaaacuuuuuucuaaaaguauucacagacuucuggucaucugauuuuauaauuuuuguccuuguaauuuggcaaagagcuaauacagguuuaggggaaggguuaacucugccauuuccuuguucccauaugcuugcauuauuacuguuaucuuuuaaucuauugauuuuuuuuuuccuagaaaucuuuuugugccacuuuccauuuuguguggcaucuguaaacuguuaucugucaugguaugcuggaugcgaggggauaaggcuucacugucaggucuuauucuccccucaccuuauauacagaucagaugaagccaucuguacccauauauuaacuauuaauaaaguugaauuuaaauacaaauauguauuuuaacaucuucuucuagcaucccacugaauuaucuugcauguucccugaggugugugugccuuacuuuggagaccuauag

SEQ ID NO: 12882 - RNA, 12199 nt, Homo sapiens
caacagcaaucgcccauuuccaaagccauggugaaacaucucugugcuaauuucuuuuguuuuguuuccuaauuuuuuuuuuuuggcagguggugggaaauaaucuuugucuucuuuggaguaaaccuucaacaccggauuuuuucuuuuaauuauggauguaaaccccaauauccccauaauuuacauugggucucgaccaauugccuaauuauaagaggauauauuuaggcucuuauuucauccacacaaaaacuuguguaacagguaguuggaaacaucugaggcaccacuuugauucuguuuuggauggucauguuuuuucuccuccguuuccccagcaugucugccaccauccucaugcacugcuuccaagugccugggagccuuuaugagcgucccuaaaccuaaaagaauccagaggcggggcucggaugaacccucgagauaagcaagugagccgcuucuccccucuaaaggauguuuacacguggguggcacucgcuggaauccagcgcucgggcagcccugggaggacgcgcucagcugcgaggaggugaccggcggcggcgcgggcaguccggaggggcgggacggggcggggcaaggcgggggccgggccggaggaggcgggcucccgggauccgcgguguccggcaguagagcucgcugcagauccgggcucugaccaugauuuggcgccgcgcggcgcuggcggggacgcggcugguuuggagcaggagcggcucggcaggcuggcuugacagggcggcgggagcugcgggagcugcggcagcugcggccucuggguacggggucagcgggcaggagugccgcggcguggugcgcaggccuugcgggggucuggagaaagcggugggcggaggugccccuuugccccggcgccgggugggcgaggcguacuagcgcgugggcucugagucauaacacgcagaggcgcucgagggaugggcagggaagggugcccuccgcggcugugcugacuucaggagccugugacucucgcguugaaaauacuucacucauguucacuuaggccaucccucugugaauugcuacauaaaauacaagacgccgcaaucaauuggaauuucucugaaagagcgaaugauucuuaguccaagugugucccaaauacugcaguggacauaggaaaaacggaacaguuuucugguguuugguuacaauucuaauuugaccgggcguccugcauucuuguuugcuaaacuuagccacccuacugcaggaagugaaggcgaugauucccgcugaauggccagagcuuuuaggauagaggcugacugauggugaugccgccugcggcuagaccgaggauagugcuuuccuuacacuuccucguuuggaauaucagcggcuucgggaccugcaguggaagggaacugcggcugugcugcccacgcccgcgcggcuggugccuggcgguccugccggcucgcacuuccgcgccugccacugcgcacuuggccggagagucugucucgcuaucuacuugaucugggagcuucuaucaguuuugcaagauucuaggaaucucaaguuuaacuuuccagaccaagcuagagaccccuccugaagggcuaaucacaggcuguuaaguguuugacagcucuuugaggccccgccguguuuuuuucugcguaucccuggggucaauauagcacuuugccuacuuagcacacaguaggcgcuccauaaauguggcaugacuaggugcuucaucuguguugaaaugaaauguuuauugugcacuuacuuccuccgugcauguuucuauucauaguucgcgacaguuuuuaccaaggucaacuagaaauugaagggaaagggugucuuccagaaacuuuuauuuggguaauauuucagaaugcaccuccuaccuccucucacuacccaagaaaacauucucuuguguucuauuggagcuccuucaguaguaaaugcuguaguagaugguuuggguaugacaguuuaagugcuggaccugagaugaaaggacuugcuuucuuaguugauaaaccaaauacagcuugcugauuuauuccaccaaugcucuuccuuagggcuaggccagugcugccuaaccuuuucugguuuaggcuucaggaacucaacuuucuuuuaucuuaaagcuucacccuccucucagguuggcugcagucucccuagcucgcuacccuuaacuccuuccugaguuaagcgcacaggacuuuuuuuuuuguuuuaaaguguuccuugcuaauacuauuaggaagcaaggaauaauagauuguaaacauuggguagguuauaauguuauaauguuuaauuccugucucuuacucuucuuuguuauaacugaacaaacugauguuugcuguagcuuccucacucuaggugagcugauaucauaaucguucccccuuauccgugguggacacguuccaagacccucgguggaugccuaaaaccucggauaguacugaacccuauacaugcuauuuuccuauacauacuugccuaugauaaaguuuaauuuauaaauuaggcagaguaagagauuaacaacaauaauaaaagaacaaucacuuuaauaacaaaaugcucauuucaaggaaucccuugcugaaucuucucauaggcccagugcuuuuuggcauaacacauugcugucaguuggaacacuuuuucuguucuugucuccacaaauuuaauaccuuuucuggcuuaacuaagcacuuauaccuuguggcuguaacuugcaguuugaggugugacaucaaaacugccaugaauuuuuuacuucuuuacaacugcacugauagaagauccguucuuaccauagaccuuagcaaccucagcgugugauuuuuuuuuuccuauuagguggagaacuuucaccguuucacuuaaaggaagcacuuuagggcuucucuuugacguaccugaauugccagcaucacuacucuagugguuuggagccauuauuauuauuauuauuuaagacggaguuucacucuuguuggagccauuauuaaguaaaauaaggguuacuugaacacaagcaucaccacacugugacagucgaucuggucaccaagacagcuguugacuaaagcguggggagcuuauacagaguccauaugcuggacaaagggaggauucauacccuggguaggaggaagcuagauggcucaagauuucaucaugcuacuuaaaacuuacgaacuauuuucuucugaaauuuuccauguaauguuuuuggaccacagcugaccuuggauaacugaaaccguggauaaagggggacuacuguguagggcagauguucauuauccaaggauaagauguacuggaaaaagcuauuagaguggauucacuuaaaauaagacuaguauuucaggccaggcgcgguggcuuacaccuguaaucccagcacuuugggaggccgagguagguugaucauaugaggucaggaguucgagaccagcauggucaacauggugaaaccccaucucuacuaaaaauacaaaaaauuagccagguguggugguacauaccuguagugucagugacucgggagucugaggcaggagaauuguuugaaccugggaagcggagauugcagugagccaagaucacgccacugcacuccaggcucggugacagagcaagacuccaucucaaaaagaagacuaauauuucaugcuauccaguuuaaaaaauucugcuugggacuauugcaaaaauuaaacaaaacauaaaaaguagcuuuauguuuacauuuaagaacauuuaaauuuuaaaugcacccccaaugaaugaauacaguauugauuugaaggcagaauauuugaguuuuauaacauaaucacaaggauaauaguuuuuuaaauauuugaaguuucaaaaauucucuuauucuuuagauauucgaguaauucucuuuugaaacaucuauuauaugucauaauccucuuguaagauuuguaauuuuacucugcaguuaguuugcaucaugguguuugauauuguuccaacagugcgguagggccugguugaccaagaaagaugaguggauggggaagaaaagguuccagggauaaaaagauuugaugaugauaaacugguugaguuuuuuuuuuuagugauaauuuuccugacaaugaaugcuuccuuuuacaagcucccaauagcuagguuuuggauaauaaauacugagauaaugagagguccuguauucaggaacuaauaguaguaauguuaaacauuauugagcauuuacuauguggaaggcacuuaucugcuuucugcguaugaauucauuuaaucuucacaaaauccuuugagacgugccagugauuauuguuuccacuuugcagacuaggaaauuuggagcuauggcccauugcgguugagauacuguagcuuccucaaaaaucuuugaagauucccugcuucacaguguguucauagaguuuuggcauguuuuacuaagaaaauagaaacuauauuuuuaaaccaauggucaggucauauggcauaggauggaauauuugaaauuugccaguuauaaauaagagugugucaagcuuuaaacacaguaaauaugauuuuaucaaauaauuaaggguguugggaagcuaguuacauaagcacacaggccuuuuugguuuuagugaaacaaauacuuuguauauugacauuuuguacugauaauaaguaaaauuuuuuucuauuuuguaaguuuggcuauauuuguuuaugagauugauuuuuuucaaauaaaacucgugauaaauuauccuuaaugcuuaauaaacuacauuguucucuuaaauuccuuuuaggauggagagcaauacaucaucaucuuuggagaauuuagcgacggcgccugugaaccagauccaagugagugaugugggagaugauugaaaaacuuuccucuguagaaaaagaauugucccuuauauauuuaauaugcuuauucaauauccaaacuugagauaguuuagcaaaugaauuaagagauuaauauuuauuuuaaaaucugcuaugaaaaucauccuugugacuaagaaguccuagaucauuuugguaauuaaaacguaugagauuuauucuuaaugaagucuucacucccucuaaguuggauaaugagguuggcugcuccuuuucaucauacccacuugaggucuaguguugauaccagucaagcugcccuuagcuagggauccuauuugauuuuggccugggaagcaguuuaacaguuuucuuuguuaguacagaaccuagugugcaguaguuacuccguaaaccauccucucagggauaggacuucuuuuccucuuucuuuuacugagaagcuucguuaauucugccuuagaaaaucucucuuacauguauguuuuucuucccuugcaaccuacaagacauaccauuuuuucucucuugcuuaccacucacuacuaccacaaacaaaaaaaaugucugccuuuaguugauuuggcuaaacuccuagcuguugacuauaacugugagggaauugcuuuuuuauuuguuuguuuuguuuuguuuugaggcagcgucucgcucuguugcccaggccagagugcaguggugcgaucucagcucacugcaaccucugccuccuggguucaagcaauucuccugccucagccucccuaguagcugggauuacaggcguccaccaccacacacaacuuauuuuuguauuuuaguagagaugggguuucaccauguuggccaggcuggucuugaacuccugauuucaagcaaucuaccugccucggccucccaaagugcugggauuacaagcaugagccaccgugccuggccugaauugccucuuuuaaaguaaaaauacaacaucaugggauauacaguuaagggcgagcuugagaagugggaagagaguucuagaaacccuaacgcugucaucuuuaguuucagcucacuuuggaaucucuucaucagugucuaauauaugucagagcccuggaagcucaucucucccuacacgaugguguuagugugucuuguaaccugaggcagcaugguggagggaagagcacuggcuuugguguugugacaagguugagucaaaucccaguauuacgaaccacucagccuuaguuuuguccuccguaagauggauucauuaauacaucucugguauggcaggcccucccuaggauggacuuuuauacuaaauauuacuaguaaacacaagggaaucauaaaaauagaccaacuugcagacagcugggcuaaaacucaggacccuucugacacccaaggguggguauaacuucugaagcaugggucuuauacuuucugguuuuuggccuucaucuugaagguacugcuuaugauccaccacaaaagaacagacuagacaggcugggcacaguggcucaugucuuaaucccagcacuuuggaaggccgaggcagguagauugcuugagccuaggaguucaacaccagcuugggcaacauggcgaaacccugucucuacaaaaaauaucgagguguggugacacaugucuguagucccagacacuuggcaggcugaggugggagaaucaccugagcucaggagguuaaggcugcagugagcugagaucgcacccuuguacuccagccuggacgacagaguaagacugucucaaacaaaaacaaaacaaaacaaaaaaaaaccuagacaaaugucugggugcuaaaucuauccauucaaaaucuuuugaaggucccaggcauucauauguuuagaaacaaaaaacaaaaagaaaaacuucauaggcugcguggaugcauagcagaaucucauagccauugugguaaaggccuggaagguaguuuucaaaccaggcugauaucaucauuauauggagagguuuuuuaaacauacaguuuucaacuucuaccucaaacucauugaaucagcauuucuggaaguagcuuuuccugaauuaagaguaugagaauaccuuaucaagagaguaaugacagcuuuuguacuauaaagguauauaggaaaggauagaaguagagggguaagccuuacauuuuaagaagaaaucauauaccauuccuuaccauugaaaguuauagaauagaagguaaggaguuaacuccugaauaccuacugaauauuugaaaagaaguauaauguuuuggggcugggcgcgguggcucacaccuguaaucccagcacuuugggaggcugaggcggguggaucaccugaggucaggaguuugagacgagccuggccaacauggugaaaccccgucucuacuaaaaaacaaaaauuaacuggccgugguggcaggugccuauaauccuaacuacucgggaggcugaggcaugagaaucgcuugaaccugggaggcgcagguugcugagaucccaccacugcacuccagccugggggacacagugagacuuugucucaaaaaaaagaaauguacaauguuuugguuuuuuuguuuguuuguuuguuuguuuugagacagaguccacuuacuguguuccucaggcuggagaaucacuggaaccaccucccugguucaagugauucuccugccucagccuucugaguagcugggauuacagggaugugccaccaugccuggcaacuuuuguguuuuuaguagagauggaguuucaccauuuuggccaggcuggucucgaacuccuuaccucaagugaucugccugcuucagccucccacagugcugggauuacagguaugagccacuguacccggcugaaaaaggaguauaauggagauuaaauaucuggacuguagagccagauuugccugggucuaaucccagcucuuccaccuauuagcugagaaccaugaacaaauuguugaucuuccucugcaccucacuuuccucaacugugaaguggggacaauaauaggaccuaccucaggauuguagugagguuuaaauaacacagugaagauaaauuguugagaauaguaccuggcacacagaaaugguugcuguauaugaauuggcuacaauuauuauuuauuguuauugcucuaugccaggcacuuuuuguuauaucuuuuuucuaauaacauugcuuugaaaugaaaaauauccucaaucugcagaugagaaaaaauagaugaugcuuaguuugagcccagaaucaugagagaccaaaauccauacccuuuccauuauaucuuaauuuauuuccaaaugguaaugucuagaauuaaaaugauuuuuugugguuuuauuucaggaaacaauuucugauaauuguguggugauuuucucaaaaacauccuguucuuacuguacaauggcaaaaaagcuuuuccaugacaugaauguuaacuauaaagugguggaacuggaccugcuugaauauggaaaccaguuccaagaugcucuuuacaaaaugacuggugaaagaacugugaguauauccucuguggugcuguuccucuuuaauagguuguaaacuagaucacccagagccuagaaccuuguguuaggaaaaugagccagacauucucugaggauagauaaagcagcugcagaucuaggaaccagauucuuagaauaggaaacagcagaguugauuuauuuuauuuuuauucuguguguguguuuugacugggguugaugaguaguguuauuaugagugcuugucuauggaucuuugaguuccucuuggagcucuuggcaagaugaaaguauucuuccucccuuuaccugggcaauacagggguuggucuucaauuacuuuucuaauaggagugcuuuagugcuccauguuuuuagauucuugaaauuuggauuuuuccauaauaugcauaaucagaaaaauguacaguguugccacuuucaaguuuauugaaaguuuauagugcacucuuucccuucaguaaacaaauguaagaaauaacuaaauauuacuguuuaucugcuuuaguuuauuuaaagcuuuaguaaucaggaagaaagguuuuagaaucagauuguuuggauuugaaucccagucugucauguaccaucauugugauuuugugcaaguuccugugccucauuuuccuccaaaacagggcuaaaaauaauaccuaccuuaaaggguaaagauuuuaagauuuaauuugugaaagagcuuuguggugccaggcucauaaaaguacccagaguucaaaugucucguuauuaugugaaaugaucuuaguucugauacuagaguaaagccuaauucuucuuuuguuuguccaacagguuccaagaauauuugucaaugguacuuuuauuggaggugcaacugacacucauaggcuucacaaagaaggaaaauugcucccacuaguucaucaguguuauuuaaaaaaaaguaagaggaaagaauuucagugauguuuauacuaauaaguuugcuaguacagugucaguuauuuaaagugguaaugcccgauaaugucuuuuaaauguuugaggauguuuuaaauacaugcauugucuucacgaagaagauguaaaaauaaugaacaauaaauugcgguggaaaccucuucuucccacuugccaauucuugagaaaaagggaugguauuaaaaaaaugaaagguuggaguuguaucaagauaagaauguauuuuauuaggaauuuagauaugaauuuuacaaccaagagcuagaagguaagcauuuggaauucuuuauuuccuauucaggaguuaacucuuuaucucacauaguuuuuaagugguaaggacugauauuugauuucucuuuaaaauuuaaggcuuuugcugauacacuugugaacuaggcaggaauaucuuauacgauauugugaaaagccuucacacuuuguacuuguagaguaauagaaguauauuaaauuuuuagcauggaaugaaauuuaucuuagagaaacuaaauuacucauuuaaugacuuaauaguucauuaagucauuaaugacuuaauaguucauuugucauuaaaacuauaccuaugggcagaaauuaaaaggagaagauuucggcauuguaugaggaugaacuuuugaaacaguguagaaauguacuuuaguuggcaugggaugguggcucacgccugugauucuagcacuuagagaggccaaggcgcaaggaucaccugagcucagguguuggagaucagcuuggucuacauagcaagacccccauauuuacaacaaauaaacaaaaauuagccuggugugauggcacaugccuggaguccuagcuacucaggaggcugaggcaggaggaucucuugagcccaggaguuugagguuuuauauauauauauauauauaaauuuugagguuuuuuauauauauauuuuuggaaaguagaacucuccaccucacaauuuaacuugaguacauuucauauauauauacacacacauacacauuuuauauauuaaauguacuugaauuagauugugagguggagaguucugcuuuccagaauuuauguguauuuuauuuauuuauuuauuuugagacagagucuugcuuugucgcccaggcuagagugcaguggcgcgaucucggcucacugcaaacuccgccucccgcguucaagcaauucuccugccucagcauccugaguagcugggaucacaugugcccgccaccgcaccuggcuaauuuuuguauuuuuuaguagagacgggguuucaccaucuuggccagacuggucucaaacuccugaccucaugauccaccugccucggcuucccaaagugcugggauuacaggcaugagccaccgugcccggccuuauguguauuguaauacauauauauauauaaauucuggaaagcagaacucuccaccucacaauuuaacucaauuuccaagagccuuugaacacuuaauguguucaauacugggaauacuauucaaacugauuucaauucagcuaaacuuagcaaacaagauuuauccuauaggaagucuuacuuuacaaugauugaagacguucaguacuucauuaaugaaaucgucuuuccagcuuccuaucaacaagaauuuuuaaagugccuacuauacaaagcauuuuccuaguugaucccacagagucacuuggggcagauuaccagaugcugagaagaaaaaacccuucaucagagguggaggaaaaauggauuucaagagugcuucugguuuuugucaggauggaccagagaaucuggaacaguccugaagaaaauagcugguggcuuccuuggccuuuugccaucaaugaugcuucuuacuuggauuuaaacugccauuaggaaaccucuugaucaagaauuuagacaagaauuucauucccaugugauaauuuagguuauaacacuagaauggaacaaagaguagaaugucuuuaguucuuuauuuugcauuaugucauaagaaaguucuugcuauguuguaaaaucguuguuagauucaggcuuuuggggauucugaaaacacauuuuguuagaguugaagucuauuaccugagaaagguaaaauugugucauaauuguucaucauacuagguauuaaggguagagacaaguuacuucaagguauagaaacacugaccaguacucgacugugaaaaacaucuuuaccuuuagcauuuuuuuuuugaaacagucucgcuccguugcucagacuggggggcaauggcgcaaucucagcucacugcaacuuccacuuccuggguacaagcgauucucaauccucagccuccugagaguagcugggacuacaggcgagcaccaccacacuucgcuaauuuuuuguauuuuuaguacagccaggauuucgccacguuggccaggcuggucucaaacuccugagcucaggcgauccgccugccuuggccucccaaagugcuaggauuacaggcaugagccacugcaccuggccugugaagaaacaucuuuuaucaaugcuuccuagacugguaggacauagggugagaggcgaguggugguucguucuugauuauguucagaucuugaaagaauucaacauuagggagagaagccuuaucaaaagccucaaaaacucuacugaagguaauaugauaccugauucucacuauggcuuuauuuaaaauagaagaaauaaacccuucuaauaucugcaucuu

SEQ ID NO: 12883 - RNA, 32298 nt, Homo sapiens
caaaagaagaggggcaggacucguucccgggaaccgaaccuggaauccccggcggcaguggggcuguugcuguugcuguggcugucgcugcccgucaggcugccuucuuuugucguuucccagcgcugcgcaggacuucuccuggcggcgcugcggauccagggggucggcugccagguacaggugaggacauugcgggaggccggcugggagccuuuugugcggccccagggacgcgcaaauucugaccaguccuccaugucucucacccgcaucccagggguugaggcugggcaaacgccgcgaaacuaucgcucuuccccgucccgcuuccgcgccuguccacccuggguaacggaaccagcaucgcgguagggacauccucgcuaggcccggccggaccauuccucagggugggcccuuuccgaagccgggaccgcuccugcuugucggcaucgcuccccacaggccgacgucgagagggccugcuuuacuccuccucuuucuccuccuucucccgcggcuucugcgcggagaggcgucgcccgggaucuggguuuuggaagaaggaucuuugugggaagacagggugaauuuaucacagaggaauaacgagggagaggagaaagguuuguccauggggcugcuagacuaguggaaggggaugcggugcgucaagggaaaauuagguugaaaacaaaugucguguauuaaucuaaaaacauuuggaaugguucuaaaacuggaugaugaguuaaaccaaauauuuacuaaauauuuacuaaauugcccucauucagcaggcucuuauagaauacuauaguguuaagauuaaaguuuuuaagaguauauugaagucguuaaguguauauuuacuccuuaaaagcuacauauuccaagaaagaccuuuggcuuccagaaaaaaaaaauguuuuaguggguaaaacucugacuccuuccuucucaaauaggugacuugugcccuggaguuagggagccuugugcuacagauuaugugaagccaugaaauaaacgugguaaauuuuauugagggaagcaacagagcagcuuuuguauuaaaaggagccugaguacgcuaugggguagaagccaaaauuuguaugaaguguugguuuaaaaaaaauuuuuuuuguaacuuucuugaaguuuaucuccggaaacucugcccucaacuuggagacuaggaggauucuguacaguauauuuccuugagauacuuuauuggaaaaguuuaagaggcacagaguccagaaugauuggcaucagagcccaaaguaguuugugguauuuuuuuuaaucuguaauauugcuaugaacuugaaaauguuuucugugcaaaauacaucaaaacuaaaauguacuugauacccaacuuaauuaacaugguaccuauuguagaaagaccaaacugaaaauuuagccuuuggcacaaucuagaaguaagcagagaaggggguuaagaugccuuucauuauguuaacguuuaauccugagaguuuacauaaaaagccagauuucugggucuuugagaaaaaugagaucuggcaacuacuaguuccauaccacguggcaaccaguuggcagcuccccucagacuagcaugcugucauuuuugccacaguuccuuccucaucaguuuuuauagcaucacauugaucaguggauucagauaccuguaucauggguaaacaaaccucuaucaugggcccaauuuucuauuguuguuucuuuacauuugucaugcacucucauagauaugucagcuuugacuucauuuaaaaaggaauaaucugcaaauguguuugacuucuugagaugaaaggcagcauuuucaaauaaauuauaaagagacuuuggaagauauugagauguguaaauucaagaaaaauguaggauuccuuggaaauaacacauuaguacugauaaaagauacuguauaugcuguaguucugaugauugugaaacaagugcuauuauauaauguguguuacuagcauuuccugauuuugcauucuaaauuaaauuuaaaaguagagaaauggacauuguauaaaauauccacaaccaauuuaauaugcggccaugcuuggccgggcaccguggcucacgccuguaaucccagcacuuugggaggcccaggcggguggaucacgaggucaggaguucaagaccagccuggccaacauggugaaaccccgucucuacuaaacauacaaaaaauuagccgggugcgguggcaggcgccuguaaucccagcuacucaggaggcugaggcaggagaaucgcuugaacucggagggcggagguuacagugaguggagaucgcgccacuacacuccagccugggugacagagugagagucugucucaaaaaaaaaaaaaaaaguguccaugcuuuuaauauuauaguauuguaauauuuaacuucucaagaacuuaauuuauagagauuuaauacaacauuaguuguaugguguguuuuaagagcacuagauagauaggucaggcccauccaaagaauuaacuauaucuuuuuguuguuaaucuggauuuacaacacuugauuauccaggaauggauuaacugaugaccagguucugaccucacucacugcccaauugccuucuaaaccacugauaauggagcuuaagcuuugaggcaggagaugauggcaguuggagaaagaagaaauuaaguugcuguauaugucuuguggguaucucaaauugcuuuuaaaagucaaauauaaaaauuguagggcuaaauauaauuuuuguguaaucaauuguauuggugcucuccauucugauauagauaauagcagaguuaagugcuuguuuauuuaaauaacuuuccaaauauauuuuaccuggcuaguuuauguuuguauuuuuaauaauagauuuuuagaauauaauucacauaucaugaaguucacuauuuugaaguauccagugcauuggguucuaguauauucacggaguugugcagucaucaccacuaauuucugaacauuuucaucacccaaaaagaaauccccuacccauuagcagucacuucccaguguucccccacuccgacagccucugacaaccuuagacuaauguacuuuuuauuucuaugaauuuaccuacucuggaaaauucauauaaauggaauuguaauacaauauguggccuuuugugacuggcuucuuugacuuggcauaauguuuucaagguuuguuuacauugugucauguaucacuacuucaucccuuuuuauugucuaauaauaguccauuguauggauauaccauauuuuuuucaucccuucaucaguugauggacauuuggguugcuucuccuuuuugaccguuaugaguaauguugauaaaaacaucuggauacaacuuuugguuuagauacauguauucauuuuucuuaggugugugguagaauuccucggucauaugcuaacuauauuuaaccuuuugagaaacugccagacuguuuuccaaaguggcuguaugauuuuacauucccaccagcaguauaugagcguuucauuuucucuaaauccucaccaacacuuaauauuauuguuuugauuauagcuguccuaguggaugugaagugguaucuuauugugguuuugauuugcauuucccugaugacuaaugauguucgucaucuuuuuauguguuuacuggccauuugauaaucuucuuuggaaaaacaccuuuucagauucuuuacccauuugugugucuuuggaguaauauucacaucuuuugccuauuuuuacuuggguuauuuaucauuuuauuauuaaguuguaaguguucuuaauauauucuagauacaagucacuuauuguauguaugauuugcaaauauuuuccuuuuucuuggguugucuuuucacuuucuugaugguguccuuggaaauacaaguuuuaaauuuugauaaaguccaguuuauuuuuuuauuuugucacuuuugccuuuggugucugcguuccaacacuaauucuguagcaucagcugggugucccccacuuccguuuaguucuggcacuagcugcccaggguuggcaucagaucccacaaauuaaaggacaagguccccacuaagaaugccauuaauuuggacaccagcuguaaaugggguccccaggcuacucacacuucugcccugcggacuacaaauucaagacuucccauaauccccucaaggcugauaguucacuagaaugacucacauaacucacugaaagugcucuacuugcaauuacaguuuuauuauaagggauacaacucaggaacagccaaacaagaaguagacacauauggcaaggucuggggcaagggaaggaugcagaacuuccaugccauccuugugaaaugugggauacaacucaggaacagccaaacaggaaguagacacauauggcaaggucuggggcaagggaaggaugcagaacuuccaugcccauccuugugaaaugugggcacaucaccuucccagcacaucaguuuuuguucaccaaggaugcuccacugaguaucgaugaagaaaguuuuuaugagguuucaucacaugggcaugauugauuaaaucauuagcuacauggcugaacuugaucucaaguccuccuccuuucauggaagguuggccugaccaguuuauuccucuaaacauauaguuggucuuucuagugauuagcccccauccugaagcuaccuaggggcccauguugccucauuaauguaacaaagacacuccuauuucucaggaaauaccacggguuuuugaaacuuucugcuggguauuauguccaaagaccagguacucucucuuauaagaugccacaguaucacaucacuuugccgaauuuugaguuuauguguguaucacacucagugacaagaaggagaguaacuugggacauguuauucuguuuucugucuuuuaaaauaugaauaugacccugguaaauuuauauaaucaaguaggaaggugcccuggcugcuaauaauguuaucuguuccacuguuuuauguugcacucuggaaaguacagucacagaagcauaggaaaaccugagcaguuucugcugcagaaauacugaaaggguauguccucaggguugucauuuauaucauaacaugcaaaaggaagaguccaugaauaaguaacuuuauuucuucuaauagggauuauaaggauuauacuuagagauuaccucuuagacauccuucauagauuuaaaaguucauuuugcugcuugcucuagagaaguaccugaauaccuaauauuaaauauguuagaaaaacagaaauuuuguucuuagaugacauuuuuacucaguauucauuacuuuucuuuagaacuuuauuuuuucuugauuauauuuuucacuaccugcauauaguacauuuaucauucugauuacagaauuuaucuuaaagacuuguauuauauuuugcauuauaaauauugaggcuuuuauucucaaaauguguuaugggaaagagaaaccaauugugcauaauuauuuggcaaaugguucagaaagucaacuuuaaugauauuuggcuuuaaguauguauugcuaauuacauaaaagcaauacaaaagaggagacaaaaaugauaagauuugguuucuacuuucaagggaaccaauaauguagcuacauguggucacaaugaauaauacaaggaaaagaauuugaggggagagggaauuuugagguuugguuugggaccuuuuaaaucccaccacuugggccuuggugcaggaaagcaaguuuaguagaauuaucugauauuagaugucauuucaguguuacucaucuaacaaauaaaacuaauaagcagaaguagacagguugaagugcaaccagagccuguuuuuaugaaagcugagggagagacuagcaaagucuauguaauguaaagaucagaaaaacauaacauugucuacuggaauuggcaauuaagguaucagucuuugagaagcauguuagucuucuuaaaguguuuuggaucgaaagguagagauaaaagccaaauuugaaaagaggauaauaauaaauaggagaacaggcauccacugcaacaggaguuucaaccuaugcuguauucaguaacuaugaauuugucccuaaugacuaauaugaucauuacaucucugaugccaccugagaccuaggcuuccacuaacauaagcaaauuuauacuagcgucuuauuuggaauauugacacuaauauuccgaacacaauucagaucacugucccccucagucacauucaaaaugugaggcucuucauucucccaugcacuuaucccuacaccacuauguguuccccucucugagacccagucuuucauuccuccccucucuaccaaacuucuccacauaccauuuggcauucuacaucuccugucaggggggaaugucuucaguuuccuuaucccucauuccuucaaaucuaucuuuaccuauacucuuuacccuuaaaagauaaaggaaauaucucuugcugucaguaggccagucucaaccuggaugcucuaagcucauucucauuucuuuaagaaauuccuucaguuaucccccuucucuacuguaucuucagcucuccaaauugaaucuuucaauguuagcaucuucccauugaaaaagguaaaaagauuuuuucucuaagucccauccucuuuuacuuuccuucauaguuuauaaguaugugucuacaaaagaguagucuagcugugaaguuucuuccucacugcauauucuccugaucucacuguaaucaagcuacuucuuauaccacucuacugcaguugcucucacuagucacuccuacuugcuaaacccaguggucauuuucuagccuuuuauuuacuuuuccucugaccauuugaaauuaccaaccauucacuccuugaaguucucuuccuuguaguccaugauacuauucucugucgguuuucuucaacucugugcaccuccuuuuccgucucucuuuaaaaggccuuucucucauuagcuuuuaaugguuaauauucaccaagauucuauccuuagccuuccuuguaauauauaaacauguucaaguaagcaugaucuucagaacaaaacuucuuuuaucuuguguuccucuuuaaguuaugaccguaucugucaacaugucuuuauggcucuacaggaugcuuagacaguuucuuuucuagaauauaaagacagaucgagauuucagaaaccucuuccuggagcgccuucccuaaacuuuaucaguuuuuuaguuugccuucucugcucaaauccuucuggauuauuuagacaguauuauuuuauacuuccuugcucacucacuuuuccacuacagcacuuaaucacaauuugccuucucugcacaaaucuuucuggauuauugagacaauauuauuuuauacucccuugcucacucauaauacuuuucuacuacagcacuuaacuacaguuugcauugugauucuauccccacaaaugagugugauuuuccugugaugaggagaaaaaaaaauuuuuuuucuuucuuuuuuuuuuuuuuuuuuugagacagagucucgcucugucccccaggcuggagugcaguggcaggaucuuggcucacugcaagcuccgccucccggguucacgccauucuccugccucagccucccuccugaguagcugggacuacagcgccugccaacacgcccggcuaauuuuuuguauuuuuaguagagacgggguuucaccauuuuagucagaauggucuugaucugaccucgugauccgcccgucucggccucccaaagugcugggauuacaggcgugagccacugugcccggcccaaauuuuuuuuuuuuagucucuuuaaugggagagaaauugucuucaugucuuacacauaguauguauucaguaaaugcugguuuaaguuuuuguugguugugcuguuuuguuagccauggacagaagcccagugcaccgaaauaacaugacagauugaaggaccucaauaaacagugauacuguaguaacaauagugguggacugaugaagaagugacaauugugguuccuccauuagaaggauaaagagggauguuguuuccagacagcuaguucuaggaguuuuagagcuaauggaaggaguagagugaggguaguuacagaugacauaaaaccguaaaccuaaaaauggcuuaaacaauaaggauacauuuaugacauaauaggaaguguauaagcagggcaguuucagguaacccgauaucaaggacccagguucuuuguuuuuucuguucugcucucuuuauauauuggugugccaucuuaaacuggcuuaucucaaggucugaagaugguuguuaccacuccaggcaucacuugcaaaugaaaaugucagaaggcagaaaagggaacauuucuuuuuaagagccugagcccccuuuuaagacugaagaaaaccucaaaaguguucucagcugacuuaucaugucauacuggccagucaugacacaugcccaacucccuauaccagucauguggcaaggagagcaccaugauuauugggccugggucaagcagcagcagcagcugggaacuugugauaaguauacaugcuuaggccucacugcagaccuacuaaauuaugaaagaaacucagggcagugccugagagggcugacccaccaaucuauguuucaauuaguaauucaaguaauuuugauguacauugaguuugagaaccacuggcuuagagcaauaaagauccaucccuuggggcuagggaaaggccuagccuccuuugaaggauaugaggccaagaagaggagaagagagaagggggaagaaugaauguuagauaggcaaccaaacauguuuacacaauucuucagggaguaugaucuuucuuacuuagugccagcuacuauugcugcccucccuucuuuuauucucugugugggccucaagaugccauacugaucuaccugcuuaaucucugaaggagcacacuguaucucaaaaaugugacgccuuaguugcuucugauuaucacaccacuguggcuaugauuuguuuguuugcugugaagggcuuuuaguuucuuuagauuauaaaaauaggaauacaaaacaaaaacacuuuaaaaacugaagauauuacugguagucauuucaaaguauucagauaugguuuuuuucuuucauuuucugccuuuccugauuuuucuucaggacauuuauauugauuuuguacuaagggaaaaacuauggaacuuaaaagauguuuuuaaauuaaaagaguuaauaacauuucaguaaaccuacauuuuguuuuccuuuuguaauuuuauugugcccaucuaguuguaauaacauuuugccuuuuuguuagguuuccuaaagacaaaaaaaaauggaggaaucuguaaaccaaaugcagccacugaaugagaagcagauagccaauucucaggauggauauguauggcaagucacugacaugaaucgacuacaccgguucuuauguuucgguucugaaggugggacuuauuauaucaaagaacagaaguugggccuugaaaaugcugaagcuuuaauuagauugauugaagauggcagaggaugugaagugauacaagaaauaaagucauuuagucaagaaggcagaaccacaaagcaagagccuaugcucuuugcacuugccauuuguucccagugcuccgacauaagcacaaaacaagcagcauuuaaagcuguuucugaaguuugucgcauuccuacccaucucuuuacuuuuauccaguuuaagaaagaucugaaggaaagcaugaaauguggcauguggggucgugcccuccggaaggcuauagcggacugguacaaugagaaagguggcauggcccuugcucuggcaguuacaaaauauaaacagagaaauggcuggucucacaaagaucuauuaagauugucacaucuuaaaccuuccagugaagguaagcauaagaucuucauugggaagaaggguggguaagggauauucaauaaauagcaaauuuuuauuuaacauaagacaaguguguaauauuuucuagaaauagccuuuuauucucaaaauauacauuaauucaaauauauuuaaugccuuccugggauuacaccccuaccacaggcgauccagacauuaauaaucaagaaucaaaugacagguuuauagguuaauauucugaaucuuaaaaugccaccguccuaacuggaaugcucacccaagugauucuggacuguguaaguagcaggggcaagacuaaaaguugcaauaagccuuggauauggguacagucacuagaaggaacugcuuuugaguuccagcuuugccaguuacucaucagauauucaaacuuggucucaguauaaucguuuguaaaacuuagguaacuguacacagcuguuccuuaagauuauguauagaaaacuacucuguaaccaauaaaaugcuaaguagaaaagcaaaaaaaaaaaaaaaaaguugcaauaagcaaaucagcuccuugccaguaggcggcagauggccaugcuguacccacugcucuagcccauuccuuuuuucccuccccaucuuccuaggaacccaucuuccauggaaccuaaaggaauauaccagauauagugcugaacuuaacaauucaggaaguuaauugucuucaggcaguuagucaggggacauaauaacuuggggcaguuuuucuguaucuauggaaagagacuuuugaaaaguuaguuggcuccguaauaauuacuaguccuuuuaagaaaagaaauaagaaaaacucuugggcaggaguaauuugaagugugaaguuccacaaaaaucaacauguucaaaauuugacuuuuuuuuuuuuuuugcaccggaagugaaacuugaaaagacagccacucagaaggguggguucacauuucaguucuguggacuuaagccaaguaaguuaagcugaguuucugaccuucaucuauuaaaaggaggguaaggagaauaagcuuacaauuauugagacuaaaugucccagcaccuaacauguaguagaaguacacuuugguucucuauuucucccuuccacacauauuuuuauauacagaaucucuucaguaauuccugacuuauuuuuuaacuauaacugggguuuuucaaaugaaauguaaauaauaaauugcaaauauuuauauguauaaacauuuuauuuugauuuuauuagauuacauguuuuaaaauaguugaauaauacagaaaaauaugaugcaguccuacucuucaaaagaaauaacugcauaucagcaguccacaacccuucugauaccagggacugguuuuguggaagacaguuuuuccgcaggcaguggggagggcagggugguuucagaaugaaacuguuccaccucagaucaucaggcaucagauucucauaaggagagcgcaaccuagaucccucacaugcucagaucauaguaggauucgugcucuuaugagacuaaugcccagcuacugaucugacaggaaguggagcucacuugccugcugcucaccuccugcugugcagcccaguuccuaacaggccacggacugguauccguguauagccugggaguugagggcccuugcuguauaucagauguuguaauuuacuccagauuuuuccuaaacauauauuacuguguuucacuaaauuuuguuacaugccuucuauguuucaguaaaaaguauauuauugcuauugcuauugcuguuucuuucaggucaguagaaauaguugcauauauaccauuguaugacuguaauuuauuagcuagucucuuauugacaagaguuguuucugguuuuuuuauacuguuacaaaaauacuacaaugaaaacacuugcauagaguaccuacuuucauaaugguuaaauccacaaacaguaugugaaagggaucaguguacccacauuugaacacuuaacuguugucauuauuuuuuaaucucuuucaguagaaucaugaaagauucuuugaauuuacauuuuugggcagaagcucaucuuugcaugugcugauuauauauauauauacaccuauauauuguauaauauaguauauauaauauauaauguuaguauauaguauaguauguaauauauauauaccuauauacauauauauaccuauauauguaugcauauaauuauauguauguauauauaauauauauguauguguguguauauauguauaauuauacaauuacaucauagcccuuuuguccacuuaguuacugucuuuuuaacuauugauugugaucacuauucauucaacaaauauuuauuuauuuauuuguuguauuuauuuugagauggaguuucacuuuugucacccaggcuggagugcaauggcacaaucuaggcucacuguaaccuccaccucccagauucaagcaauucuccugccucagccucccaaguagcugggauuacaagcuccugccgccaugcucugcuaauuuuuguauuuuuaguagaggcaggguuucaccauguugguaaugcuggucucgaacuccugaccucaggugauccgccugccuuggccucccaaagugcugggauuauaggcaugaaccacugugccuggcccucagcaaauauuuauugagcaccuacuauggauagaaacuguucuaagaacuugggguucauauuagaggaguugauaauguauuauuuauauacagugcaugcauuuuuucuucuuuuuuuucuuugucuuuuuuuuuuuugguugggggacauuucuggcacacuaaaguuuugaauuuuaauguagucaaauuuauccaugucuucauagguuuauguuuuguguuaggauuagaagggccuuuuccaaccuaaaauauuuaucugugguuuuuuccuaacauuuucuugguuaagaaacauuauuuuuuacauuuaaauuuuuuauccaaauauuugauccaacauaagaaggacuuaggcauccagcuuuauuuauugguuuguugagaugugucuuggaaguguggagcaaguacuagacuaagagaaagaccgcccauuacuaguucuaacuggaccaauuaguuucugaacuugugaaaauaauuauucugugcuuugucuuuuuggucuauauaaugaggaauuaguagauguuuccuaaacuuacuuccacacauaggauucuuuaauuugaaauuguugagggcagaacucacaguugaaaccauguuaguaauagcaauaucacauuggacagagaaucccuagcauuucaaagcuuaaaaauuuggaaaaacucuaagcuacagaauuaauaguauuuuaaugccuuuaaguguaauguguauuuauaacagacaaaacaagucaaaaugugauucaagucaucagguaugguauuuuuauugugcacccacugcauggccagcgcaauuacagaaccggguaggauaaaacugcuuuaaggaauuuuuauuuucacuggaaaaacaaaauagaagauauacucacaggaaacauuuacucauuuaagaugauuuugcaccaaaaucuggaagauagcaagagucacaauacuugagaaguuccugcauguuaguguuaacuuuugaucaaguuauuuagcauucaaaaauaacauaauaggcucaguuggcauagagauguguuucauguggccuauacaauauuuuuggguaaaaaugaauucuuugucauuaucuuuaaaaaucgacauaaaaacccauauucuggcuucucuugaaaguaaguuuuuuuucuuuuggcagcacuaagucaauacgugucuacaccacuugucagggcacacucuguucagucaccacacccuaacaacucucuauuacaucacuguguuuguuuguuuguuuguuuguuugagacagagucucacucuguuggccaggcuggagcacaguggcacgaucuuggcccacuguaaccucugccuccucaguucaagugauucuccugccucagccuccugaguagcugguauuacaggcaugugccaccacgcccagcuaauuuuuuuuuauuauacuuuaaguucuaggguacaugugcacaacgugcagguuuguuacauauguauacaugugccauguuggugugcugcacccauuaacucgucauuuaacguuacguauaucuccuaaugcuaucccuccccccuccccccaccccacaacaggcccuggugugugauguuccccuuccuguguccauguguucucauuguucaauucccaccuaugagugagaacaugcaguguuucguuuuuuguccuugcgauaguuugcugagaaugaugguuuccagcuucauccaugucccuacaaaggacaugaacucauccuuuuuauggcugcauaguauuccaugguguauaugugccacauuuucuuaauccagucuaucauugcuggacauuugggcugguuccaagucuuugcuauugugaauagugccgcaauaaacauacgugugcaugugucuuuauagcagcaugauuuauaauccuuuggguauauaccccguaaugggauugcuuggucaaaugguauuucuaguucuagaucccugaggaaucgccacacugacuuccacaaugguugaacuaguuuacagucccaccaacaguguaaaaguguuccuguuucuccacauccucuccagcaccuguuguuuccugacuuuuuaaugaucgucauucuaacugaugugagaugguaucucauugugguuuugaauugcauuucucugauggccagugaugaugagcauguuuucauaugucuuuuggcugcauaaaugucuucuuuugagaagugucuguucauauccuucgcccacuuuuugaugggguuguuuuuuucuuguaaauuuguuugaguucuuuguagauucuggauauuagccccuugucagaugaguagauugcaaaaauuuucucccauucuguagguugccuguucacucugaugguaguuucuuuugcugugcagaagcucuuuaguugaauuagauaccauuugugaauuuuggcuuuuguugccauugcuuuugguguuuuagacaugaaguccuugcccacgccuauguccugaaugguauugccuagguuuucuucuagggcuuuuaugguuuuagguguaacauguaagucuuuaauccaucuugaauuaauuuuuguauaagguguaaggaagggauccaguuucagcuuucgagauggaguuuugccacguugggcacacuguucucaaaccccugaccucaggugauccacacuccuuggccucccaaagugcuagcauuacaggcaugagccauggugccuggccucaccguggugguuuuauuuauuuuauuugcuugucccucauagacauuuuaauguuguaauccaaucccugcuguuuuacagaaguggugaaacuaagaccuagaaagaccaccauuuauuggcagaguauaggcuagaacccagacuuucucacccccaauccaaggcucuuuucucuuucuucuauuggaagaaauuguggaggaaaucaacaaguuacuguuuccuuuuuuuuuuuuuuuugagcaguaauacuucucagcuauuaaaacauaguguaaaagaagcuacccuguccacuucuacuuauuucugcuguuuuuguaaauauauauauuuuauucaacagcaaaaagagacaagugaauauaauuaauauaauauaauacauuacaauacaauacaauauuaauugagauagaucuguacucucgugaguuguucugagauuauggaccugaaacuuucuaaugcuggugucuuuaaaaagaaaagaaagaaaagccucuguaacaaaauacucaggauacagguuuuuuuacucuaaagucucauauuuaaauaguaaugauggaauaagaaaauuaauucaccccauuugcuuaauuguuauaucauggaaagcagcaucccaguguaagggcauuaacucuuguguauccaguuauguugaucauauaaugcauuuugaggaaacauguucuguuuuuuuacuugguaauccugcaugcuuuuucaauucuuuaucuuguuaaaggacuugcaauugugaccaaauauauuacaaagggcuggaaagaaguucaugaauuguauaaagaaaaagcacucucuguggagacugaaaaauuauuaaaguaucuggaggcuguagagaaagugaagcgcacaagagaugagcuagaagucauucaucuaauagaagaacauagauuaguuagagaacaucuuuuaacaaaucacuuaaagucuaaagaggugagugaauuauauguuacagcaugugauuaaacaugaguaauuuaguguaggugcuaaaaggauaaacuugggguagcuauauauuuauacuuuuaaaaagaaauuauuuaaaauauaucuugaaauugaugucuguuuaaaacaccuaccaugauguccaacaugauguagguggcauuuguguuaguuucacuccagaaaaucuacugccuugcuaauuaaaaaaaaaaucaucuaugcauuuccuucauaaaauauacuucacauccuuuuucuaguaaaaaacaaguuagcuuauuugauaagccuuuuacuuagacauuuuucauucugaaaguacuuugaaccccaaaugaaagccucagagacuguauuaugaauauuuuuuuauauagguauguuauacugauuuauuuucccuuaauuccugguauuucugccuauguuauugcaauagguauggaaggcuuuguuacaagaaaugccgcuuacugcauuacuaaggaaucuaggaaagaugacugcuaauucaguacuugaaccaggaaauucagaaguaucuuuaguaugugaaaaacuguguaaugaaaaacuauuaaaaaagguaagcauuaucauuguucuuuauuagcuacuacuaacugagaaaguggcuccuaaauuuuagaaaugccgucagugcauuuuuaagguauuucgagauguucauuauaccaaauugcauuauggcucuuaaguguaaguuuaauacauuuucauuuuucucuuuucuauaugaaauguaguuauuagcuacaauaacacaaaaaucuaaggaguauacauaaucacuguuuuuugcuaaaauuuuccuuauacuuuguuucuaggcucguauacauccauuucauauuuugaucgcauuagaaacuuacaagacaggucauggucucagagggaaacugaaguggcgcccugaugaagaaauuuugaaagcauuggaugcugcuuuuuauaaaacauuuaagguagugauaugauuuuuguuuuaaaacaaaugacugaagacuuaauaucuuuuguaauaauacauuuuaaagguaguauuaauaguuuaaucauuuuuuaauuagguauucauuuguuuuucuuuaguucauauguggugaguauauaauuaauaucguguaaguuuaagaguaaaguauuucucuuuaccuuuggguagcaacuaauuauucuaagaucauuuugguaacuuuuaaguuacuaacuguauuaguuuguucucacagugcuauaaagaaauaccugagacugaguaguuuauaaagaagagagguuuaaucggcucaugguuccacagguuguagaggaagcacaguggcuacugcccugcuucugaggaugccuugggaaacuuacaaucauggcagaaggggaagcaaacacguccuucuucacauggcagcaggaagaagugaugagcauaaggggggaagcuccuuauaaaaccaucagaucucgugagaacucauucacuaucacaagaacaguauaggggaaaucgcccccaugauucaauuaucucuaccuggucccacccuugaacauguggggauuaugggaacuacaauucaagaugagauuuggguggggacacagccaaaccauaucaacaaucuuggcagaagggggaauauggugcuaaacuauuagaaacugcccccaugauccagucaccucccagaaggucccaccuucaacauuggggauuacagugaacauaagauugguguggagacacaaauccaacccauaucacuaacuuuagaaauuugcauuccugucagguccuuugacuugguccucuguuuuccccauuaauugguagauagaucucaucagucuugauaaaaaaugaguuuuuuaguaauggaaaucucacaucaaagacacaagcuaaaacaucuugcuauauaacaaaauacuagcaaccaaagucagcagcaaaauagaaggauuacauacuauaaccaagugauauucaucccuggcauacaaagauaguacaacauaugacaaccaaucaauguaauacaucacauuaguagaaugaagugacaaaaaccacauaaucaucuuacugaugcagaaaaagcauuucacaaauuucaacauuccuucaugaugaaaaauaaaaccacuaaaccugaaaugaacuuccucaacaugauaaaguccagagauuuaaaaaacaaagauguuuaaaccccauagcuaaugucauaauggugagugauuguaagauuuuccccuaaaaucaagaaaaagacaaggaugcccaguuuuuccacuuuaauuccacauaguauuggaaguuguaguaauaaggcaagaaaaugaaauaaugaaagacauugcaauuggaaagaaagaaguaaaauuauccucagaugccaugaucuuguauuuagaaaacccuaaaguuaacaaaugaauucagcaaaguuacaggguauaaaaccaacacauaaaaaucaguuguauuucuauauacuagcaaugaacaauccaaaaaaagaaauuaagaaaacauuuccauuuacaagaucaucaaaaaauaaaagacaggaguaaauuuaagaagcuguaagacuuauacacugagaacuacaaaacauugcuaaaagaaauuaagucaugaauaaauagaaacacaucuguguuuacagauuggaagacuuaauauuguuaagaugacaauacuauccaaagcagccaaucuacagauugaaugcagucccuuucaaaaucccaauggcauguuuuacagagauagaaaaacccauucuaaaauuccuaagaaauuucaagugaccccaaauagccaaaacaaucuuuaaaaaaagaacaaaccuggaggacucuucaguaacucuuucaguuacuacaaagcugcaguaaucaaaacaguguggcacuggcaaaagaauaaacauauagaccaaugaaauagaaaguccagagauaaaaccuugcauauauguucaguugacuuuuuuuuuuuuuuuuuuuuuuuugagacagagucucacugugccacccaguuuggagugcaguggugcaauaucagcucacugcaaccuccgccuccuggguucaagugauucuuaugccucagccucccaaguagcugggauuacaggcaugcgccaccacacucaacuaauuuauuccauuuuuaguagggacaggguuucacuguguuggccagucuguucuugaacuccuugccucaagugauccgcccaccuuggccucccaaagugcugggauuacaggcgugaaccacugcaucuggaugucuguugacuuuugauaagggugccaagaugauucacuggggaaaggacaaucuucaacaaaugguauugggaaaacugcauauccacauacaaaagaaugaaguuggaccauuaucuuacaccaaauacaagaauuaguucaaaguggaucagugacuaaauuuaagagcuaaaacuagaaaacaccaaaaacacaggcagcaaaagaaaaaauaaauugaacuucaucaaacuuaaacauuuuguauauuaaaggauacuaucaagacaguuaaaagauaaucuacacaaugggagaaaauauuugcagaccauauguccgauaagggccuaauauccagaauacugaaaacuacaaauucagcaaaaguacaaacccaauuuaaaaaugggcaaaguacuugaauagacauuuuucuaaugauauacaaaugaguaauaaaaacaugaaaagggccaggugcaguggcucacgccuguaaucccagcacuuugggaggccgauaaggguugaucaccugaggucaggaguucgagaccagccuggccaacauggugauaccccgucucuaaaaaaaaaaaaaaaaaaaauuagcugagugugguggcgggcgccuguaaucccagcuacucaugagguugaggcaggagaaucucuugaacccaggagguggagguuacagugagcugagauugugccguugcacuccacccugggcaacaagagugaaacucugucucaaaaaacaaaaaaaaaacaugaaaaauacucaacaucauuaauaaucagagaaaugcaaaucaagaugacaguguaauaacuacuucacaucuaguuggauagcuaauaucaaaaaagcagaaaacaagaguuggggaagauguggagaaauuggaacccuaguguauuucuggugggaauguaaaaugguaaaaugguguagccccuguggaaaacaauuuggcaguucucaaaagguuaaacguagaauuaccauaccauccagcaauuccauuucuagguauauacccaaaagaauuguaaacagguauucaaacagauaucuguauaccaguagucacaguagcauuauucacaauagccaagaguuaaauguauucuugucuuuuauuuuugaugcuauugugaacaaauguuuucuuaguuuucuuuuuugaauuguucauugcuaguauauagaaauacaacugauuuugaugaacaacccaaauguucaucagcagauggauaagcaaaaugugguauauauaauggaauauuauucagccuuagaaaagaauuaaauuugauacaugcuacaccauggauaaaucucgaaaagauuauacuaaguaaaauaagccagacaaacaaggacaaguauuguaugauuccauuauaugagauaucuacagcaggaaaauuuauagagacagaaaguggaauagaaguugccaggggcuagggagagacauggcaauggggaguuacuaccuaauugguacaaguucuauuugggaugaugaaaaaguucuugaaauagauagaggugauaguuacacaacauugcgaauguacuuaaugccaccaaauuguacaucuaaaaaugguuaaaaaggucaaauuuauguuauauuuuaccacaauaaaaauuuccuacuaaaaauucucauuuuacuucaaugaggaaagauuuuaaaaauaggaugguaacuuauuuaacuaaaauuauugaauagguuauuuccuuuguuuuaccuguaaaagcuaaguauuuuuauuauuuuuuuuuaauuuucagucauagcugcuaugccagaugagcauuuuuaaauaguugucaauugguauaucaaaaaucugaaggccuuuuaucagucuuuuuaauguaagauaaguaaauaugauuuagaaauuuagucuacuuauaauuucuguuaugcuuuuaaugauuguuuuguuuucucuguagacaguugaaccaacuggaaaacguuucuuacuagcuguugaugucagugcuucuaugaaccaaagaguuuuggguaguauacucaacgcuaguacaguugcugcagcaaugugcauggugagaacaccuaagacaauuuugccauucuaaaaacauguuuacuguagagcaaaacuauaagauuaauaaugauuaagaauuauguuuucacuuuuuucugucauuucagcuugucacauuuuuaauuuuauauuuaaagauaauuguguaaagccagaguguuaaguguguugaaaaaguaugucuaaagaacaagcagaguagaaauuuuaauuuuuacaacaaaagauuaaauauuaauggauuuuuuaggaaguagauaaugcuuagauaaaaugaaaaaaagacaaauuuuuuaaaaauuuauuuuaaaaauaaugcuuaaauuauuuaacgauuugaagcuuaaaagaucugggaacuaauaggagugucuagagacuuuaguucuauccugucagugaauaacaaacagaugaauaguaggcaaacuuuuuagcuucuuuacuggggcuuuauuucuuaucuaaugaaaugagaagaauauuuacuguauuugcuucaaaggauagucaugauagccaguuuuuuugugaaaguacuuugaaagcuguacuacuguuaauguauaguucuaaaacacacuaauaaaaaguuaagaaauaaacaucaguguuucuuuuaaacaugaaguuggauaaaauucaaaauauuguauuuccccccaaauuugcugaaaauuacugccauugaauuuuucagguugucacacgaacagaaaaagauucuuauguaguugcuuuuuccgaugaaaugguaccauguccagugacuacagauaugaccuuacaacagguuuuaauggcuaugagucagguaagaaacuguguuuuuuaaguuuacuuaguuaaguuuacauaacguguagaaugauuuuauauugaugucauguaugguauuaaucugugagaacaaaauuuuuuuugucuuaauuuuugcaugacaaguacaaaaccgaaaauauauaugcaggcuuugggaaggcuguauauauuggugcuaaacaaaaugauacuguaaaaacuaguauuuuuaaggauuuauuuacuuauuuauucaugcuuuuguuccgaauuagaucccagcagguggaacugauugcucucuuccaaugaucugggcucagaagacaaacacaccugcugaugucuucauuguauucacugauaaugagaccuuugcuggagguguccauccugcuauugcucugagggaguaucgaaagguaaaacaaauucuaauacgguuccucacccaaauaauauuauuuuaauacuugauuuuuuuuuuuuuuuuuuggagacaggaccucauucuguugcccuggcuggagugcaguggcucagucauagcucacugcaaccucaaccucccaggcuuaagugauucucccaccacagccucccaaguagcuggaacuacaggagcgugccaccaugcccaccuaauuuuuuguaggaaugggguuucaccauguugcccaggcuggucucaaacuccuaggcucaagcgauucuccagccuuggcuucccaacgugcugggauuacagccaccacaccuggccauucuugauucuuauucacuuauguguuucaaaaaauguuacuacaaguaguucuguaucuuauauaggagccaguguccguuauagacucagcaguacuuaaaauaagaaaaaguauugauuacacacauaaaauuuauuuuaaccaguuuccauugcuaaacauuacuaagaauauccuuugcaaacaguauuuuugguaauaaucagaauauuuguuuuaccuuagcuguaaguuuuuuuuaauaauucagugugcuccuugaaaaauugaaaguauuagugaguuuugcaaaaggauuacauaaaauuaaagcuauaaucuaugcucuauguuuuauggacauaucuguguucuaaucaguauccuccaguugagcuuucugaaaugacauaaaucuucacucuccaauguggguugccacuaaucacaugggacuuuugagcacuuaaaauauggcuagugugacuagaaguagaaauagaacuuguugaugaagaguagugguucucaaagugugguuucccuaccagcagucuuagccucaccugcgaccguauuagaaaugcaaauuccugaggcccgucagagaccugcugaaucagaaacucugacguugggacuguguuuuaacaagcccuccagaggauuucugaugcaggcuuaaguuugaaagcugcagguaagggaauaguuuuguuuuguuuuguuuuguuuuuuuaagaaauggggucuccaucacuggagugcaauggugcuaucauagcuuacuguaacuugaaauucuggccucccaaagcacugagauuacagccaugaggcacugcccaaccaggauagaauguagaguaaagacuguuugguugugagucccgagucuuucucuuacucuguguggaccugagcaaauuauuuaacugaucuacaucauaguaaguuacuuaccucuuagaguuguuuuaacaguuacgguagauguauuauuuaaacagugcauuguaguuucucauguguauacauucagugauuguugguuuuucucaaaaauucaauuauuuuaaucuuacauuuagcuguagaggacaaguucuuacguggaacauguguauaucgcacauaucaaagucaucagccaaaaguugaucaucccagagauauguccuuauauauacucauacacacugccccagcauuugauauguugauaaaaauaucuggcacccuuaauaaccugacagguuucauaaguacaaagugccuaggcugcucaauaauguacacugcagcccauagaacaaguaaaguaauugaagagagaaguagaaauuucaggcagauucuuauacaauuuuauugucccuucuucuaaaacucccauauucuagccuuaaaagauugacccccgcaaaaaaaugacuuuguauuuaaaaagcucugguagagaaauguuaaaguguuuuaauuuuggagguauuuugcauuuccuuacauuuauguuuuuaauauguauuuuggucuuuuucuacagaaaauggauauuccagcuaaauugauuguuuguggaaugacaucaaaugguuucaccauugcagacccagaugauagaggcauguuggauaugugcggcuuugauacuggagcucuggauguaauucgaaauuucacauuagauaugauuuaaccauaagcagcagcacgauccagagauccauugccaucagugaucucacuaaaaauauacagcuacuucccagcuaaucuccacccaaugaaugaugaugguauaguaugugcauaauggaaaguuaccuuacugaaaaaaaaaaaagaaggaaaaauaagaugggcccaaaggucuaucuacuaaacuagcucuuggggaaauagcuucaggauacuguaguuuccucuaucuaauagagaacuuuuuguuaacagacacuguaaaauaguuuugcuuuguugaauaauacguguguaccuaaaagagguaagagcaaaaaguguaauuccacaucauguuacuugagaagugcuuaacguuuucuuaaauguuuucauugggaaaggacagcuuugauaauguccaaauacucugaaaugcacuagaccauauaacugugaugaaauaugaaacucaucuguaaacuuuuauaccaaggggguaaaaaaaaaaacuaaggcauuugauuaaauuaugaaugaguuuuacaaauuccuuucagaguuuuacuaagaucacacaaauaacagcuuucuuauucagugaaaaagauauuuuauuucugauguuuuauuugcacuuguggaauauguuaccauuaaucagaaacaucauggcaaccccuaagaauagacuaaguuuguguuggcugagggauucuauuugguuugcuuuuuuuuuuuugcuuuguuauauuuuauugcuacaaggggugugacuugauaaugauuuccucugaauuauaauaacauagccagauguagucucacacuguuuuucauacucuuaaguguaaauaauauaaaauguuucaagcgcuuaacucccccucauucacaaaguauaacaauuaaaaucucaacuauaaccaguuuagcuuuuuccuuacuuuuaaaauaaaauuuuuuacuuuuaacuauuuuuuuaguuaauauuuuuaaaaguauacaugucaauggccucuuuguccauuauucauuuuguggcaaaauauucuucuuugauaguguaaacaaauaauaaagcaaucuagguccuuuagguuugaaaggcaauuuuugaguagcauauuaccagcuagccagucacuaggaauuuuuuucaguauuauuuguauguauuaaacuuuucauuacacuaaagugcauuauuuuauugagcaaguauccuucauugugagguuuaacauuaaagcaaucuguugaaaugccauuaucuuugcucauaauuuuauuauggccgucuaagguagcuuacacauaaaaccuguuugcguaucuguuguucucuaaauauuaauugaagauuuacugaggauuuguaagguccuucucgcuguuaugugaaaagucaaacuguaguuaauguaaauuauagccuuuuaggugcuuggggguuagaggguuuauguuuuuugggaaagggggacuuuaguagucugaggauuucuguacauauuuucuucuguuuuaugugaaauuugggcucugggaauaagaaaauauuccuuucaaauuuauuugacauauuaaugcugguuuugauauguacccauuccuucaaggcaacugguaucaguuuuuaagugugauuuaccugagauauuuuuguucagcaaagcucauagcacccucacccccacuccagacaugcauugcuucugauguuguucacguuuuuaacccugucaagcauugaacugaauauauuagcuacuuuugacacauuaaaauauuacguucagauugaauuuaaaguuuaaagaaacuaauagaauuacguaauaguuauugaauuguuuaaguaaacccaagaucuuaaaaauuauaacaugaucauuuuauuccuaauagaaauguuaaauagaauauaguacaaaagugcauuaccuucaguuguguacuauuuccauaauacuuuuagacaaauauaucuauaaguuaauauuaaauccaucaaggauacaagauuggauggauaugaccuuucugaaguauuuagguaggucuaauuaaauggacuaggguaacauuuaagaaagaaaggauaaguaggagaagcuaccacagaagguaacuuuucaaaucauggcauauuugagcuggaagaaaccuuagaaaccuaaaagcuaauuuuuuaaauuuuuguuagagagcugagguccaagacagagugugauuuugaaguacuauaaccuagaaaucuuggucucuucauuccugugccagaauuuauuuccccacaacaugggaauacauggucucagaagaguagaggauaaaauaaaauuauuuaagacuuuuaccuuauugaguuauuaggaaauaauguauauacgauugcuuuaggaguagaaaaauagaaugggaacauguauaaucuuguaauucauaggaauccucaagcacaauuaaccuguguugcuauauauaucuacauauauagagaaaaaacaaaaacuuuaccucauuaugaauaaaauguacugaagugauaaguuuuuuauuuccugaguuacuuuuaggauuacuguuaaauuaauauuugggaaaauacugcuuuuaaaaacaauccugcaagaauaaacaaacuuuauuuccuagguaguauguaaauaguuccaggauauaguuguaauuaguaaaacaaaaacuaaucuuauaaucccacccuuuauuaguugaaaguucuuggaaauuccauuuauuaauacuuauauuauuuaguaaucuaucuuaugagaguguuagugaggcaagaugcuagugaauggaauuuaguguuacccuuugacaccuccuuugcuuuaucuaacuuacugugugacuguagacaaccaguuuaaccuaagugauuugauuauuuuuauccuuaaaaaguaacauaucugugcuuggaucauagaagaaucagugauuuaauauuuguauaaaaauugaaacugggaagagggcuugcaauacaaguuagaauucuuuuuuuuuuugguuaaaaacauucuuguuaauaagauacguauuucaaaagauaaaauguuuuagaaaaauagcucacucaauaggccuaacaguguuuuaaaacauuccuguucagaguagaaaaauuuagaagaaaaauuuucacagcuaaaguauuacccaaaaagucacuauucucuacugaagagggagaaaaaauauacuccaagaucuucuuggacagaccuagaaaaacaagcuuauacucugaggaaaugcuguuaacaaacuuuuuuuuuugagacaggcuaucccucugucacccaggcuggaguggcaugaucacagcucacugcagccuugaccucccaaguucaagugaucuucccaaguagccaggaacacuggugugcacugcacuaccacgccugcuuuuuuuuuuuuuuuuuuuuuuuuuuuuuuuaagagacaacgucucacuguguugcccaggcuggugucaaacuccugggcucaagggaucuuccugccuuggccucccgaagugcuggaauuagaggcaugagccacugcacccagccagcaaacauucucuuaaucuuuuaaaguaaccaguaaaucuacaaauaguaaaguacuauuuucaucagggauuuuuuuuuucuuauuuucuagauuuuacagaaacaaugugaaauuauuuuggaaagauaagguaggauucuugaauaaaucugaaggucucacaauuaagugagaaacaccuuuaaaagcauaguaaagcuacaccuaaauaacuaaagccuaaaucauuguaauguuuuguuggacuuacuuuaacuugaccuguuguagccacaaauaacaaauuucuugguaacugaugcuauuacaguagguaaucaaaaaugaaaaauucuagucuuauauacugcagguuuggggugauuguuaaggcacuauccccucuggagaaaugucauauggcaucaguguaaacaugcacaagaaagaauuuguaaaaaaaaaugacagguuaaucaaugaaauuaguuguauuuacuguuuggauuuuauuuaguguuuccuugaugucuguuuccucaucucuuauuuguuggaagauuacuuuucuaccucuuuuuuuucuuuuaaaauuccuuucuuacauuucuguuguuucuuuuucuaguccuucucuaucuggauaauaaaaugaaugacaggaaagucacccacauagagguuugggaugaaccuuuugcagauugcuuuuuguuucauacaaguauaagaucauauuuucuuuuucaacuuaguaauaggcaggcuucuuggaacaauaaguagauugauacacuccuccccaaaucaaauuauauuguauaucuuuuauauuagauguuugcagaaauucuguggccuuuaagaucaguuauucagccuuuguaauuauguuaucuagcuauguugaaaagauaagugcuuacuauauaagcacucuuagaaaaauaauuaacugauuacucuuucagaaaauagcaggugucucaaugcuuuuuuuccauaauuauaaagaccauugucaaaaucuuugguuuacuaaauauuucacugagcauauauagagauacguugcuuguggcauaaaaagucuuguagauaacuuacucacauuuggcuuuuuuuuaauuggugcauuuuuuaauuugcuuuuuugaaaauuaugaaguuaaaauuuaauucuaagguaguauuuuucauguauaaaacuaauaauguaguuaagcauacuguuugaauaaaauuauaauaaauggcacaauuccuuaaacccugaaaauaccaaguuauauuggaaaauaguggaaagaaaaaacuaguggagaacaucuuagaaaauucuauuguggaaauuacgaugauuauuuucagugagaaugaauuuauauauacaacaaaaauauacaaaagcuaaccuucucauccuaaaaagauuuuucccuuugcuucuguuuuauuuagcccugccaugcaccacauuaauuuuaugaacauaaaugauauuuaacuuuucuuuuuuuuuuuuuuuuugagacagagucucacuccgucaccaggcuggagugcgguggcgcgaucucagcucacugcaaccuccauuucccagguucaagcaauucuccugccucagccucccaaguagcugggauuacaggcacgcgccaccacgcccaccuaauuuuuguauuuuuaguagagacgggguuucaccauguuggucaggcuggccucgaucucgugaccucgugaucuguccgccucggccuuccaaagugcuaggauuacaggcgugagccaccgcaccuggccaacuuuucaucuuaaguuguuuaaauuuaugcacuuuuagauaucagaauauaugcuugaacaaaggaaauaguaaauuagcuauaugucugcugguuucacuucgauguggauauggauauguggauaaagacaguaaaugaaauuaaaacccugcuguuuuaaauaucauuaccagauauaauugagggaauauuauaucaacaaacauauugaaacuuggcuuuauuuguaacguaaacuauauauaauccauacguagccaaauuagauuuaaaauauacaauuaaugaauaguacucaaaguguuuuuguugcacuguuacucugaauauggacucucuauaucugguauggcgugacugggcauaacuucuguaauguauuucaguuauauguuuuuccuuuuauugccagcuucugauaaugaaauuuuccaaagggaugagauauaagaaucaucuuuuauaaaaaccaguggggagugggguauuauaaucuaguucuaaacuguccauuugcuuuauauaaaggcuuugauuucaauaacugaccauuugaugaauauuuaaauuacacagaauaaugucuacauagaauaaacuuaaguauucaagagccuuaaagugaaaaaaugaaccuuuugacugccuuaaaauacuacuugcucuguaauucaggcauacuaguuacuuuccuuggggucuguuuaaauaaugccuuaauaguguucuaauguuucugaaauacagaacucaaagggucuuuuagagcuuuuaauuuuacauagugaauggaaauuuaaguauuacauuuuaaaaccugauuguacauugguaauuuaaacauccaauaacaggaaaaucuagauacagugauguguuauacauacaugacuguuaacaucaguaauauuuuaugauaguuuaagguuuuuuauuguuuucuauaacaaguuauccaacagguuggacuuuguaacaugauauccaaggaccaaguugcauauuuaacaucgaaugaaaauguaguuguacaguuccaaaaauaauuaauuuuuuaagggaauuuuucaagacaaaaggcaaauauuuuguuucaaaccuacaagcaaauucauuccaagaagugaauauaguaguaaaacauaaagacuauugcaauaaaaaguuuccaggccagugacuuguuuaauuacauucacauuuuuacauucacuuugccuuucaaagcaggaguauuuuauaaaacugaaauaaaacuuuaaauugucaagcuggugcuuaaaguuauguaaaaucugauuuaaguuuauuucauuuccaaggaaaggacccugaaaggaggggacagggagcuuccuaggucuguugauaaacuaacugaugcuuugucaagucuuccaaguuuucacuguaaauaauacaacuaacaauguaauuuugcuguuuucuaauagagaaugaaugaauauauuaauguauuacauuuguuucaugauaaaacaguuuucacugauacugugaaauccuuucucuccuuucuagccuugcaaaauacccuacuaaauaaaucauuuuagacauggagugcagguggacacugugugaacuguuuuuggucaguuauuguagaaauugauagauguaccaaauaaacucuaugcacauuaaacaagugucugucuaucucuuucaagaaauacgaauguuaagguuauaauaugccuuaaaaaaucuaaagccuuuaguaaucuuguauuugaacaagguaaaauuuaaguuuuga

SEQ ID NO: 12884 - RNA, 816 nt, Homo sapiens
aguuugaagaggggggaagaggggaacauggacaugaagaggaggauccaccuggagcugaggaacuggaccccgucagcuguucgagaacuugucuuggacaauugcaaaucaaaugauggaaaaauugagggcuuaacagcugaauuugugaacuuagaguuccuuaguuuaauaaauguaggcuugaucucaguuucaaaucuucccaagcugccuaaauugaaaaagcuugaacucagugaaaauagaaucuuuggaggucuggacauguuagcugaaaagcuuccaaaucucacacgucuaaacuuaaguggaaauaaacugaaagauaucagcaccuuggaaccuuugaaaaaguuagaaugucugaaaagccuggaccucuuuaacugugagguuacuaacaugaaugacuacugagagugucuucaagcuccugccccagcuuaccuacauggauggcuaugaccaagaggaccaggaggaaccugacucagaugcugagguggaugguguggaugaagaguaggagggcgaagaagaagacgaagaagacgaggaggaugaagauggugaagaagaggaguuugaugaagaagaugaaaauguagaaggagaugacgaagaugaagucagugaggaggaagaagaauuuggacuugaagaagaugaagaugaggaugaggaugaaggaggaggaagaaggcaggaaagguaaaaagaggaagagagaaacggaugaugaaggagaagaugauuaagaccccagaugaccugcagaaacagaacuguuuaguaucgguuggacugcuc

SEQ ID NO: 12885 - RNA, 476 nt, Homo sapiens
cacgaaggucgagcugugcaguuuuaguggguacaagaucuacccgggacaggggaggcacuacgccaggaccgacgggaagguuuucgaguuucuuaaugcgaaaugcgagucggcauuccuuuccaagaggaauccuuggcagauaaacuggacuguccuccacagaaggaagcacaaaaagggagagucggaagaaauucaaaagaaaagaacccacccagcagucaaauuccagagggccauuacuggugcaucucuugcugauauaauggccaagaggaaucagaaaccuuaaguuagaaaggcucaacgagaacaagcuaucagggcugcuaaggaagcaaaaaaggcuaagcaagcaucuaaaaagacugcaauggcuacugcuaaggcaccuacaaaggcagcaccuaagcaaaagauugugaagccugugaaaguuucagcuccccaaguugguggaaaacgcuaaa

SEQ ID NO: 12886 - RNA, 1167 nt, Homo sapiens
aaaauacuguucuccauuaaauaaauuaugcucggguugacacucuuaauguugaauccugcaguauuuaaaugcaauaauuguuguuuaaggauaguaaucauagacucaauaucaaaaauugaacuauuaaauaauucugcugcugaagaguaauuuuuaaagaaaguuaaaaucaugauuucuauaagguauaaaauaaauaugacaauaaucagauaacucagaacaaagugcuauaggcaauauauaguuuuccaugagacauaauuuuuuucucuacacugucauuuguuguuuaauguauacaauucccauugauaacucacucguaaucuaguugucuucuuaagcacuauuuaguuauuaacuggaaaagcugaauauugacaaugugugaguaccaucacauaguuaguaguugaaagaagaaaaauauaaacaaugugugccauuauauaacaguauaauguaaugaaaacauuuacaaugugcuaaugacuguccugagaagaaauucaaacucugugaaaguuggggaggcugaaguuaggguauugaaugaucagcuaacuuugagagaucaacagaaaaggguagaaaugagauuucuagaaauaaggacuaaagccaugaaauugaguuuaugacuggauuaccuugagagauuuuuguaugauugcagagagguagguguagaaaagagaucaguaggaggauacugggaauauuaguuagggagcuguuggcaaaugaccucacauaucagguuaaaaaguuucaacuauguuuccuggccuccaugaguuguaggauauuuuagagcagagauuggcaugucuuuacauaagauaauugaaguggaaauuauaauuacugacaaugaccacccuaaguaguaaaccacaaaaugacaaaaauacaaaacacccaacccaucaacugagaauacauucaugcuagaggcuaaacaagccuagaaagacagauuacuaguuuggucgucauucaguuuggucauccaauaagaaaaaaaugaauaugaauuuccaguaaguagagaacaaaagauugaaacugaaguaauuaagugcuugcuguuugcccauugaccagauagucacuggucauagaacuaucugcauucuuuaugcugcgucacuuauu

SEQ ID NO: 12887 - RNA, 8843 nt, Homo sapiens
cagcuuccuggguuuccgauuuucucauuuccguggguaaaaaacccugcccccaccgggcuuacgcaauuuuuuuaaggggagaggagggaaaaauuugugggggguacgaaaaggcggaaagaaacagucauuucgucacaugggcuugguuuucagucuuauaaaaaggaagguucucucgguuagcgaccaauugucauacgacuugcagugagcgucaggagcacguccaggaacuccucagcagcgccuccuucagcuccacagccagacgcccucagacagcaaagccuacccccgcgccgcgcccugcccgccgcugcgaugcucgcccgcgcccugcugcugugcgcgguccuggcgcucagccauacaggugaguaccuggcgccgcgcaccggggacuccgguuccacgcacccgggcagaguuuccgcucugaccuccugggucuaucccaguacuccgacuucucuccgaauagagaagcuacgugacuugggaaagagcuuggaccgcuagaguucgaaagaacuccguggauauuccagcuuucccacaagcacugaucauuaugagccaguuacuuaaccgaucugagacacucucaccuccuaaauagggauagaugauacuaauuugcagguugucauuaugauaagacaggaucugaucaauauaugugaauuguuuauauuuggaaccuuuuuauugaguggaagaaguuguuuuaaauauucuagucaguucuuuccugcucccaggaaagcccggauuauguuuuaagauaagcaaaaugucuuaaaaguaagcuguuuuacuuugaauuuuucccuaaauguugauuaguguacuagauccauuuuaauuuggaaagugaagugcuacuuauuugaacuucuuaaaaaugcuaauuuuaacaucuaaagaguuaacuaagaaaagcuuaguaacaugauguaccaaguugaauaugcuguuauccuuauuuagaauagaaaauugguauuucuacguuuuauccauucuaaggcagguuaaaaaauuguauuuccaugacuaccuauauauuucuugaauuuauuauuguaaaguugauucauagucaaacaauuaaauguuuaaauuaagauuaagacacuagagaaugauuuauuugcuguccuuuaauugcagcaaauccuugcuguucccacccaugucaaaaccgagguguauguaugagugugggauuugaccaguauaagugcgauuguacccggacaggauucuauggagaaaacugcucaacacguaaguuuguccuuugguugccucauuaggaguggggcuggauacaguuaucauuguauagauuugugucuuauaaugagucccauuaauuucucccucccuuucuucgucuucuugcagcggaauuuuugacaagaauaaaauuauuucugaaacccacuccaaacacagugcacuacauacuuacccacuucaagggauuuuggaacguugugaauaacauucccuuccuucgaaaugcaauuaugaguuauguguugacauguaaguacaagugucuuucuaagguuuuuagccuucucaaagaaaaauaugcuuuauaauacuguaagccuaaucuaaaaacauauuuccaagcuuaucaaaaagacuuuaagauagcuuuuaaguuugccuuccaucuuaaucgccaaaaauauugacauuuagucccauccaguuuauacagucugcucacaacucuguauaccucuucuaaccuuuacuguuuggucaguuuguggagguagcaugguccagcuguuuauugaaugcccaugggccacagaauuguucugaacauguagcacccauuaaaauaaauuuggauuuggaucagcaagaaaauaacuuuccaugauucuaaagugggugccauacucagccauuccuuucauaggccucuuggauagugagcagauggcuaccugaaaaaucaauauugccagauuauaaugugcagaguauauguauuuuauuaaagauguauuucaaguggccauuagacuauaaaguguaguuguuuaaaaauagauuuuuuuuauuuuggaguuacauucaaccucaggugccacuuuccacauuuuacaauaaaaauaaugguugauuuacuuaacaaaugagaauaaauaaaacauuuuuuucuuugaaaauuucagccagaucacauuugauugacaguccaccaacuuacaaugcugacuauggcuacaaaagcugggaagccuucucuaaccucuccuauuauacuagagcccuuccuccugugccugaugauugcccgacucccuugggugucaaaggugaguaagaagaauccauuagagauguauuaacuauaagacgggcugcauugcugccaaaaaaaaaaauugaccuuagacuaccauuuauuuauuaacaaaagcaguuuuuacuuuuagcaugguuaucuauggguauuuuuuaaaguaugagucuauauaaacuauuauguaaaagcaaaugagcgucuugguauaaugucuuaauauuuucaaauuauuucuuuagaaaugaaauaauucuaauuaaaauagauaaaaucauucaguaagaaguuguuccaccauaucuuagaacuguuguuuauauuaugauccuauucacaauuguaauucucauauaaaugaagaauucuugguagauugacagucaccaucuccuuucuugaauacauagauggauucuuaccuuagcuuucucauuuuucagguaaaaagcagcuuccugauucaaaugagauuguggaaaaauugcuucuaagaagaaaguucaucccugauccccagggcucaaacaugauguuugcauucuuugcccagcacuucacgcaucaguuuuucaagacagaucauaagcgagggccagcuuucaccaacgggcugggccaugggguaagauagaguuaauaucuuagaguuaguaaaauuauaccaaaucauagucaagggcuaacauuaaaggagauauacagauagauagauccaaauaacuuauccacuuuuuuuaaaaagaagucuuaucuauaaaaaccuuaaaggaauuuuccauuuacuucacuggucuaguaaaauuauacacacacacagacaugcacacacauauauaaacauucacacacauacauauguacagguauuguuauuuguaauuugacccuuguauuuuuuaguuuaaaauguuaguacugcaaaauguuauguccucaaaaacacauuguaccaugauuaugccgcuuucaauauuguaaagugagguuuuugccgcauuauuauuuuuuggauuucaauagcauagcuucaaguuauucguaagaauuuuuuauaaauaauacauuuuuauacuuuuuuauaauuaccauaucaucauagugaaguauauaauauauaugauauaagcucaauauaguauauuaauuccguuaaacacaaagacauaucaguuuguagcuuugguggauaaacaaauuaauuuagcaauucauggcuaugaaaaauguauauuuuauuuaaaaauuuuaaagaaagcuaaaugaucaaauuauuuaaugaugaauuauaugauagacacuuuauauaagaaaaacuucaacagcaacaaauuaaaauuuuuucaucauuuucuagguggacuuaaaucauauuuacggugaaacucuggcuagacagcguaaacugcgccuuuucaaggauggaaaaaugaaauaucagguaugcuuccuuugacuauuaagacuuaguuauuaccgcuuauacccauauuuuaaaaucccuaaaaauguguuccuuaacuuuuuaacugauguuuauuuauuuauuuauuuuuuuagauaauugauggagagauguauccucccacagucaaagauacucaggcagagaugaucuacccuccucaagucccugagcaucuacgguuugcuguggggcaggaggucuuuggucuggugccuggucugaugauguaugccacaaucuggcugcgggaacacaacagaguaugcgaugugcuuaaacaggagcauccugaauggggugaugagcaguuguuccagacaagcaggcuaauacugauagguaaacaagaaaaugauuuauauaaaacccucuuccccagggaaaauuagugugcuaucuuuguuauguuuugaguaaaugacaagaugugguaaaugaaaacucacacauucuauauacauuaaauauguaagcaugacugauaaaauagcuaucuuuugauacugacaaggaagaaaacagaaaugaaggaauagcaaauuuuaaaaauugcauuccaguugcuugaaagcuugugaucagaugcaauaaauguuuuuauuauuuauuuugugcaaauaggagagacuauuaagauugugauugaagauuaugugcaacacuugaguggcuaucacuucaaacugaaauuugacccagaacuacuuuucaacaaacaauuccaguaccaaaaucguauugcugcugaauuuaacacccucuaucacuggcauccccuucugccugacaccuuucaaauucaugaccagaaauacaacuaucaacaguuuaucuacaacaacucuauauugcuggaacauggaauuacccaguuuguugaaucauucaccaggcaaauugcuggcaggguaagcauuauuauugaaaaccaaaacaaaagacuagucaguaacuuuagaauuucugccacggaaauuauuuuucuuaaacuuacuaaaagaguaguuaguuauauugcuaguaaaauuauuuuauugauauaagaagccuaacuuuguuugaaaagucuaaacuuuuagucuagucuacaguugucagacaaauagcaaauuguaccccuaccuuaaaaauauuuucaaaaaguaucuauaaucuuauaggaauaaauauuuuaggcuugaauacuaguguuauuuuugaaauguaaaaaggcaaauuaguucuaggcuggugucccauugaauuuuaagcagagcuccuguugaaauguagguaagcaucuuuccagcaaauaaaaauugucuccgcugggaguuucaguuuuaccugauuuguaccuaaggcaagcugaauacaaacaguaaauaugccuaaaauucuuguuuuacaacuaauuuuacuuuccacagguugcuggugguaggaauguuccacccgcaguacagaaaguaucacaggcuuccauugaccagagcaggcagaugaaauaccagucuuuuaaugaguaccgcaaacgcuuuaugcugaagcccuaugaaucauuugaagaacuuacagguaagaaacaguuucuaaacuucuucguuuuuuguuuguuuguuuguuuuuguuguuuuugguuuucuuuucgagauggagccgcccucugucacccaggcuggagugcaguggcgccaucucggcucacugcaaccuccgccuccuggguucaagcaauucuccugccucaacuuccugaguagcugggacuacaggcucacgucgcacgcauggauaauuuuuuguauuuucaguauagacgggguuucaccguguuagccaggcuggucucaaacuccugaccuagugauccgccggcuucggccucccgaagugcugggauuacaggcgugagccaccgcgccuggccccuaaacuucuuaaaagaaucaggggucaaauggaaacagagaaguuggcagcaaauugagcaaaagaaucaaacuguuuuuuauuuugugaaguuugacauugguuguaucucugucuucaucgccuucacaggagaaaaggaaaugucugcagaguuggaagcacucuauggugacaucgaugcuguggagcuguauccugcccuucugguagaaaagccucggccagaugccaucuuuggugaaaccaugguagaaguuggagcaccauucuccuugaaaggacuuauggguaauguuauauguucuccugccuacuggaagccaagcacuuuugguggagaaguggguuuucaaaucaucaacacugccucaauucagucucucaucugcaauaacgugaagggcugucccuuuacuucauucaguguuccagauccagagcucauuaaaacagucaccaucaaugcaaguucuucccgcuccggacuagaugauaucaaucccacaguacuacuaaaagaacguucgacugaacuguagaagucuaaugaucauauuuauuuauuuauaugaaccaugucuauuaauuuaauuauuuaauaauauuuauauuaaacuccuuauguuacuuaacaucuucuguaacagaagucaguacuccuguugcggagaaaggagucauacuugugaagacuuuuaugucacuacucuaaagauuuugcuguugcuguuaaguuuggaaaacaguuuuuauucuguuuuauaaaccagagagaaaugaguuuugacgucuuuuuacuugaauuucaacuuauauuauaagaacgaaaguaaagauguuugaauacuuaaacacugucacaagauggcaaaaugcugaaaguuuuuacacugucgauguuuccaaugcaucuuccaugaugcauuagaaguaacuaauguuugaaauuuuaaaguacuuuugguuauuuuucugucaucaaacaaaaacagguaucagugcauuauuaaaugaauauuuaaauuagacauuaccaguaauuucaugucuacuuuuuaaaaucagcaaugaaacaauaauuugaaauuucuaaauucauaggguagaaucaccuguaaaagcuuguuugauuucuuaaaguuauuaaacuuguacauauaccaaaaagaagcugucuuggauuuaaaucuguaaaaucaguagaaauuuuacuacaauugcuuguuaaaauauuuuauaagugauguuccuuuuucaccaagaguauaaaccuuuuuagugugacuguuaaaacuuccuuuuaaaucaaaaugccaaauuuauuaaggugguggagccacugcaguguuaucuuaaaauaagaauauuuuguugagauauuccagaauuuguuuauauggcugguaacauguaaaaucuauaucagcaaaagggucuaccuuuaaaauaagcaauaacaaagaagaaaaccaaauuauuguucaaauuuagguuuaaacuuuugaagcaaacuuuuuuuuauccuugugcacugcaggccugguacucagauuuugcuaugagguuaaugaaguaccaagcugugcuugaauaaugauauguuuucucagauuuucuguuguacaguuuaauuuagcaguccauaucacauugcaaaaguagcaaugaccucauaaaauaccucuucaaaaugcuuaaauucauuucacacauuaauuuuaucucagucuugaagccaauucaguaggugcauuggaaucaagccuggcuaccugcaugcuguuccuuuucuuuucuucuuuuagccauuuugcuaagagacacagucuucucaucacuucguuucuccuauuuuguuuuacuaguuuuaagaucagaguucacuuucuuuggacucugccuauauuuucuuaccugaacuuuugcaaguuuucagguaaaccucagcucaggacugcuauuuagcuccucuuaagaagauuaaaagagaaaaaaaaaggcccuuuuaaaaauaguauacacuuauuuuaagugaaaagcagagaauuuuauuuauagcuaauuuuagcuaucuguaaccaagauggaugcaaagaggcuagugccucagagagaacuguacgggguuugugacuggaaaaaguuacguucccauucuaauuaaugcccuuucuuauuuaaaaacaaaaccaaaugauaucuaaguaguucucagcaauaauaauaaugacgauaauacuucuuuuccacaucucauugucacugacauuuaaugguacuguauauuacuuaauuuauugaagauuauuauuuaugucuuauuaggacacuaugguuauaaacuguguuuaagccuacaaucauugauuuuuuuuuguuaugucacaaucaguauaucuucuuugggguuaccucucugaauauuauguaaacaauccaaagaaaugauuguauuaagauuugugaauaaauuuuuagaaaucugauuggcauauugagauauuuaagguugaauguuuguccuuaggauaggccuaugugcuagcccacaaagaauauugucucauuagccugaaugugccauaagacugaccuuuuaaaauguuuugagggaucuguggaugcuucguuaauuuguucagccacaauuuauugagaaaauauucugugucaagcacuguggguuuuaauauuuuuaaaucaaacgcugauuacagauaauaguauuuauauaaauaauugaaaaaaauuuucuuuugggaagagggagaaaaugaaauaaauaucauuaaagauaacucaggagaaucuucuuuacaauuuuacguuuagaauguuuaagguuaagaaagaaauagucaauaugcuuguauaaaacacuguucacuguuuuuuuuaaaaaaaaaacuugauuuguuauuaacauugaucugcugacaaaaccugggaauuuggguuguguaugcgaauguuucagugccucagacaaauguguauuuaacuuauguaaaagauaagucuggaaauaaaugucuguuuauuuuuguacuauuuaaaaauugacagaucuuuucugaagauaaacuuugauuguuucuauacaucuuugucauauga

SEQ ID NO: 12888 - RNA, 574 nt, Homo sapiens
aagaguauuuuuccuaaaauaggugaauugccaugcugaccguaacuuuuaggcugagacaaaacaauauucaauuagaauucuaauuuccauuagaaacugguaaguguaaaccccaaaaggcuuacagaaaaaguaaaucacaaaaauacaagcuuguaaagcaguguucacauuaaccucagcgaaaacuuuuaggauucaagguaugaggcaaaagucauaaugguugucagguucaggaguuuggaagcgcauauagugccucaucugcuguucccuagucuuucucuugauuuccaucaucugcccuacaaaccuuucuacaucaucucucgcuucauugugcucaauaugccuauuagguauggcccaucgaaaauuagggacaagucgccuaacucgcccccgccugauauuuccuccaggcuucuggccuucacccccucccaaauggcgggauucuucuucauucugcgugggggccugcuccccuccuucguuuucuuguugggcauuuuccccguugagauuguuugccgcuaguuccucuuuggacuccauuacuccuagg

SEQ ID NO: 12889 - RNA, 574 nt, Homo sapiens
ccuaggaguaauggaguccaaagaggaacuagcggcaaacaaucucaacggggaaaaugcccaacaagaaaacgaaggaggggagcaggcccccacgcagaaugaagaagaaucccgccauuugggagggggugaaggccagaagccuggaggaaauaucaggcgggggcgaguuaggcgacuugucccuaauuuucgaugggccauaccuaauaggcauauugagcacaaugaagcgagagaugauguagaaagguuuguagggcagaugauggaaaucaagagaaagacuagggaacagcagaugaggcacuauaugcgcuuccaaacuccugaaccugacaaccauuaugacuuuugccucauaccuugaauccuaaaaguuuucgcugagguuaaugugaacacugcuuuacaagcuuguauuuuugugauuuacuuuuucuguaagccuuuugggguuuacacuuaccaguuucuaauggaaauuagaauucuaauugaauauuguuuugucucagccuaaaaguuacggucagcauggcaauucaccuauuuuaggaaaaauacucuu

SEQ ID NO: 12890 - RNA, 45886 nt, Homo sapiens
cgcacgguggcgccacauacguacucgucaccccuuggcccucccugaagagcuggugaccuuaccgucaaagccccgggaugccauggaucguccucguuggcggcuucuggacacugagccacuagagggcaucggucccgguagggccggacggcaggcuccgggauaccgccacgcucucuauggcgcccagaagggggcgggguggcgaccgcagucgcuuuggcugaggcucugcggggaagggagggggggcuuuuacgucaucaaucugcgccaccugacucccaagucccuggcuuuggagugggaagugaggugugggaaguaggucgcuuucugaugaauucaguggcagugaauugagaccggagggaaucuggccccuagaggcugguacuugggcccgaaacccccaucuccggcggagagaccguccgagguaauugucugccacgagugcacauucugaaaacagguaagucagccuaaguguagugugugugugugugugugugugugugugcucucuuuucaagagaaaaaggaagggacaguguuggaaccauauggacagucacuccggcacacacuucugacgaacuuaccuugugugaaacggcguaccuaaaugguuuuuggugguggggagguggcacugagugauucaguacccgggaauuuaaggacccggguuaauucuucaggaggagaauuaaaagaaaccgguagcacuuugaguguagccuauguuuuaaauuuuucguugcagaaacgguuaccuaacauuauauuguuuuuaaaauugaaaacuguuguaacugaaguuuuuaaacacauuguuaauuucuacaguaacagaacuuguaugguuccagaucauaauucuguaguuuuaaagcucaauccguagauuguuucguguuuacucuuaugaaagaauuuguuaaauuauucauuguaaauaaugcauucccagugucgucucucugcaguucccacagucgugggccuucugugaauuggugauuuaguucuuauaugaaauuuauucuuuuucucuaguucuuacuuuugaaucauguugugaagccgucuaagaaauauaaauggaagcauuuuaugauauuuuguaauaacuaaggaaaaauaaaucaacagcggagcuuaagguugauuuuuccccaaaaauauuuuuuagauaagcauuguaauuaaaguugcugguauaugaaguauuaugcuauguccuaagcccacaguauuaucauacuguugaucugucauuugggaaauguagauuuuucuguacuuagauucacagaauccuaaaauuagauagguuuucagaucugcuaggauucaaaugcuuuauuuuauagauuaggaaaccagagcccagaaagguugaguugugucagucacagugcuuggaccacaaaggcuuuggcugauauacaacauuucuggaaaauuaugacccuauaaggcaaaauacaguugucccuugguauccguggggcauugguuccaggacccucucaccugcccaccccauggauaugaaauccauggaugcuccaguuccuuauauuaaaugguguagcauuugcauaucuuaaaucaucucuaaguuacuuauaauaccuaauacaauguaaaugcuauaguuguuauauuauauuguuuagggaauagugacaagaaaaaacaucuuuaaugauacagauguaaucaugcuuuaaaaaaauaauuuuucaaucugugguugguugaauacauggaaguggaaaccacagauguggaaagcugacuauauacauuuuuaguacugccuuuuauaaaguaugguugacuacauuuaaaaauuuugaaagagcacuaaagaaaaauuuaucugacauucaaucagauuucauaauugaauagauuuucaucucccuauuacauucaguuucuuacacauuaauauggcuacuaggugacacccuagaagaaauaagguuaaaagguuaaauauaacuuuagaauuacuuguauuuguugcaagaauuaagaauuauuagaccagaaggaaaaggaguauaauaugauauagaggaaaguagauacauagaauugcauaccuuaaggcauuacuaaaagguaaaagcccuuaacuucacagaggcaacagugauauuuagacaagcauuccuagacuuagucucuaaaaaaugauaugcaaaucugauucacgucuauuguugucaaaaaagagcuaggaaggccaggcauggugacucacaccuguaaucccagcacuuugggaggccaaggcaggcagaucacacggucaggagaucgagacuauccuggcuaacacggugaaaccccgucucuacuaaaaauacaaaaaauuagccgagugugguggcgggugccuguagucccagcuacuugggaggcugaggcaggagaauggcgugaaccugggagguggagcuugcauugagccgagaucgcgccacugcacuccagccugggcaacagagcaagacuccaucucaaaaaacaaaaaaaaaaaagagccaggaagaaauuaauguauuuugagacaaaacugaacaagcucauugaaacaauaaggaaacagccuccaguaggacauuucagacuugaauccauucucugggcuuuaguuuuaaaaugcaaaaccguuuugugacugacaguuuacugguaucagauauaccaccccagcauaucucugguagccuuaacuuugugguacugaauaagauucacauuuuuaacagaauccaaaugaugaugauuccuaaauugcaguguucaaaauacuguaacuguguuccugcagucucuguuuguuuuauagcucuuuuggauaucaucucuuuuacauuuucauccucacugauuaugaacuccuugauuuaaucauucauuauauugccuagcucuuuuauucaauaucuuugguuuuaagcuauagaaaugcaaaucaaaggagcauaagccaauagagggaaugaauauacugacuuccauccacagaccagagggaaaacagaguaagagcuacccguaguaaugauuuaauugaaggacugguuacgauuccucauuaugagcgugguguugaaaaacauggauucuagagccagagugucugaauuuaagucccuccuuugccacuuacccagcuuugucacuuuggcaaguuauuuaaucaacuuuucucauuucaguuucuucaucuauaaaaugaggauuauaauaaugguacccacuuccugggguuuuaugaauuauuaauguuacauggaaaguacuuacaauaaugcguuguacaaaguagaagcuauauguuguuauuguauugcuauuuaucuacuuaaauaacucuuacuguaguauguauugcucaaggacagagauuguguugcucaucuuuguguuaucccacuuagcauaguuucuaagcaaauaguauaguucuuucauauaugcuuaucaaguaaaugaauuugacucuaccuccuaaugaacuauucagaaauucauguuuacgauuuuagcaaugagaacaccaagacuuagcaauagaguaucaaagauaauacaacuagggaguagaucuaaaauaagaaaucugguguguuggcugggcaugguggcucacgccuguaaucccagcacuuuggaggccgaggcgggcggaucaccugaggucaggaguucgagaccagccuggccaacauggugaaaccccgucucuacuaaaaacacaaaaauuagccgggcauggucgugagccccuguaaccccagcuacucaggaggccgaggcaggagaaucacuugaaccugggaggcagagguuacagugugccgagguugcgccacugcacuccagccugggugacaagagcaaaacuccgucucaaaaaaaaaaaaaaaaaaaagaaaucugguguguugcuuacuaguuuaguauccucucccuuaucccagguaugaguaaaagguuugaucucucaugucaacucugguugauuugugguuguuuccugcugcauuguauugagaagaacucuggaacugcaucugaacuuugcaagaaggaauacacuauguaauaaguauuugcugcaaggcaugagauagccucaggauaguaucacuucucuugcuaaacuacucccaugauaaagacauugcaaaugauauuuuaccuaaaugcuguaucuuuucuucuugugauauaggagauuuuaguuccuaaaaaugggaagaaccuacauuguagaagagacuguuggccaguaucuuucaaacauaaaucuccaaggaaaggcuuuugucucuggccuuuuaauaggacagguauguaucuuuuacucugcauuuauaacuaaauaauuacucuguaauuuauuuuaaaaauuacuuguugauuuaaaguuaaaagaugcuauuuaauaauaaacucaagauugggggauggaagaagaaauguggaagaaguaacuuuaaaguaggucuuugaggaaacauggagaaguagacaaaccuagcccaauuuugcucgucaggacaccuuccccuuugaccauguaaacguaauuuauaauauggaaacuucagaauuagaauguuuauugaccagauuuuucacauuuuguugucuuuccaaaguguuuuguauucccuucuaaucuuuuuaauaucugguuguccaguucuuuacaaaagaagcuuuugaaaauuuuauuccuguucuaauuuguguugucuuauaucagacuuauggcaacaguggucauauuuuuguuguaagcuauaguacccaucuuacugaauuuuuuguuguuguuguuggaucaauagggagggagagggauugggaaaaauuuggaaauuagacaaauucuaauuuccucuuagagcugagucuuaaaaacacaaaauggaacagagauucagauacuuauuuuaaaacccaugccacugauuucuuaugagugaaggaagaacguguuaaucggcaggagggaccggucagcaguacaaagccaaaaaaaaaaaaaaaggagagucacacaggcaagcugacuguguccauccaaacacaggagagugcacuuuggcccaaggacuugauuuugaggccuacuagccaauaaagcucuuauugggacaauuuucuuucuagauaucuuagccugaugccuuagaaucuucaaauuacauaauuaacuuuccuuauucugauucuacccauauucccaagcuacuuucuuuuauaauuugaugccccauguuaucuacuuauaaagaauacacuguccagaggacucaaguguucagaugccuucaugacauuuuaguuuucuacaucauucugaauaaacuuaaucaaugucagucuagccaugaaagacaggcucauuuucagaauuuuuacaaaucagauuucuuaauuugcaagacagagggcagaucuacaugguucaaccagguagcaccacucugugaggccucucauuagacagccagacugccucucuugagaacagugugaauuucuuuuuaauucaguuguaauguggggcucuuuuuguuaggaguuuucuauuuaaguuuuuuucuuucucuuuguuuaaaacauuuaagagaagaagagucuuagagaaagaugugaucaguagagauaaaaagucagggagaaagacccucuucuaaauuugucuuaacuggauaaagguuguuucuaaagcucaggcaaacugccaucuuacaaaugagugucucauaauuuaaggccuuccuucuuuuuuuuuuuuuugagacggagucucgcugucgcccaggcuggagugcaguggcgcaaucucggcucacugcaggcuccgcccccugggguucacgccauucuccugccucagccucccgaguagcugggacuacaggcgcccgccaccucgcccggcuaauuuuuuguauuuuuaguagagacgggguuucaccguguuagccaggauggucucgaucuccugaucucgugauccgccugccucggccucccaaagugcugggauuacaggcgugagccaccgcgcccggccuaaggccuuccuucuaucucuuuuuaugcuguaguauguauugcucacggacagagcaauucauuccuuucaguauucuacgugcuuuuucuuccagaguucauuacuuuuuccucuccuuccucuuaagcuugccuguuuccuggucucugucaguuucuuuuucuuuucaaaguuauacauuuuaugaagaaaagaggagccuucuuaacugagaccuacuuucuuuuccuguguuuauuugaauguaacuuccugaaaauaaccuguaggaauaguuacucuuauuuucuaucccaagaugauacuaaugaucagaguuucaggucauguguggggaagauacaaugcuaacuugcauuagcaguguuauuuucacucuuuuuuuauaggaaacuuucacuguagugaaacugagcuauugaauguuccccuacauuuauuuuuagaucucccaacuuugguuacuacuuaacugauauuacagcugaagaacagauugggugugguggcucaugccuguaaucccaaugcuuugggaggccgaggugggaggauugcuugaaggucagaguuugaccuagccugggcaacauagcaagacucugucucuacaaaaaaguaaaaaaaaaaaaaaaaaaaagccaggcauuauggcugauuguuugagccuguaguccuagcuacuugggagacuacuuggggggaggauugcuugagcccaggagugcaagguugcagugagcuaugaucacaccacugcacuccagccugggcauuagagcaagacccugucucuaaauaaauaaauaaauacacacacacacaaagaacaaaaaacaaaacaaaacaaaaaacuugaggaacauagaaucuguaucacuuuaaauugugucccaaauccccuuuguuauucuguggaaauguauguggaaguucccuacugucaucauuucaauuaaaauaagauacaaaaggucacuuguuguuucauuuuacuaauauuuuccgaucuguucauuuauaacuuauaaaacaaauauaacuagaaaacugaauaagcauauuacuuuuuaguuaauguaauucauucacucauccaguaaaccauuuuuagggaccacuccaugauuuacauuugaguuguccaaauaaauaagaagcugauauuaaauacauuaaaagauaaacaacaugugagggaaagauuguaaggccauccuugaaaauuagcuucccuuuagcuuccauuauaauguggguauuaaugauuuaaccuguuacaaauauuacucaguuuuugcaugucauaaaagcuaaggaauuuagguaucacucuaauuagauugaggaaucagauaucacucuaacaagcuuuuuaauuuguuguugaaguguucgucacaaaaggauuaugugauucuugccacuagaacgccacccaaagaggagcaaagugagaaccucaaacaucccaaagcuaaguuggauaacuuggaugaagaaugggccacagaacaugccugccagguuaucuuauuuuuuuguuuauauguuuaaguuuuauuucaaaaaagagcuagaaucaagaagauuuagugaaugaguagagagaagagacauagggagaaaguagcuaaagaugacugagauuuuuagucugggugucuaggaggauacuguuggcauuacacgaggaagaaacagauuugggaugggugagugggaauaaugacuaaauuaauucacuuacaaguauuuauugaaugaauuauauaucaucaaauaaauaauguuagaauaagguaaaaauagaauuauuuccuuuucugggguugggggugaggggagggaacuuagaggacaggucaauaggugcagcaagccaccauggcacacguaaaccuaugugacagacuugcacauucugcguuuuuguuuguuuguuuuaagaaaaagaauuuucuuuaauaaauaaaagauuuauuuccuuuuccaaucaacuuuaaaucuuuaaaucuuuuaaacucaaacguguuucuguguauguagauauauauauauauauauauggacauauauuugugucuguguauguguuugauuauggagcaguguguaguuauauuuaaaaaaaaaauaaaaucuugccuguaaucccagcacuuugggaggccaagguggguggaucaccugaggucaggaguucaagaccagccuggccaacauggugaaaccccgucucuaguaaaaauaugaaaaacuagccaggugugguggcaggugccuguaaucccagcuacuugggaggcugaggcaggagaauugcuugaaccugggaggcggagguugcaaugagccaagaucacaccauugcacuccagacugggcgacaaagcgagacucugucucaacaaaacaaaacgaagaaauccaguauuuaauuauuauuguuuuagucuguuuggguggcuauuaaggaauaccuaagacugaguaauuuauaaagaaaaaaaggccuguuuggcucaugauucugcuggcugcaagauugagcaucuggucaaagccucaggcugcuucuguucaugucagaaggcagauuggagcugguguguaaagaucacugggccagagaggaagcaagggguugggaggugcuaggcuuuuuuuuuuaacaaccagcucucguaggaacaaauauagcgagaacucauucacugcucugaggauggaaccaagccauuaaugagggaucugccccaugacccaaacaccuuccauuaggccccacuuggguucacauuucaacaugguguuuaaggggacaaacauggcaacuaucuucuaaagaaaauauuaaguaauguaaaguuaaauucccaaugguuuguaaauaacuuucuacucuaauuuugcuuuuggucucucauaaaauuguauaugacacacacacacacacacacacacacacacacagaauauuaaugaauuuauauaguaaauuagcuuaaccuuuuaccucuagaaagaaaagguuaauuuuacuuuuuccccuuucuugcucucaccuccaucuccuaaaaaaugguuacuuuuuuguguuggugauuuugaaaagauaugcaggcuccuuaugcuaaauaugaaaacuuuauuugucagaauugugcuacuauaguaaauagaauuuauuaaaucagaggaaaacaccgaaagacauagugcaaguagauuaaggauuagagcaugguaccuaauuuucuaagacuguacucugauugauugcuuguacauuaaguaaucaaaagcuaaccaaaacacucuaaucucugaguguagaugauagaaaaaaauccaugugguauuaagaacuagccacaaucaugugaagggaaauacagauauggagauaucaugguaguauguaucaaaaaccuuaaaaauauguauaacuucuuaaaccaguuauccaccucaagggauuuguccuaaacaaauaauucuaugaaugcagaaagauguacuaggauuuuuaaucaauauuauuuuaagguaaaauuagauauagcaaagaugcccaguaucaguaagugggcuuaaaaauuugagguuaaucuaugcaauagaaaauaauggauuuucaagucagacucccucuguucaaauuccagaucuaguaugcugcuaaaaauagggauacagagguagaauuacuuauucccuuaaggagcucccugaccaacuaguaggguucacagauaacuaugauauaagacuaugugauaaaauccaugggaaaacuacaccaaagcccugucggaguucagagaugaaaagaucagagaaggcagcuuccucaagcugccuuugaaguauccaguaggguugagacaugcagaaguauaagaaaaagucaguuucggccuagggaacacccugaguaaagacacauaguuagaaagccuaggauguguauggaaaacaguuuauagccucauuugacacuacuuuucaaguaguuuuugacaaauauuugaauuacuugaggaaaaguagugucaaaugaggguauaaacaucauugaccagauccuagaaagucugaaauaucaaucuaaaauaaaacuucauuuuauuuagcugauggugggacgccauugaaaaaauauuucagucuuugaucuccugagaaaaggauuuauuuauugauguagcuaaaggauguuguuaucagauaguuuuauuuauaaaguaguuuuaaggugaaaagcuaaggacaugcuaagcagacaguuucucaaacagaaaggauugcauauaaugccaauuuguuagcuaauaauauauuucuauuuuuagguauccagaaugcuaccagggggacuuuuaguucuuggaguauuuauuauuacuacuuuagaacuggcaaaugauuuucaaaaugcccugcguagaguaaguuugauauaucgaaaauucuuaaugaaaucaguuauauguuauuuuuacugauuaugaguauguguaaugauucuaggcauauuuacauuuguuuuccauaauucuuuuuguugggguuacauugaaaaagcuuuugucacucaauugcuuggauaucuugaguguaaaaaauguuuauauuuuuaaaaacuacacauuuuauuuauuauuuuuuccauggguaauuuuauucuuuauuuaguacacuacccaaaacagggcuaucaucagcccauauggcauuucauacaaauuugaaaaagcuauucuuuccucaaguuaaaaaguuaaauuauuuacuucucaauaauaaccaugacuaaugacaguaauuccauguaaauuaugcaaacaaauaauucauuguaaaauauugaaaaauucaaaugauuaauuauaauauuaagaacucaaagucacuuggaucuaauaauuuguuguaaaaaaggcaucuuuguggaaguaauucuuuuugacagaaaaacuacauauuuuaaaauaaucuuuauuuuagagguaauuucugacuauuaggaaacaaauuauaaugcuuuaaacaguuuuucuuaugcaauagcaguauucugucacaccuuccauuuaguaccuagugauuacuguaacaugaaauuaauaggugcugaaauucuuuaccuucuucucaauucuccggagauccugagaguaaaacauaaacaaucagauuauuccuggacacaguaucuaucagaaaucuccuguguuuuuugcuuaauugcugcaccagagaauuggguaacauaguguaaaaguaaauaugaagguccacaugcuguuuucccuuaaacccaaaccuaagguagauucuguguagccagcucuuuuagcauucaggauccacaugaacuuuuugaaggguauuucauaccccaaaagagggggaaccuuaaaaucuugagacauauaaaacccaaccccaacaguaucccagaaaaacauuuuuuagguaaaaaauauacagcugagaacuucagauguuacagauuuuuucagucuuguaaccuguccugucagaugucccagccucaagccuuugauauuugcaccuaagggaguaagggaagaaaauggagauauucuccucccugcuaaauuguuuaacccucugccaacuuuuccaucuuaaauaaauuuaccuuguuuacaauuguucauucucuuuggcauuuugaaauuuaaccgaaaucuaugcguauuuaauauuaauagcauucauugugcaaccuuuuuuggcuggugcugaauugaggggguugaaugugggcccagugcuagagagauacagccaggcccacuuuccuugcuuuuguaucuuuuguuccuaaaaaguauauaaaacuuuagaaaugcuuuaucucugacauuacugaguuucaauuaucuaauuguuuccacuggcuacacugacaaacacuacaagaaacagccuuauaaaacuugucagugucacccauuauuguuaaggacuuuauucaucauauuacauuaauauuguguuuccggaagaauuucuuuuuauauuaugaagaagguugugccuccucugaugauuguuuuuagcuuacagaccaugugaauuagguuacagauuagauuucucucugcacauuauuguuagaaagcuuagaccgaaauguauuaccaccccuuacaucaaguaugcauuuuuauaauucuuauuucugacacaaauuuaucucacuauucuacuuuaacuuucaauuuguuauuacuauauuuuauauguuguuauauauugccuuaagucuugugugacguuuaaauaagaaaugcuaaaugggugacaugcuugauuucuuuaguuaaaaucacuuaucauuucucauucuaauuaaagucucuguucuauaguuuauauaaauucuaguugccccaaauuaauuuuuuguguccaguuaaucucuaaugauagugaauuaaauuuuuuuauuuaaacccaauuuuucuguaauuuccuaaaaggaauucaaaaauguuaguaauuagcuccagucuuuaauuugaagaaaagaaaaauuaaugguggcacacaccuguagucccaguuacuugggaagcugaggugagagaaucacuugagcccagguguucaaggccagcuugagcaacauagugagaccccuucuccaauaaauaaagaaucauggaauuuuaaagcuaaaugagaguuggggacauuauaauugccuauuucaacacucaucuuuuuuuuucauuuuacauucaauuaguguguauuuuucucucuuucagcuaauguuugcuguggaaaagucuauaaauagaaagagauuguggaauuucacagaggaggaagucucagaacgagugacacuucacauuugugcuucuacaaaaaaguaucuuuuguucaguuuaugguuuaaaaguacaaaguaccaaaauaauauucuugcaagguuuuuuugcuauuuauuuaaaucaucauuuaaaaaauaggcauaguuuuguaagauuuuucuguaaauaacauggaauuagagccaccaauaauaauaauagcaauaaugguuguuaaucaugucccaaggugauaaaaagcuugagaucuguaauaugaaagacucaggauucugaauuuuuuaccagcuaucugcccuguacauccaagcacagcagauucccuacagagauaaaugccuaacugauggcuuaggcaaaguaauguuuuuauuauguuaaaguuuucaccuccaguuucuauagauaaggauguacaauucaaagcacaggugcacagagcuggaugguauaggacaucggagaaauucuuaugucuuuggcuaagaugaaaugacacuaaaagccaguuacacggccucuuaccagggcaagaguaccucccaagcaagggucauccucaccaaaggagugacacgauccauggacuuccaaagacagaauuuuaaaagugaccauuccugcagaagcagggcuuuuuuuuuuuuuaacaacaacaaaaaaaaucuuuaguauuuaacugcaaaguuucauauacaagcccuuuaauccaauaaauagucucagguuugaccucauauaaaacagugguacuuuuucuuauggagaguguauauuugagaagaaucucacgagugcuuugauucuauuuauugcaauuagcgggauucauaaaagguaggaaaugauuuucaagcaccgcaaguacuauagugauagcaguuuguauguaugauuauauauacacauauguauauauaugcacacauguacauauauguacgcauaucuuuaaaguguuaugauuuuguaagaacuuuuggaugcgugcauuuuuuaguuuauuuuuugauaguuuauauucuuuuaguuaccaauaaugccuuuuuugguuauuucuguccuuaauuagugaagaauauuuugucgaacuuaugauauccaugauccaaagguaagaaauuuacucuuuaaagauuuuucugugucacaaaguauuuucaaucaaaauucagcuuuuauuuaguuuuaauaauuuccauugccaucacuuccuauugaugccuacaaacaacuguaguuuuuauuuugaaauaugauuaauuuuauuacagauaaggaaaacuuuuuugugcgugacagggucucacucucuugcccaagcuagagugcagugaugcagucauagcucacugcagccuccaccucuugggcucgagggauccucccaccucagccucuugaguagcugagacuauagaugugcaccacugcaccuggcuaauuauuuuuguuuuuuguuuuuuguuuuuuuugauagagauaggguuucaccauguuaguuauguuugucuugaacuucugggcucaagugaucugccugucuucgccucccaaagugcugagauuacgggcuugagccaccacggccagccaacuuuuuaaaaaauuguuaaaauaucuuuguuaaucuccuccuaccuuguuuguguauuuaguuuuauauuugagaggcugguaguaaaagugacugaggacuuuugguagcugcacugccuauuaaacaagcuauguguauucagcaaaacccagauuagcacuuugcuaaugcaucuaaaaggguugugaaaaaguaacuuugcagugucauuagcaaggaugggacagaaaggagaaugccugccaccuaggaguugcucagugauuauuugcuucagaucagaaucuucaguauugauacuguugaagcuagaggaucaaaggaccuuucagaauucuaaacauggaaauuucugauucuuuuucugccuaccauugggaggagaaguauugccaaggauguauugaagaguacugaacuuaacacaugcuuuauuuuguguuuaguucaaccuauagucuuuugaucaaggguuuagccauauauguuagauaugaguuuguaugcguuauuuagguuguauauuuaauaauguuuuguugauccauguauuuuaucuagacuacaucauaguuauuuuucucccuucuccacugcuagaguucagcaagaccagcagauuggaaguaucaaaguggauuaucauccucauggcuuucuuuagaguguacaguucacauuaauauucacaucccacuuucugcuacuucugucagcuauacucuggagaaaaauacaaagguaccaggguaaaaugaauuuucuucagugauugcugagugaacaaucugcuuuuauucugcuuacaugugucauucauuuuacaauccucaaaaauuacauucugcuuacaauguuguuaugugaguaacuuauuaccgcagccaaauuagaaauuuuuagaaauuuuuagaaguggaacaaugucauaauacuaguauauucaguuuaauaauaacuaauaauuuaguuguuagacuaaauauacuaguacuuauuaugugcugauuaaguauuauuaugugcuuugucauuaaacuaaauauaacaguauucauuaauuaacauguaaaauguaauuaauguaagaagcuauacuguuuggacuuuuagcuuucucuuaguacuuagguuuuuuugucuuccuuuuuccaguucuuuuuuguauuucuauaccauucuuuuauuuuuaucuuauuuuucuucauuuuucccauugaagaugucaaauagagcuuuuuuuuuuuauuuuuuagacuuauuugaugcuuuuuucucacuuuuuuuuuuaagguagugggcauuaaauuuuauuuaacugaucauguacuuaauaaccuccugagucugugacauaaauguuauucugggauaaagaucagaaaauaacuauuauuaaauauaauaagguaucaagaauggggguauacuuuuuuuuaauuugugaaacuagauuuaaaugcugcaguaaugagauuuagggauuuuaauauuucaauuuauuagguggaacaaaguagauuauaggaaguuuaauugagauggcauuguaucugaaagauuuccauguuguguuucuguuaagaauggacuuacacgcugggccaaggaaauagaaaaugguguuuauuugauuaauggacaaguuaaagaugaagauugugaccuauuagaaggacagguaaguuaagagaaaaucaucuuauuaaauuguuagugcuuaaggaaaaauaaaacaugacuuauuuuuaguccuugccuacaagaaaacugauuucaucuaccucucauuucugauuucugauuuaaaguaaaaggcaaauguuuuucuuagaaaaacaaccucauuaaaaaguaggcagaggauaugaacagacacuuuucaaaagaagacauacaugcagccaagaaucguaugaaaaaaaacucagcauuacuaucgguagagaaacacaaaugaaaaccacaaugagauaccaucucacaccagucagaaucgcuguuauuaaaaagucaaaaaauaacagaugcuggcaaggcugcagagaaaaaggaaugcuuauaaaccguuggugggaguauaaauaaguucaaccauuguggaaggcaguguguugauuccucaaagaccuaaaaacagagauaccauuugacccagcaauccuauuacuggcuauacccucaaaggaauauaaauuguuuuauuguaaagacacaugcaugcauuauguucauugcagcacuauucacaauagcaaagacauggaaucaaccuaaaugcccaucaaugacagacuagauaaugaaaaugugguacauauacaccauggaauacugugcagccauuaaaacagaacgagaucauguccuuugcaggaacauggauggagcuggaggccuuuauccuuagaaaacgaaugcaggggccaggcaugguggcucaugucuguaaucccagcacuuuggggggccgaggugggugggucacuugaggucaggaguuugagaccagccuggucaacauggugaaacccugugucuacuaaaaauacaaaaguuagcugggcauugguggcaggugccuguaauugcagcuacuugggaggcaggggccaggcgugguggcucaugccuguaaucccagcacuuugaggggccaaggugggcagaucacuugaggucaggaguucaagaccagccuggucagcauggugaaacccugucucuacuaaaaauaacaaaaauuagccgggugugguggcaggugccuguaagcacaagcuacucggggugcugaggcagaagaauggcuugaaccugggagguggagguugcauugagccgagaucgugccacugcacuccagccuuuggcuacagaguaagacuccauuucaaaauaaaagaaaaggaaaagaagaaaacuaacagaggaacagaaaaccaaauaccguauguucugacuuauaagugggagccaaaugaugaaaacacauggacacauagaggggaaaaacacacacuaaaaggagggagaaggagaggaucaggaaaaauaaauaauggguacuagguuuaauaccugggugaugaaauaauccguauaucaaacccccaugacugaaguuuaucuguguaacaaaucugcacauguacucaugaacuuaaaaguuaaaaaauaaguccaggaaaaaaaagaaaaugauguaauuggaauccugaaacuuuacaggagugucaucugaauuucaucugauuuccaaauuguaaacugcugaccugcaaccaaaggccacauguuguucugcccugaugacaguucaaaagcuauggccauuuuauaaaagagguuuauagaggcuucuaaaauagcuuugaccugaaggaagcggaacuuuugugaucucucacuuuuuaaagcagggaucagcaaacuuuaugugaagagaaaaauacuacauauuuagauuucacaggcuguauuuuuaucucuacuguguagcaugaaagcagcuacaggagauacauaagugaaugauccugguugcauaccgguaaaacuuuauuuacaaagaugaguggcaauguggguauuugcccacaggcagugguuugccaguuguugcuuuagaggaaugaaaguauggaauuaauuguuuuaaagaguguacauugauacagaauacauaaaguaauaucuauauaaaaagcuaaauuaaaauaauuaaaagacuuguuuuuuucuaaguuacuuaguauauguacaauaguuuauaaguugucuuuuauguuuuacaggcuucacaguuuggcuuuuuaacuuuuguguuuuuucagaaaaaaucuucuagaggaaauacucaagcaacuagucauucuuuugaugucagagugcuaacgcaguugguaaauauuuuaaaauaacacuuaaaauauuuauuagcauaaccauaaugaaacuguuucuguuuuuauuuuucucauuagagaauaaaaggauuuuagagcuguaagagacuguaugaaauggcugguuauaggaagguuauucccaagaaacaucauuuuaauaaaaccuguuuggguuuuuugccucaaggauauuaaaauuuuaacaucaauagauagcaguuuaaaaaaauauguacacauacaugcauacauauacauguauguauguguacauauuuuggguuguagcuuuuauaguuaaaguugcaauuuuaacaacuuaaaagauguguacacagaggugcaaagaguugucauaugcuuauuuugaaguagauuaauuagauuuauacccccugauuugauaaaaaucacaaaguauuaauuagcaaguuuuauauuuauguaugguugcuuuaauuuacacgucuuuucgaaaauuuaaaaguuggauaucuuaaagaauaaaaaguuaaagccacuaauuauuccuaaaaauacauaccuuugauuuuaauccuacuugaaauuauccuaaagaacagacaaggguauaaaauagcaaacgcguguuuguaggaaacuuuauuucaauauuauacuggauuuugaaacagaaauacucucaggacuuguguuuuuuugaacugaauagaauagaauuaaaagcaauuuggcauuugaggauguuuuaguuucuucuuuuucuguguguagcaauagcgcauuaguaaauugucuuugggccuaugccacucaaugugaguucucaauuucauuuuucaauaccuuagagguauuuuagucucugauuuucuacuuugucuugauuuuagaaguguccuuuguuuugaggcuggcuauuccacuacuuaugugcuuuucacuaguuaggcuuacuucaugguuuauuaaacaauuugguuaagauuauuuuauuaguaguauaaaauuguaguugggagauguauagagugugggaauauagagagaugaguggaagauaaucucaugagauaauuuauuguaguaguaauauuauuguuauuuuugagacggagucucgcucugucucccaggcuggagugcaguggugcgaucucggcucacugcaagcucugccuccuggguucacgccauucuccugccucagccuccugaguagcugggacuacaggcgccugccaccacaccuggcuaauuuuuuguauuuuuaguagagacggguuucacuguguuagccaggguggucucaaucuccugaccauaugauccgccugccucggccucccaaagugcugggauuacaggcgugagccaccgcgccuggccagguguaguaauaauauuauauaguauaauauauuuuugguagucacuccaccgaucaccuaacuggaaauuuugaagugacuaauauacaguaaguagucaguaaguauuuauugccacuuuucucccaguuaagucuuauugauuccuuauuuguaguauuaagcuuuucuuuuauuuuccauacaguccugcugucauuagccuuacaacaguauuauuuuaccuaaacuagcacaaguagcccuuaacuggucucucuucaucuauacauucuuguccaaagugauuguuucucuaaaucccuucuaccuuuguuaguauaucucuugaaauacuuuccauuuaucuacucuauccuguuuauacacucagaugaucauuucugaaucauaguuuauguucaguuauuaauuuuuuucaagaaguauuuauugaguuuguacaacagccggacacugauuaugguacuccuugcucaaaauuucuuaaguguucuguacugacuaguuagagaaguccaacucaggguucuucauagccucagcauaccuuuuuguucuuauuuucuaccucuuauuuucuagauguaugcuugccauaccuuuaaagcucuguauuuccugaacuauguaucaugucuuugcucuuuucucugucacccaaacugucaaaauccuaucuguacauuaagaucuagcccaaaugccacuacuuguguaagauuucauuugguucccauagaaauggggaucuucucuuuuucaaaugccaugucagcaucauagaaguucccucaccuauaggcuguuuggcagccagguuauuccuaaguccaaauaaccaagaggaguuuacauuuguagaccccaacuggucuacauuuccaccuaaaaggaaugagucagaccuuacauucuuuaaaacuuuuccuggcugagcaugguagcucaugccuguaaucccagcacuuugggaggccuaggcagggugaucgcuugagccuaggaguucaagaugagucugagcaacaagugaaacccugucucuacaaaaaaauacaaaaauuagcugggggugauggugugugccuguagucccagcuacuugggaggcgaaggugggaggaucgauugagccuaggagcuugaggcugcagugagcucugauagcaucacuguacucuaggcuggaugacagaacaagacccugccucaaacaaaacaaaauaaaacuaaccaaccaaccaaaaaaauaccucuuuucuuuaauauguguguguauagucuuuaauagucuagucuguuuuggauaacaaugccauaauuauagauagauagauagauagauagauagauagauagauauauguauauacacacauacacauauauuuacauauacuaauauauaaauguguuauauguuaaaaauauauaaauuauauguuaaauauguaaaauaggacauucuuuuuagaguaguuuugucuacaauaaaaaguuauggaguagauaggggaagccuguuacuccuccuccaaccccaccuuauugauguaucaaugaacucuacaugugucauauggaagcuuauuccagacauuguaucagcaucgucacacugcugcuugguuugaugauagccauuuuugaauggacccaggaccuuuggagcuguguggucuguggcaaauuuuuugucaacaaguccuugaccaucuuaaaguuuaaauuguuuaacaacaccuagaagauuuacauugccuuagacauugcuugaauuacacuagacaucaauaaugcucuuucaauagcuaugcaugucaguauucuccucuucauuauuuuuccgcauuuauuccugauugcauaagcacauaggcacaaagcacuuuucacaaguuguaugauuugacuuuuguucuucagaauugauuugguuguugaaugacuuauacuccaaguguucuuagaacauaaauuacuuccuuaccauuuccauuuuuugguuauuuuuuguaaaucauuauuuuuuguuuccacuguuauuauaggccucuauuacagguugagugugccuuauuugaaaugcuuaggaccagaaguguuuuggguuugggauuuuuuuuagauuuuguaauauuugcagaauacauaccaguugagcaucucuaagccaaaaaucuaaaaucuuauaugcuccaauuaccuuuuccuuugaacaucacauuggugcucaauaaguuuuggauuuuggagcauucaggauuuuuagauuagggaugcucaaccuguaguacuuuaacuauuuugauacuguccuuguuuuuggcacuuauuaagaugaugggguugaaaauauaugugaaacaccugaaaaccgaacaagagcacuggcauuccuuagacuaaagaggaugggacuagucuaugaaaguuuuugguugaaaguguguaaauauaugugucugugcauugcuuguaguuuuaccauaguuaucacaucccacuuuguauuuguuauugugaacuuauuuugcauugcacaacuuauaucuaguacaucauaucuucuuuguauaucuuuuaaucaucacaguacugaugugaauaauuugcaaauaauauauuuuuaggagcauaucgagugaauauugaaccauuuuagaugguuauguuagaaaaauuuagauguaguuguguuuaauuucauuauaucuucaaaaugacuggaaaauaauauauaacuuauaaaaacaaauaugaaggccuuuaaauaauuugcagagaauaauuucaaaugcuuggcucagucaaaacuuuguucucucuucauaaaaucgcuaauauaauguuuaaauauuuccuguaguuaaucauuguugguuauuagaacuuaaacagauuuugucuuucagcuccugaauucagaccacagauccacagccacaguccagauauguagcgguucuguaaaccuuaagggugcugugaaaugcagagcuuauauccacagcaguaaacccaaaguuaaagaugcugugcagguacaaaaaggaauaacgagcauauggaaccauguuaacuauuaacaaaaaccuaaaauuuuaccauuuuuuaaucuuauauuuuguaauuauuaauucgauuuuaacugauaauggccuauugugcaguccaaauguaccauauaauuggugugaagauuuucauauguagaguaucuauuuugugccuuuuuaaaaaugauggcuauacaaguuuaguaaguguuccacuguuauacauauuaguaucuaauuuggaacacugcaauuauuuuuuuagaugugaaauuuuauucauuuaucuguuuuuaacuauuuagauaaauuuaucauuaaacuauaaauuuguuaauaagugugcuaaauaaguggaaauaaaacauugaaugauguaucaguuauuuagugggcaugauuguacuggaaagcaaauuauuuuuuuuguuaguuaaauauuguaaaucuaaaguauuuuauuucuuacuguguuuuuuguguguuuuucccuguaggcaguaaagagggauauauugaacacaguugcugaucguugugaaaugcuauuugaggaucugcuuuugaaugaaauuccagaaaaaaaaguuaugaguauaaaauaaguacuuuuuugcguaucuucaacugauauaguaauaagauaucaagauauagcagauacgucaucuuuuauagcuaccuaucuauauuuucaagcaguauaucaucuuuuauuauuggaugaaaauuuuucaguugcuacucagauuuuuuuuuuuuuuuuuagacagagucucacuguguugcccaggcuggggugcaguggcacagucauggcucaccugcagccucagccucuugggcucaagcaguccuccuaccucagccucccuaguaggugggccugcaggcacaugccaugaugccuugcuaauuuuugguauuguuuuuuuagagacaggguuuugccauguugcccaggcuaguuucaaacuccugaacucaagugauccacugucuuuggcuucccgaagugcugggauuacaggugugagccaccaugcuuggcucuagaaaaacguuuuagaacacuaucaaauuuagcaaauuugucaacaauuaagaauuucagggaggauuuuuaaaaaaauuaauuccaagugaacuucuccugccagaaugaguaaacuuuguuaacauuuuaaaguuaguauuuuuuguugauaucuaugaguauuuuaaauaauuuagccauaaucaaaauauuauuaguguuaaauacuauauaauagcuccuuuaguagguacuauuuauauaaacuacacuaguuuauaugcuucucagcuauuacucuaacagacuucauuacguuuaaaaaaggcugaguuacaguaucuuacccauuaauaacgauugcagcuuuugggaaacauaacaauuuauaccaucgcaguaaucuguauuaaaaaauuuuuuuaaucaaaagcaaguuaaaauauugaguacacuuuuuaaagcuacaucaucaucuccccauucuuuuuuuuuuucuuuuuuuuuuuuuuuuuuugagacggaguuucgcucugucgcccaggcuggagugcaguggcgcgaucucgacucacugcaagcuccgccucccggguucacgccauucuccugccucagccuccuguguagcugggacuacaggcacgcgccaccaugcccggcuaauuuuuguauuuuuaguagagacgggguuucaccguguuagccaggauggucucgaucuccugaccucgugauccgcccgucucggccucccaaagugcugggauuacaggcaugagccaccgcgcccggccuccccauucuuauuauucugauguuaguggauuugcaauucacauuuagauauguacauaauugaaacauucauauuagcuucggguuccagcaauucuccugccucagccucccgaguagcugagauuacaggugcccaccaccacgccuggcuaauuuuuguauuuuuaguagagacaggguuucaccauguuggccaggcugggcucgaacuccugaccucagaugauccacccaccucggccucccaaagugcugggauuauaggcaugagccaccaugcccagcccacauuagcuuuugaagggaauauuuuuauguucauaggaaaaaaagcauagcuccucuauauaaccaacuucuuuuaguacuacugauagcuaguauguuaaguuugauggacuaauuauaaucuuuuuuuuauauuccuaguaugcuggauucuaugauuggcagauuuaacauuuauccuucucguaauucacaacccuaaaguuccauuuacuaauaauuuauaauuuugcuggaacaugaauuugaaucuuacaugcaacaauuggauugagaguuuugggagggcaguaugugggaccuguucacauaguccaucagucuagcagccccaucucaguguggcuuuguuuuugcaauuugacuuugaguuugugguaacuccugugguguaaaucauugcuucagguucugagcaacaguguauauuauagcugcauugcagguuucaggauuugcaggguauggggauguauccaccauuauuguuaaagauuuaccuuagcagacacauuaguauacucuucuauuuaaaaauccuuuauaaaagugguauuauauggcuauccugguauucuuucauauuguuaguacuuugaaauuuuugcugauguucaauuaguaaaauuaauggccccuaacagcaguuguacuguuuguauguuaaacuugauacauuuagaaguuaauguuaaagccuaauccuaaauuuuuaaaaggugaaaaaguuuuuacuggcaauuggguggccuugggaccugugugaagagcauagacuguaguuugguggaaagagcaaagacuuugaaguucucggauucuguguguauucugcuccuagcagagugaccucaggcaaaugacuuuauaggcaucguccgucuuucugucugucuuucuuucucucuuucuuucuuucucucucucucucucuccuuccuuccuuccuuccucucuuucucuuucuuucuccuuccuucuucaucccaucucaucccuucccuccccuucccucccuuccucccucucuuucuaugaucacauaguuuuugacauucuuuuggugugauguaucacauuauuaauuuuuguauguuggaucauccuugaaucucuggaguaaaccccacuugauuaugauguauuaucuuuuugauguacuguugcauuugguuugcuaguauuuuguugaggauuuuugugucuauguucaucagggauauugucauguaguuuucuuuuuuugugucuuugguuuugguauuaagguuaugcugaucucauagaaugaguuaagaguucucugugcuucauuuuuuuguaauaguuugagaauaauugguauuauuucuuuuuuaaagguucaguagaauucauugguaaaaccauccagucuuggaguuuucuuuggagauuuuucauuacugauucaaucgugauuuuuuaucagucuguucagguuuucuauuucuucuuguuuucugucuucuuuucucucucucucuuuuucuucuuccuuucuuucuacgaagacaaguucucugguucugugucuauucugcugcuagcagaguaaccucagacaaauaacuuuauaggcauccuauucuuucuuucuuucuuucuuucuuucuuucuuucuuucuuucuuuccuuucuuucuuucucuucuuuucccucccuccuucccuuccuuucuuccuuuguuucuuuccuucucuccucuccucuuuucuccucuccucuuccucuacuuccucuccuuuccuuuuccuuuuccuuuucucucuccuuccuuccuuccuuucuuccuuucuuccuucuuuuuuuuaaugagagacagggucucucucugucacccagccuggaaugcaauaaugcaguuguagcucacugcagccuugaacucuugguccuaagugauccuccugccucagccuccugaguagcugggacuacaggcaagggccaccacgccuggcuaauuuuuuuuuuuuuuaacuuuuuuguagagacaagagucuuugcuauguuguccaggcuguaguccuguggcugugcacagguaugaucauagcuaaauacagcuuugaacuccuggcuguaagggaucuuccucccucagccucccagguagcugggacuacaagcgcacagcaguaugccugaguaaucuuuuaauuuuuaccuuuuuguagagauggggcuuuguuauguuguccagguugucucaaacuucuggccccaagcaguccucccaaagcacugggaauuauaggcaugagccacuaugaauggccccauuuucuuauauauaaaauaggaauuaugguaccuacuuuuugaggcugcaagauuaaaugagaugauguuuguaaggccccuaauaaaauugguguaagccaagcccucaucaagugguauugauaccauguuggagaugauggaggagaacaacuuauguuaauugucuuuaaaaugccuuaacuucaauuuuugggaaauuuagcauauuucaaacagaaauaagauguaaauauauauucaacacuuuaguaacaggauaauuauuccaacaacauauuaguugaucuuagguaucaagauaaaagaauacauuguaagugugauaauauaaauaaauguaaauucuuuaaaaaaauuuuuuuaauuuuuaacuuuuguggauacauaguagguauauauauauauuuaugagguauaugagauguuuuguuacaaucaugugauauaaaauaaucaucauggagaaugaguuauccauccccugaagcauaaauaaauguaaauucugauguugaauuuauacaccaaauuguuagauuuuagauuuuauccucauuuuacuuugcuuauuuucuuauauacugguaagaucuuauagaugcuguaauauaguaaaauguagaauguaugccauaaaauuaaccugaauuagaguauuuuugcaugcaugaggaagucuguuaaggacauaauaacuuuauauaucugaucucuaaacuaaaccuaggcuuuuaauuuuggcuauccagauaaaagaacuuaguauuucauugucaguuuaaaaaaaaaaaaaaacuccaauuaauccuugcacuuguugugaucuuccucuuugauuccucuuaagauacagccuaagccuucuucacuguuauaagucuucauuugauccugcucaacuuauucucauagaugaccuacucauugugaaaauggaggucaucaguuaugaaaccucuuaccuuugcccauccccacaucaguauccucuguaccacuccacugucuucccagaacauuuguaauccuguuugucugugccuaugauuccacucucugaauggcacuucuccuaucccuuuaugcagauguccucuuauccuuuaagcuucaacugugcuaucaccuauucuaaaaaaaaauucuaugaaaaauacauaaauaacuuaaaaguuucaguacuacucugauaccagcuaggacauuuaaccaauagaaacccaauucuuauuauauuggcuuaauuuuaaaauuuuuuuauuuguuuugacuuuauucagauaauguugaacuagauacuaugacaugaggauauuccuaaaggauucugcuuuggagugcuuuuugagaugugucuuuuccaaaagauuucuccucccauuuaaaccucagaccaacagaaaacgagucuuacuuagauacuaaauugcuaauuuaacuucuuaauuugaaaguuguagugcuuuuucuuuuuaaugaguaauuuaaauuuauuggaaccaguuauuuaacguuugauuuuuuuagcuuguuauuuuucagauagaccaagaauugauguaguuugaaaugguuuuaaaauuuugcaugccaauugcacaugcacauuagagucauuuuugaguuuuuacuuaaucuguuucaaguaacuguggcucaaaauaaaauaauauaguccuaauuucaauguguggacaauuuucgugcuacaguacaaauugcaguaauauucuucuacagcuaggaggcagucuggucaaagaguaaaauuucucucccaguucucaugugcaaacaagauaauacacagaaucuggaaggaacacguaguuuaagccauugcauuuccugugacacuuaaggcauuguucgucaucuucuguuuguaauuauguaaaguuaccacuaguuucuugacaacgaagucuagguuacuauuaaaauaagcccuaguuuuccacuugaucuuuacauuaguaacuuuuuaaucauaucuguugcugaaagaggucauucuuuucacaaaauuucuaucuuucugauaguucauaaggaucguagcauuuaacuaaaaaguaauuauauauuuacaugcaacagugacuauguuagaaauuaggggaaauaauauauuccaguuuguaaguauucacagaagaaugagauauuuguuauuuauuuagauuuauuuuuuucuaaaaaugauuuaaggcuuuuuacaaagaagcauaaguaaacaagugaaaauaaauauuaguaauaaagagucaaagggaagguaaaaaaagaaagcaaaauggaguugguagugagauagguacacaaaacuguauguaugacuagauguccuaaacaugcuugauauauaggaagggggcuacaucuaguaagaugaaauucauggggagauuaauacaaaaauguauucuaucagauccugugcacuagauguaagguggccaguaauuuggcuccaaacuuggaugaagaagagaaaaaccaacuauaaaauguacagugccuaugaggcuaaaacagacaagaaggacaauaguuucugacaucaaggacaaaauugucucuugaguguucuucauaggacagugggucguauaagaauguguaaucaacagcuuuacauugaaggcaaugauaaguuuauuuuauuuuuauuuuuauuuugagauggagucucgcucuguugcccaggcuggagugcaguggugcgaucuuggcucaccgcaaccuccaccucccgguucaagaaauccuccugccucagccuccugaguagcugggauuacaggcaccugccaccacgccugacuaauuuuuguauuuuuaguagaaacgggguuucaccauguuggccacguuggucuccaacuccugaccucaagugaucugcccaccucagccucccaaagugcugggauuacaggcaugagccaccgcgccuggagauaaguuuauuuuucauaggaguaucauuuagguuccuugcaaagaccagggguuuugagguaaagcagaauuugguaagagcaauuuugugccagaucaaccagaaaaugaaaaaauauugaccuuuuaagcuuuauuucuauuaguuuuuguauguacuucuaaaauauguaucacugauaccagugacaaaccuaucuaaauauugauaauauuucuuuuccuuuuagauucugaaaaagaguuccacguccucccuuaucgagucuuuguuccccuuccuggauccacuguaauguugugugauuauaaauuugacgaugagucagcugaagaaaucagggaccauuuuauggagauguuggaucacacaauucaaauagaagauuuggaaauugcagaggaaacaaacacaggucauuauaugaugcuauuuaagaaccugguuagauuacagcuaagauuuuaccuaugagaugucuaguuuaaauaucaugucuuuagauuuuuuuuaaagcuaguucuguuugacacuucgaaauauuaacugagacauuuuaaaauacauguuuaauuucuacaugucuagacauacagugaguauuuccugggaaauuguaccaaaauuuaagauacuaagguauuuuucaagcuuagcaaguagaucuuaauaaaacaaguucaggauuaaguagguaaaauuacaaagcuuuaagguauuucuuucaauauaaaaguuuucucaaaacucauuaucuuacuugguaaagcaucaugucagaacagaagguuuuaaaacacuaauuuauuaaacauuuucuccauauuauuugccuuuuuuuuuucauauaccuuucauguaauugggauacuaagccaaaaugggcaguuccagaaauuagaugacuuuuauagagcauagauuugcuuuacuauccagguuuuguaacacauuuuuuuuucccuagccaucacuuucacauuugacuuuauacuuuggaagacuguuuggguuuuuugcuuucuuuuuguuucuagugaguucaguguaugaaaacaugucuauaaauaaauauguaaguuccuuuucugauuucuuaguuauucuuugcauaguuaauucucccuucaggaauaggguguuugauucagagugugcuugagauuauagugagucaaguaaguauuugauuggggaacuucaaaucuauaguaaacugccucaaguuaguugcaaaccacccuuuaguuuuucagcaauaccagaucgugauguagagcaauaagcuuguuucaguggggaaaauaaaauuucuaaauugcccaaugccugauguuaaaauaaagaagagcuacuuucuaaucccaugaaaacuaauauuuuuaaagauacaacucuagcauaguuccaugaaaacuaauauuucuaaagauauaacuguagcagauggaaaguaucugcuuuuugaaaguagacugguaaaaauguuuacugcuuuccaaaauuuauuuuccuugguuagugacugcauuaucucugccaacgaaacuuaggaucaugaggacagggauuuuuguuuguuuuguucacuucucuaucguuaaggccuagcaauaguucuugagccauucuguuguugaauagaucuuauaauguugguaggaucauucaaauugaccuaauuuaaccucuuaauacugaaaacuacaucccuagcagauggggauucagauucuauucuucuuuauucuaaauaccaaucugccucccuguaaccuauucuuucaguaauaugcagcaauaaaacaugaguaccacuuccucacugagaccaugcuuuaaauuugagagcaacuauuauguucuaaacauuucaaagccauauauucucaccuaccuuaagcuguucauuuuauuacaguuuccagaccacauuuuuuucuuaccaccuuguuugcuuuccgguagauuaggaauuuuuaaccugugggguucaaaaccucuggugucagagcugaacuuuuagaagauccacaaaccacuugaaaguaauuguaugauuuuuuuucugaagaaaaggucuaucgcuuucaaagaguuuaaaaauuacuucuuaaauauacucugauuugccuuccuugaaauauguuacccugacgaagcuaaugcucuaaaaauaauauagccauuauuuauauaucugccaggcacaguuuuaagagucuuacaaauacuaaauuaucauuccuuguaacaacccugugauguaaauaacauuauuaauccuauuuuccagaugagagaauuaaggcucagaaaggccagguaacuuuucaaaguuacauugcucguaaugguggagcuggaauuuaaacuuaggcaguuugguuuuagggucugugcuucuuuucuaaaaauuuuauuuuacugccuuuguguaggagcuaaauaaugaaguauaguaugauuauuuuccaugauauagauacauauuuuagccuggcguucuucauuccaucccuuuaaacauuuucaaguguaaauggaugauguuacauuaucuugguuuaauuucaucuagauuaugucaauauaauuucucauuuguuggcuggaaucuuggaucucauuauuuauguuuauauaaacauauaaacaauauauaauguuuauauauaauauaaacauauacauacauaaacauguaauauaaacaauuuguguauguauguaaacaaaaauguuuauauaugugaacauguuuauauguuuauaugaauauguuuauaaaauauauaauauaaacaauauacaaaaauguauuguuuucuuauaaaaauauaaaauauaucauguuuauauauaauuuuuugaauuauuugucacauucuugugcaucucacauucuuaaacuaagaaugacuaaggguagcacuguaugcaaaacuugccccauucacaaguuacuuuaaaagucagauauaaaagaauaggaagagagagucauuucaucuagguuuuuuaaauaauucuuaaaaauauuucugucuuaaguauuuuuaacucauuuaauuucauguuguauguuaaacacaaguauauagacuaguuuaagacuguuuuauucaguucuuuuuaaguuaauauuuuaacaaacaguuaguaacagagguuuauauucuuucuuuacauugcuaagacauuaaaaaaaauuaacuugggcaacauggugaaacccugucucuacaauaaaaauacaaaaauuagcuguagaaguuucaaugggccguguuuacaccacugccguucagccugggugacagaguaggacccugucucaaaaaaaaaaaaaaaaauuaaguagcuucaaccacuguaauguauuccuaagagguaacuauggcaaccuggcaugacagccucccaaaaccaaaacuaaaacccaauaaauucaaauucucaugaaaccguuacaugugcauuucagcaaacaucuguugaaagagcaaaaagggccuuugccucucuugcuuacuguuguguuucuagcacuuuacuaagagcuuagccuuagcaugucauagguauucaguagauauuuguugacugaauaaauuauuuauuuuguccuauggauuagaguccaaagaacaacaaaaugcugauucugucuucaaggagcuaaguagauuuuuguuuguuuguuuuuugagacggagucucgcucugucucccaagcuggauugcaauguugcauucucagcucacugcaaccucugccucccggguucaagcgauucuccugccucagccuccugaguagcugggauuacaggugcgugccaccaagcccagcuaauuuuuguauuguuaauagagaugggguuucagcauguuggucaggcuguucucuaacuccugaccuugugauccgccugccucagccucccaaagugcugggauuacagguguuagucaccaaggccagccaauagaguuuuuuaaaaaaaugucuguguagauacuauguuuuuacuaacuucagacuuguucagacuagguaaacuccuucacuaaacuuucuuguaguucccucuucuaugcuguucuucuauaauacuuuacauacuuguaauuauuuaaaucaucaauugcauauuuaauguugaucuuucacauuagacuauaagauuuuugagaguaaguagaguauuuaucuguaccuaaaacaugguagguguuccuaauuauuuguuacugauucauaaauacugaauaagugauucuuaggaaacuacagcacuucuuguuuucacauuuauuucauacuugagaaauuauuagcuuaugccuguacagacaagguuuuuaagauuuguguaguauaguauauugaacauguugaggguuuaaaaagucuauaauauucauagcuguauggcucaguaguucagaacauuuucaggaguuuugaacauuuaagacaugaaauuaugucuuuuauaugaaaauauguagcacuaguuguugccccagaaauuuuaaucuaguuuacagcauuuaguaugucucuuuaucagauguuuauuaagcuuaugcucuguucaagacaauauaauagauaugaaucaauaacuugauuccuuuccuuuagaagccuagaggaaagauagaauguauaugcgugauuaguuaugcagagaauguaguaagguccuaagaguaccuaagaacuccaucaagauuagugaucagaauuuuagggucuccagugauuugguuaauaauuuaaucagaaaaaagucucuauuauaggcauuagcaguaaucuauaauauacaguaacgaaguuuuggcauuccuguauuaaaauuuuagugggcugggugcgguggcucacgccuguagucccagcacuuugggaggccaaggcggguggaucaccugaggucgggaguucaagaccagccugaccaacauggagaaaccccgucucuacuaaaaauacaaaguuagccaggcguggugaggcaugccuguaaacccagcuacucaggagguggaggcaggugaaucacuugaacccggaaggcggagguuguggugagccaagaucgugccauugcacuccagccugggcaacaagagcaaaacucugucucaaaaaaaaaaaaagaguuaguaaauuauuucccuuuuuuuauucuuuauuauaauguugaguaucccuaaucugaaaaucuaaaaucugaaaugcuccaaaauuugaaccuuuuugagcaccgauaugaugcucaaaggaaauguucauuagagcauuucagauuuuggauucuuggguuaggaaugcuaagcugguguacugcaaguauuucagaauuuaaaaaaaucugaaaucugaaacacuuacgaucccaagcauuuuggaugaggaauacucaaccuguacuacuucuauguuucacuucaacugaaaggucacugaaagcacacaccaguuuuauaaauugaugcucuguaauauacaguguaugauccuacuuguauugaaaguuucauaguuuugaaugauguuugcuuuugcaaauaaauaaaaguuuuaauuuuagccucaaaacaauauacuuuauccauuauugucagauauaaaugcuauucucuaaugaauuguuuuuauuuauauauauaguaaauauauuuuaauccucuuucuuggguucccucaguaagcuuuaucauuagcauuauuuguaccuugugaaauauuagcaugaaccaguaaauaugaaauaccuuaaaauaacguaaaaaucuuagauaauauauaaauauuaauacauaugucugauuuguggauuuuaacuuucauaaacuuuuaauauuaaaacuuaguuauauguuucacacuguauuuaaaaauuauuuacugucuauauuucucuuuuuuaugcugacagucuaguauagagauggauuaacaguaggaagaguuuaauauuacaagaacaaaggaagcaaaacagcaauuuggaaaguuuagguguguauacuuacauguaugccauauuaaacucaugguuucuagaugauauuacacauuuuucuaauauuguauaauguauugaagauacuucaguaugguagguaugauccuuucaggacucugcccuguuuuugaaacuuacauggaucucaagugagugacugagugagugagugaugucuguucuuggcugccuauuauguauuaggauucuacagauaaaauauguaguccugacucucaagaagcccacagugcaaugggaaauacaaagaaaugaguuauuucaaaacaagguggcccaugugcuguaauaugcugaucccugguuuuauuauuaauaucuaauuauuugaaauuauuaauugcugaaaccacuaauaauucuauaacaagaaugaacagagaagagucagaacucuuagcagaggcacugucucuguaagggauucagggaaagcuuagagcaggugacauuugaguucguuuugaaggaugaauacaaauaaaaguagcuuuuuaggaauugaacacugguaugagauguauuacaaccaagaauaugacuuaccuagaaguauaaguuucaucaagcauuuguuaaauuggaaggaaugauauaguaauucugcauauuuauuauaaagaacacauucccaaauaauagaauaaaaacauacauuuuaauagaaaaauuaagugcuuuuacauaaacauccuauuuuuuuuagaauuauaugcgcuuauucacucauuuacucauuuauucauuuacucaaagauaguagaugccauaauuuuacaaagauaauguccaggaguccaggccugccacuuaaaacuaaccuuaaagaaguccccucugaguccuagauucucuugggguugaugugagaauuugguaaaacuguuagggaaaaugcuuucuaaacagaaagagauauauaaauggaggaugauauuaacacauuauuaggcuuuuaaauacugaaccucugacuuguaaugaaaaauauuaauguuaaaguaugaaaaugucuuauaauauguauaaguuuuccuaaauauuugaaauuagaguuuccauauaaaauaaaccauaagaaaguggagcucaaauguucaaauucaaaaauuggaaucaauuacuacgcauuuaggaacauuaaauuugcuauaaacauauugcuuugucuucuaaguauuuaacauuagagguugaauaucccuaaucugaaagucugaaauacaaaaugcuccaaaauuagaaacuuuuugagcaccaacaugaugcucaaaggaaauauacucauuagaacauuuuggguuuuggauuucagauuagggaugcucaacaaguaaguauaaugcaaauaauccaaaauuugaaaaaaaaaaucauuucagguaaaggaugcucaacuuguaugauuuaccugauuauuacuuauuucuguucuauaguauaguugcccaaguaguugcuauguuuaaaauacauauuugccaaguaaguaucuuaaaauaacauacuuuuaaaugacuuaagagaugaagaacaauuuguuugucaaaaugacucgcuugaggugagggauaacuauggcuuuaaaauuucuuagcuguguuagucaucuccuaguagauguuaacuugauaauuucaauguacuuuuaucaacaguaccaucuaaaaaaauuugaagucauaccuuuaaaaucuggugaaccucaucuuugccaauaucagagcugagauuaauuuuugucauuugguuaaacauugacaauuauaaaggaaaaaugaguaauacugaagauauaauuuuauggcuacaucgcugacuauaaugauacaguaauuuaggaauuagggauaggaagaacacaggcuacuaaggaguucaagucuuaacauuucauuuuaagcuucuaaauaguucugccuaccuaucagcagcuuggaaugaaaucugaacacgucugcaacuuuugcaugcauucacagcccuuguuuucucucucuuuuugacagcugcucaagaauacucuuaacaugaucaguuuucgauuugucugaauuugaaaugacuugguuuuaaggaaugguugagaucuaguguucuauugaaucacuguguuauuugcauuuaaauuucuuguaauauauuaaaauauuggugaaauaacacagugccugagauuugguuuaaaaauccuacaagcccccaccaaaaauaaacagacaaauaaauugcugugauaaggccuuauucauuauugaaaaacauucugcuucgguaaaauuaucucaaauuuguaucaaaccucaugauuuuguaugacagauuuaaaaauggaaauagggcaaugaaaugucuuuuaugaaaguaaauuauuugcucagaguacgaucuucuagagcaugaucuucauauguaauaauucaauauuaaauauauaaguaauauauuaugacaacuaaaacaauuuuguuuuuuuauaugcaaguauucaaguaauaaauuuccuauagcaaacagguauaauucauaccauccauuauuuuuguuuguuaucugauauaaggauuuuauuggcccaaauaugggggaaaaaaacaaaaaccuuuuuuuuuuuuuuugagacagucuugcucuguugcccaggcuggagugcacuggcacuaucuuggcucacugcaagcucugccuccuggguucacgccauucuccugcgucagccuccugaguagcugggacuacaggugccugccaccauaccuggcuaauuuuuuuguauuuuuaguagagacgggguuucaccauguuagccaggaugaucucgaucuccugaccucgugaccugcccgccucggccucccaaagugcugggauuacaagcgugagccacuacguccggccaaaaaauaccuuuuuaacagagauauuugcucauagaagagccgaaguuuguuuuuguuuuuauuugauguaaaauuguaugagccauucaauuuuuagaccuauggacugaaguuggaagaaauuuuaaauuacugagcuaauauagucuagaacugaaguauuauagcccuugagaaaacuacaaacuggaaauauagaagacuagauauuccuagagacaguucauaagaauuuguuuuucuuugugacugguuugauaugagaauagaaaaaaaaaggggggaggguuuuuuuguuuuuuguuuuuaaaguauuuuaguuaaaugcuagaagaagaaaaagaaaaaagaauaguggugcccuuauuucuaauaagauaguuacuaggaauuguuuaugaaaaucauaaacuuuucuuugugagaaauuaaugagaaguagguaauuuuuuuucuuuuucauccauuuuaguaucauauauaccuauuucaguaaguuuauaugucauucuuuugagcuugugcucccauauuggggugcaaagaugucuauaagaacauuguaaauucaacaauaggcuauuuuacuuuaaauuuaaacaguaauauuuacuaucucucuugaguucucucucucuuuuuugugggggugaggguaaauaaacagauaaaucuaaaguaguugcuuucauaaucuaguucccuggaguucuauagaguagcauucuaaugucaccucuaggauggaagaaagaagcuggucugacuccaggaguccucccucccagcuucagccuggguagcauacuuucaucuuuuuuacacacugggaauuucugucagauuuucuuuguuuucauaggauucuucaguccuaggggaaaaaaacagaaaacuauuagccuguguggucucugaggaugcuaucaguucacacacuuucauucagcauuaaauaaauucggauaggccaaccugcauaaauugcugucagcauaaugaaguagaaagagaacuuguguccaaaucaucagucaaaugccugugauggucgaaaugcacuuuaaccucccagguuauguuuuccauuuguaaaaugcgaugauguccuugccuugcuuaccauucugaguuguuucaaggucaaauuuuugaucauaguuucaauuucaaguuggauccagagucagcaaacuuuuuuuuguacaaauaaauauuuuaggcuuugugagccgcauaaggucuuuuucacauuuuuuuuuuacagucuuuuaaaaauaugaaaaacagauuuuuaguuuaagagcuuuuacaaaaauaggucaugagccagaggcccauguacugcaacgugcuggucagugguuuuauuauuaauaucuaauuauuugaaauuauuaauugcuaaaaccaccaauaaugauauaaauuagacugggcaugguggcucacaccuguaaucccagcacuuugggaggccgagacaggcagaucacuuauagucaggaguccgagaccagccuggccaacauggugaaaucccaucucaacuaaaaauacaaaaauuaggccaggugugauggcucauggcuauaaucccagcacuuugggaggccaaggugggcagauuaccugaugucaggaguuggggaccagccuggccaacauggcaaaaccccaucuuuacuaaaaauacaaaaguuagucgggcauaguggugcaccccuguagucccagcuacucgggaggcugaggcaggagaauugcuugaaccuggaagguggagguugcagugagcugagaccacgccauugcacuccagccuaggcaacagagcaagacucugucucaaauaaauaaauuaaauuaaauuuaaaugcaaaaauuagccaggugugguggcaggcggcuguaaucccagcuacucaggagguugaggcaggagaaucacuugaaccugggaggcagagguugcagugagcugagaucaugccaccgcacuccagccugggugacagaguaggauucugucucaaaaaaaaaaaaaaaaaaaaaguaaauuaaucucaagagcgaaguuuacucugcuaugaauuuugguauaaauuuaucucuacuacuauauaguaaacaaauuauuauuauuguuacuuuuuuuugagacagagucucgcucuuucacccaggcuggagugcaguggugcaaucucggcucacuguaaccuccgucucccggguucaagcaguucuccugccucagccucccaaguagcugggacuacaggugcacaccaccaugcccgucuaauuuuuuguauuuuaguagagacgggguuucacuguguugcccaggcuggucuugaacuccugagcucaggcacucugccugccucagccucccaaagugcugggauuacaggcgucagccaccaugccuggccaacaaaucacaauuuuugaaagucauucagaacuggcuguguggcccucugguuuaguucaaugauaaagcuacauuguuuugaaaacuguuaauuugacguauauucuauuaaauuuaauucaccuacaauugauaaugaacaaauucaguauguuauauaaaaaacaaguagaaagaaaauggugaugaucguauaguuuuuuauaauguucuuuaaagcucaguuucauguguuaauccuuauuuuauguggaauuuauuauuauuauacccuuucagcuuguaugaguucuucuaugaauagucaagcuucauuggacaacacagaugaugaacaaccaaaacaaccaauuaaaacuacaauguuauugaaaauucagcaaaacauagguauuuaauuuuacuucuuuuauaacacugaaaacauauuuagauuugaguuuucuuguuacuuuaagaucuuuguauuucauuucucuuucuuaagauugcuagacuuaacaguauuuauuggguauuauggaaaguaccaggcccuagagauaggaagauuuauaauucauacauugucaucuaagugcccucaaagaugacacauccuauuaauuuuuaaaacguucuuaaaagaaaaagcugcagaguuuugggaaucaguuaauauaguagggcuaauguuuuacaaacggguguucuuagaauuacuauugcaggagauuuugauagguguucuaugacaaacaacguuaaauucaagucaggaauuuuauaauguauuuuuauauuuuaaaggcucuaagaauuacuuuaacaguuuucagaauuuuugaacaaggaacaugcagacuauuguuuaguggaguaacaauuugagaaauacuaaguuuuaagacuucugacugagaguuaggagccagaagauuuaauuguaguucuugucauucauuagauaaauuuaauuaauuuuuuuguacaugugugugugucugucugucugucuggacuacuauggucauuuucuuucuuucuuuuuuuuuuuuuuuuuuugagacggagucucgcucugucgcccaggcuggagugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagauggggauuuucuuucuuuagcuuacuauaaucaggaaaaaauaaaaguuacaacuuagauguacuaauuauuagauuuuauaauggucgaacauggacuucugcaguuuucaguagcuacacaaguuacacagguggcuuuauauuauaaugauugagaacuacugccuacuggagcugccguuuucuuuuaaccuacguagcauaagacagcugguaugccaauauaaauauuuauauaagcccuuuaaaguguuuguuauuuuuucucuuagauacgucucagugcacaugugugcaagagagauacuuuguccaacauuugaaaucuaguuuuucaacuaauugcuguauuuuucucuaagauguugcugccuuuuaguauauacauauguaugucuauguaugauuguguguuuguguauuguuuuuuaggcccaucaguuacccacauuucagagccuaggauuaguuuggccuuucuuuugcucauuccauuuucauuuguucuguguuuguuuuacuuuuaggugugauugcagcauuuacaguugcaguccuugcugcggguaucuccuuucauuacuucagugauuagggugaggcacaaagaguuucuugaucauccagagaacauugacagacaauuaugaauaauaaagauguuaacaauccaucuguauuuaaaacacuagcagccagaucugcugccaugaugccuauuugguguguuucugauuaaaaugaaaucacaagcugccuuguuuagccugcuuuacauuguagguggcccgcauuuccagaaauaacguuaugcaucuagauggaagcugcauguaacaaaucauuauuaucuauuuuuaaaagcuucaaaaugaugggauaugaucauagauuuuagucuuacuaaucugaaucacauauuaaucaggacauuaaaaacuuuaacagaggcaugauggcucacacguauaauccuaaugcuuugagaggcugagguaggagcaucaccuggggcugggagggaguuggagaccagccuggaugacauaaugagauucugucucuacuggaaaaaaaaaaaauuagcuggacaugguggcaaucagcucuagucccaacuacuuggaggcugaagcaggaagaucacgugagcccaggaguuugaggcugcagcgagcuaugaucacaucacuguacuccagccugggugacaaaaugagacauugucucuaaaauacauaaguaaauuuaaaaaaaaaagaauaauaauuugaacagugaauguugauguaacaucuuaauaauagagcaccagaaaaauuucuaccaaaugagacaacaacuuuaggauaaguucauccucuaggagcuuucuaaugugcacucaguuccuguauacuguguguuuuguucugaucaagggguagggaaccuuuccagagaagucccauuaguaagaaaugacauaaaauacgugcuuucucagguuacuguauaacuguuauaauauauuuaauauauaaaauuaagacuuuugcuuccagcaaguauguuagacuagauauuauaaaacaacuagauccugaauaaaaucugcuuuuaauagguucacuggaaguaggagaauuuucaagaaccauacuucgacauuuccucugccacaaaaaaugaacgcauuuuaaguuaggagucaugaauacuguauugaccauacaaguggauuaugguugucuggauggcagauaccaauagcaacauugucauaugcaguuugccucaaaucagaaacaagaagacaucggaaucugagaugcugcccuagagaggacaguuaaagaagguucagugguccucaguuugcagugcucuagcuccuggcagaagcaagagggaaacauuccuaauuuaguuccaagauuccuacagauuauuaucaaguaguaguauuuuaugacuagagaucacaggcacaaguugaaacaaacuaacaugacaagaaagcuauagaaaaaauaaacauugaacucaguucuucaagguuucaucaccaacauaaggaaugaaguuggaaccacaggcagaucugaaaaagaaccaaauagagcuccuaaaaaugagaaauauuuauugaaauaagaaaaaagcccucagacauguugaauauuuuauuagacucagcugaagagacaagugaacuaaacuauaagcuggaucuaaagaaauuacccagugagcagugaggagaaacaaggagcuagaaaacauuggaaaguuaagagaguucgagggaagaauuauaaagacuaggaguccuagaaagagaaaauuuagagaauaaaggagaggcaguacuugaaagauaacacaauuuuacaaauuuguuggaaaaacaugaauucauaaauucaggaagcacaauauauaccaaacauauauuuaaauaaaauccaggccuagacucaagguauuguaaaugacaagauaccaaauacaagauuuuaaaagcaaccauggggagaaaaagaucagugaaagcaagacagucaaauacuuaguaggcuuccuaacagcaacaauguacccaaaagaggguagaauucugagaaaaacuauuagcuuagaauuugcaacaagcgaaacugaaacaaacagaugcucagaugaaaaacagauguuauccucagcacaaauucaguaaagagacuacaaaaggaugaucuucaagaagggaaaugauucuaaaaggauuaucugaaauugaaaaacuaguaagcaaauaaaugauaaacauaaguaaauuuaaacuguuguuuguauaaaacaauuauaaugaaguguuuauaagaaauuguaaacaaauguaaaacuaaauaaacauuguuaugcaacauuaauaau

SEQ ID NO: 12891 - RNA, 63182 nt, Homo sapiens
cgcagagccucagccaaagcgacugcggucgccaccccgcccccuucugggcgccauagagagcguggcgguaucccggagccugccguccggcccuaccgggaccgaugcccucuaguggcucaguguccagaagccgccaacgaggacgauccauggcaucccggggcuuugacgguaaggucaccagcucuucagggagggccaaggggugacgaguacguauguggcgccaccgugcggacagcgguuacggggccgagauaggagagccaggggagcggggagaaaaacggaagcugagagggcggugcagcauugggcucccggaaaagaaugagaaaaacacuacauuucccagagcccuacaaggccugaaguggguggagcuggaagccggaaaauugggugcgcaagaggaucagggauagccucugagcucggguucccaggguucguagcuuccaacggcugcgcgcgcacuucggucgcgggcggugaggugcuguugcugaaacgcugccgcugaggguggacucgauuucccagggucccgccgcgggagucuccggcgggcgggcgcgcgcgagccaccgagcgaggugauagaggcggcggcccaggcgucuggguccugcuggucuucgccuuucuucuccgcuucuaccccgucggccgcugccacuggggucccuggccccaccgacauggcggcgguguugcagcaaguccuggagcgcacggagcugaacaagcugcccaagucuguccagaacaaacuugaaaaguuccuugcugaucagcaauccgagaucgauggccugaaggggcggcaugagaaauuuaagguggagagcgguaagugagaugcucuuuccguccuugguuuugggcucgacucccgcccuuugggucuggucuucccccaucaaguuggcacuggguaccgcucuguuaaccucacuuccugggcucuguggauauccugagccuucgcuuuccugcuccuuacaguuugauaagaagccuuugaaaaaaaaaucugaaucuaaguucaguagcauuuucuuuguaguuaggguaggcucauacagggacgcuuauuuuccuucguccggcagacgggaaacagacuugauagagucugcgaacccaucucucuaagccuagaguaccuuauauguuuuguugcacuucaacugauaguggcuccgcccuauuuucuaggcaccugcauucuaggccuuugccaaauugaccacucugugcacuuguucuuagugugugcgucgucccguggcuccagaacgaaucagauguuuacaaaaaugaauauuaggugcauaagagcgcuggaaacacagugaaugugcaguacauaaauuuaauauaucuugauuucucuuaaaaaguuggaguuugauagaaaacauuaaaauuuucuuguaauuaccuaaaguaggccuuuaaguaagaaaguuacugacaauaauggcuugaacauccuugaaaaaaauaugaagaauauagucauuaccauuaguaaaauacaaacuucccguuaauguguuuugguuuaccauuuguuuggggagguucauacuguucuugcuaaguugacuggaaauucugaacaaguuuuuacuucaaaaaaaguguaacugucaagcagaauugaccuugaaaauuaguucucugaucccagagcugaguauaguacauugcauucuauuuauuaauuugcaccauaaauauugaaugucuuacauguuccugauacuaugcugaacaugauauucaaucccuucccuuggaaaguuuacacauuuacuuuuacauauauuuaguaguuuuaugcuuucagguaauaucuugacuacuauaaaagaagucuuuuaaaacaaaggaguuuuuuuuugucuaaacaauuuuuucucguguaauaaauacuuuauuuauuaagcaguuuacugaugucuggagaaaauacuaagauaaaugagguuaccugccuugaagacauugauuuguaaagccccuuuuaggccuuauuuuuauuuuuuauuuuuugucauguaagucguuuggaaaugcuuuaaguccuuuucagugcucagucuauuuaucuuuacucagauucucuuauguggagcacaauucuaauacuguaucuuaaguuuuaaaaucaagguuauuagaaauaaauaacaguauucacaauguauguacauguguuugauuuuguuuuuuguuuuuugcuugucugcuguagaacaacaguauuuugaaauagaaaagagguugucccacagucaggagagacuugugaaugaaacccgagagugucaaagcuugcggcuugagcuagagaaacucaguaaguauuuaauucaucuuuguaaguauucucggaguaucgaaaucuucagagacuccuuuauauacuuuggaaacauuugcuuacuaaacaugaaaauauugauuaagcaucauugguuuuuauuauggugauauuuugauuuuucacuuagugguaaagauuuugugagaacacagaauuuaauggucaggaggucuggauucuuauucugauuuugcuauuaaaauugcuuuugccacauguaaaucuuaacaguaucugauuauuguuuauaaaaugguuagacccacaugucugucuaccuagacagcuuuguaaaucaaaugagauaagaguucuugaaaucuuuuuaaaaaggugaaagcauuaugcaacuaaagaaguagagaguggcuuguuuuuauguugaagaaucgaagccuauugauuucauuauauuuauguuuuaacuccauuuuuuaauaauuuuuauaaauaucuaugaaucucaggauauuuccccuuuaaggccuaauuccuauaaaagauugauagcuaaucucuuucuuacuuuucuuacaucauuaaguuuuagaaaguucacaagauguuaaagauccugacauuucuuaggaggaugauaugucuugugcuuugcuuuucccauccaaguucugaccaggccccacccugcuuagcuuccgagaucagacgagauggggugccuucaggguggucuggcuguagacugcuucugcuuuaagaaagcaaacaucagaacauuaggaaagaucucuauaaagguguaauuaauuuuuuuuuuccuuuuuuuuuggagacagagucucacuguguugcccaggcuggaaugcaguggugcaaucuuggcucucugcaaccucugccucuuggguucaagcgauucuugcgccucagccuccugaguagcuggaauuacaggcauguaccaccaggcccagcuaauuuuuguauuuuuaguagauacagugguucgccauguuggccaggcuggucuugaacuccuggccucgagcgauucucccgccucggcgucccaaagugcugggauugccacugugucuggcugguauaauuaauugauacuuaauauaguucaauuuuaauuugauugauggagaaggaacacaggaaguucauaaucaaaugauuaaaauugcagcuuuccuucuuaauggguccaugaccaucaacuauuuagguuauaacuuuuuucagcuacuuuugguacaccucauuuuaaaaacguaauguauaugcauacaugugugauggagcauauauagcuagaucugguucauuaucuauguaguuuugccuagccauaauaaaaagaucuguuuaguaguagugccgaggaauuugagaaaaaugacugaauacagcuuuuacgagaucugggagaagagaaaaagggaugaaccuacagauacaucagauaccuuccugugguauacaguuaaugugugcgcgcguguguguguauuuauauacucuggaucaguaagucuggaaagcaguaaauaauauuaaaacaaaauagaaaauuuagacacauuuaauggggauuuuuuugcuuuaaugguccucuuuaaauagaaguuaagauuagaauuaauuaaaauguauuugcuuauuaaauugccaacauauguauuuuagugaaauacaguuucaaaauguauauuuuuggaaaaauuuuaaaaauuauauuuuuucuaguuagccuauguuuagaagagaaacugcauguaagggaaaagagcccauuuugaguggcaauugagagauugauaagugcguuaucaagcauaauguuuuuucuuuaaaggcucuauuuagagugauaaaugauaggaauugcaaauauucauuauugugauuugcuguauauacauguuauauaguuuaaaugcuuuuucucucuugauccugucuuuuuaacuccauuuucuuacugcuaaguacaguucacuguuucuuaugauauauguugacuuagaagauggcacugaaaaauaaaggaauuacuaauugcaugugacuuuccccauaaauguuggcuaggauuauuauacauuugauuuggagacaggauagcauauuuaaaauuuuggucuagaacacaguaaauuuugaaugcauucaugaauuuggaaugugauguacaaugcagucuuucugggcuucuguuuuuucauuuauuaaaauauguaagguuggcaguugcauaaaaacacucauugcaaguuuuaagcaaauguguauguauucauaaaauuccuuuuauccagacaaucaacugaaggcacuaacugagaaaaacaaagaacuugaaauugcucaggaucgcaauauugccauucagguaagagauauuucuuagaauaagcucauuguagacauuuuacuugaagggacauucuauucugauuguuuaucaguuauuagucaaugggaagauguaacugauguccuauuaggggaagcuaccaacaaaaauauguaaauauaaauuccuuaauuggaucuauguuuuauugauagauuggacaucucuuuuauucaacagaaauuaucuauugaaugcugacuguaguccagguauuauaucaaaugugauacaguugggaauuugggugaauccacauugguagucauuuccuuaggguaguuuuauaagaaugacaguuugaauaugaucacagggauugcugacaaauuuguuaauuaaagugguugcaugcaauuauuuuuuaaccagauacaacuuuauacuuuugccauugcuuuuuuaaaauuugcauuuuauuugguguuaaaagauaauuucuucacauuucugaagggaaaaaaaaauuuacuuccagaaucugaauaggcgcaaaaaagccucguaguauaccuagaaaggcuuuguaagaaauguauuuauaugaagaaugacucaauacccaagaaaacucaaauacuucucugaaaacugugagaauauaccuuuauaaaugaagauauugcaaauuucuggauggaaauguuuuccaaauuaauguguugguaauacauuuugacucuuaaguccaagucagauagccagaaacuuguuaauguaguucuaaagaugauuggggaaaaaaacauaguaauagcuaggaugcuucuaaaaaaaggaaguaucaauuuaaauuaaguacuugcauagccacauauucaaguuuuauaaagcuaugguuauuaaaauauuacaaugcugauauaaaaaucaguacagagaauaaaaggcaguccagaaauaaaacccaauacggagguucuuaaucuuuuggaaagaagcagagcugucacaaaaucuuuauaaaucuuguaaaaacuauggaucuguaaccgaggaaaauagugugcacacagucacauaaaauuuuucagaaaaaaaaaacuaugaagugacuuaaaaaguaauagaauuuauuuaacugcuugguggcugaaagaaagaaacugaaagcuuuuucacuaagauccaaugcaaggcugggaugcccacucaccacuuguauucaguauaguacuggacguaccagcaagagcaaucagacaagaaaaggaaauaaaaugcacccaaauuggaaaggaagaaauaaaauuaucuuuacuuauagauuauaugauccuauauguagaaaaccugaaagauuccacaaaaaccugucagagcuaauaagugaauuuauacaauugaaggauacaaaaucaauauuaaaaaaucuaguagcauuucuauacacaaacaaugaccuagcugaaaaagaaauuaagaaaagauuucauuagaguaccaucaaaaaacaacuuaggaauaaauuuaaccugggaggugaaagauucauauacugaaaauaauauaacauugacgaaagaaauugaagaugcaaauaaugggaaagauauaccauacucauagauaagaagaauuauauugcuaaaauguccacacuauaaagugguaaaaagauucaggccaauccugucagaauuccaaaggcauucuucgcagaaauagaaaaaaaaaauucugaaauucugauggaaucaguuuuaaaaauccugaauaauaaccaaagcaguacugagcaagaaaaacaaaguuggaggcaucauacuucaugauuuagaaaacuguuauaaaacuauaguaauccaaauaguacaguacugacauaaaaacagaaaagugaccaauggaauagaauagagagccuagaaauaaauccaaacauauggucaacuaauuucaacaagggugccaagaagacccaauggaguugugaucgucuccucauuaaugguguugagaagacuggauuuccacauuugaagaaaugaauguuggauguuuguguugcuuacaucauauaccgaaaucaagccaagauggaugaaagaucuaaauguaagaccugaagccauaaaacucagagaagugaacauaggggaaagguucuugacauuggccuugguaaugauuguuuggaucacaucaguaguucaagcugcaaaaagaaauaaacggaacuacaucaaacuaaaaagcuucuacacaggaaacaagaauauuaaaaggcaaccuacaguucugacauagguagcuugagauagauauuucuaacucaaaaacauguagauugccauuguuuugcugggaagcaguuugacaaguuuuuuguuuuugagacagggucucacucugucacucaggcuagagugcagugaugcagucuuggcucacugcaaccucugccucccgggcucaaaugaucaucccaccucagcuuccugaguaggugggaccgcaggcaugugccaccaugucuggcuguuuuuuucuacuuguagagacuggguuucgcuguguugcccaagcuggucuugaacuccuagacucaaaugaucggcccagcuugauuucccaaagugcugugauuacaggcaugagccacugcaccuggcugacaaaauauauuaaaaguuuuaaguaauucaauuuuuaggaaucuuucuugaaaaauaauuugaacuaagguguaaauacagugauauucuaaguuauuaggacauuuccaugugauuaaaagagauaugagaaaaauuuucauaagccuaguaaaaauguuuuaaaaauccaaaauuuaaauagaaacauuggaauuacggguauuuuuuaacuuugauguguaaguuauaagagaaagccagucauuuacacuacagcugauguuaacuaaagugacaauucuauguucgcuuuccuguauugcucuacuugauuuucuuacuuauuacuucuuuauaugacagagccaauuuacaagaacaaaggaagaauuagaagcugagaaaagagacuuaauuagaaccaaugagagacuaucucaagaacuugaauacuuaacagguaugaagaagugcuuguagcuuuuagcuccauuccuuuauuuuucuucuguuagugcuaggaguuagugcucagcccauuucuguugcugauauuuuuuuguuaugguugaguauagaguugucauauccuauuauuucuccuacucauuuaucuuuaaaucauugucaaguguuuaaagaagugucuagaaagugcacaagugaagaacaucucaaagaaguaguaauuuggaccagauuuuacaugcaaagauuuucacuacaaugcuguacauaaugucaaauuggaagcacuuuaaauauuugcaaaggcugaacuacuguucuuuauuucauauggacauccuugcuauauaauaagcauucaauauaagaacauauacucagccuauauuuauaaacagacugaaggaggcagagacauaaaauacauaaacauagacuguaguauauaauacagcugauguagucaggugaacuugacucugaagcaguuaaugguaagaaguuuccuuuggugcccaggcacgguggcugacgccuguaaucccagcacuuugggaggcugagguggguggaucaugaggucaggaguccaagagcagccuggccaagauggugaaaccccgucucuacuaaaaauaacagaaauuagccagucaugguggcacgcaccuguaaucccagcuacuuuguaggcugaggcagagaauugcuuaaacccaggagccggagguuguagugagccaagauugcgucacugcacuccagccugggcgacagagcuagacuccguaucaaaaaaaaaaaaaaaaaaaaaaaagguguuuuggguucuuuuuuuuuuaaugguuuuugaaauuuuuuuauuucuauaaaagaaaggauuuucagauauuuauaucauuauacaauaauauuccauuaguuaaguauacuuucccagucucacaagaguuccuucaaaauacuugaguguguugaucaacaagugguaguuacaacuaaacgaauucauaaaaucuagauauuuaauagauaguuuuuuaaaaauguguauuccauauugaguagguuuuuauauuagugcuuuuuagcuuaaugauuauuuauaaaauuuuaauaggucuuuggauauauaucaggaaaauuaagguuaacguugaauauuuagcuuaacacacuguauuuaaaauaaauuuggauaauucacaaguuuggauacacaaauuucaauuuuuugucauauauuuguagaaauugaauuuguaauuaacuauggcagaaacaaguuaaaauaagagaguugagaacuacaguugacccuuaaacaacacagugguuaggguugcugauuccccccacaguugaaaauuuauguguaacuuuugacuccccaaaaacuuaacuacugcuguuaacuagaagcccuaccaauaacauacacaguagauugucauacguuuugucugugaucuguauuauauacugugcuccuucaauaaaguaagcuagagaaaaaaauguuaagaaaaucauaaggaagagaaaauacguuuacuguacauuaaauggaaguggaucaucacaaccaucuucauccuccuugucuuuacauuaccuaggcugaagaaaagggguuggucuugcugggucagguugcagagguagaaggggaggcagaagagggaggcacacucaauguaacuuuacgaaauacagccuaauuucugucugacuugcuuuuucauuucucuaaaaauguuucuauacauuaccaaucuuccuuccaccguuugcuauaguuucagugcccauguaagagaaggauccaugucauaaaagaaaucaaaagcagucuuggguaaucagaacccuuccaccagauagucuguuaccaauauguuuucugacacugcuaguucuacauucuuuuuccacaucgucuggcacugguuuggaagcacucaucuccauccagucaucuucuguuaauuuaucugauaugguggcuauuagcucuuggauuucuccaagguccguaucuugaaacccuucaucccacuuuuuuugccauauccacaaucucuuucaugauuucuuugauuggcucuguuacaaauuuugugacaucaugcacaacaucuggagaguuuccuccaacaggaauuuauuauuucagccuugauggcuuucauaacuuuuucuguaaugaaaaagaagggauggccucuucaguguguuauccuuuaaaacuuucaugauauuuucucuguugggguucucuuccacaguguugacauuuucuuuucacaaaguaucaucucuauugagccguaaagguccuuaugacuccugaucuaaaggcugaauuagaaacauguuugggagcaaguagacugcuuugacaccuuccauguugaacuccuggguucuggguggccagggacagugucuaaagucaaaagaacuuuaaaggcagccccuuggccagguacgguggcucaugccuauaaucccagcacuuugggaggccgaggcagguagaucaccugaggucaggaguucgagacuagccuggucaacauggcagaaccccaucucuacuaaaaauacaaaaauuagcugggcguggugguaggcgccuguaaucccagcuacucaggaggcugagucaugagaaucacaugaaccagggaggcagagguugcagugagccaagauaaugccacuacacuccagcuagggggauagagcgagacugucuccaaaaaaaaaaaagggcagccccuuuacuagcaagguacuuucugacuuuagggacaaagcaugaguggaaccaauucagagaagggggucugucauuguccaggucuucuucuuguguaaccagaagacaggcagcugguguuuaucuuuuuccuuugggcccugggguuaaaagcuuuauaaauaagggcaguccuuaucauaaaccugacugcauuugcucaguacgguagaguuagccuaucccuuccugcccuaauccuggugcucccuucucuuucuuacuaauaaauaucuuuuguggcauuguuuuuuccagaauaguacacuucuaucugcauuaaaaaccuggugcaggcauauaaccuuucucaaugauuuucuuagcagcaucugcuguuucuugguugacagaaccugcuucuucaguuuuguugacauuuuuauaagucaaaccuuucuaaaauuaucaaaccauccuuuacuggcauuaaauucuccagcuuuagaucugucaccuuccuuuugcuuuuaguugucauauaauaacuuugcuuuaccucguaucauauuagagucuauagguaugugauagcaauccugcaccccauaaaagcugcauuuucaaugcgagauaggaagguauuuugcagaaaugcacuuuuuuaugcuugcuggcguagcugcagugauggcuuuacgaauuuucuuuuuauuucuuuuuuuuuuuuuaaacaacgguccauauacuggauucauuugucuugaaaugguggguaaccaucgcugcaguccucaaucugugguacauaucaagcaauucaacucuuuaaaauauugucgugauauuucccugcuucuuagaagaaguacuuccaacaucacuaguggcaguucuuauggaucccauguuguuauucaagguuuaugguauuguacuaaacacaaugacaaauaugcaaaaacuucaaaagauuucaaguuuuaugguauugcacuaaacacaaugacaaauaugcaaaaacuucaaaagauuacuauuuucugcauuaugcaauuuacugaagagagaaacugcucacaauagagucacacagcauucuauacagacacucaaaacacuugagcuuacugcaguaguaucaggagguggcuaugaaaguauuccaguaauacaguauguauuacaguuaauuuuaugcaguuaugguuuaauaaagcauauuuauauuugcuuauauuucucuugauugcagauaggguuguguaguguuugugugcauaaguuuugauaaauuuuuuaaguuuguaucauggauuugugcauauuuuaaugguaguaaaugauaaaauacacuaauaucuacauauuaguacauauuaugcacuuacaguagcuuuuucuuaguuuguucccauuucugggcugccuggauuggucuguggucucugaguuuuucaaauuguaaguuuuugggaaaaaauuccaauauauuuauugaagaaaauaugaguggaagugaaucugcaugguuccaaucuguguuauucaagggccagcugugcauacuuuguauuaaagguuuauauuccuagaaauauauuuuugauauuugguuccccugaguguuaauuaguuauuauuuuuuaauucucuucaccauucuagaggauguuaaacgucugaaugaaaaacuuaaagaaagcaauacaacaaagggugaacuucaguuaaaauuggaugaacuucaagcuucugauguuucuguuaaggcaaguaccagaugauuccuaaugcauaaacuauagcuuuuuauuaaaacucaccuaaauuaaauuucaaauauaggcaauaaaguaauuaaaagcugcauuuuguuuuguuuuuaaugucagaaaauuaagcauuaggacaauucuaguucaucuguuuugcuuguuugaaauuuaaguuuguuacaguucuuaauguuuucuaguuaagaaucuaugcaaauacuuaauuucuguuuugaaauaaaauucugcuugugucccuuagcuacagacaaaaucuuuugaauaaucauauaucaucuuuaacuguacguguuauuuucuuggauuucuuuaguaucgagaaaaacgcuuggagcaagaaaaggaauugcuacauagucagaauacauggcugaauacagaguugaaaaccaaaacugaugaacuucuggcucuuggaagagaaaaagggaaugagauucuagagcuuaaauguaaucuugaaaauaaaaaagaagagguaaguuaguaaaauuguguuuuucuucauguugaguauaacuuacauuuguaugucaguuuauuaaauauguauucaguaguguguaccugauuaguuguaagaugagugguuaaaugugaauaaugcauuacauuuggcguaaaaaaucaaccaauugcguuuacauaaagaauuuaagauucuuugucaaaucugguuaguaucuacugucuuacgauauaucuuuccuaaaauauguguuuguuuaagaaguggugguaaguuuuugugagcuaaaucuaaacauuguucugugagcaguuacucuuaguuuucuuaaauaugcauauuuuaauugcuuuuucagguggggagggggaguuacuuagcuuuuccuuagcagcauaaaccucaugucagaguaauuucaguuaauaugacauccuuucccccugcucuauuuuuuguuuuuagguuucuagacuggaagaacaaaugaauggcuuaaaaacaucaaaugaacaucuucaaaagcauguggaggaucuguugaccaaauuaaaagagguauauaugaccauuaaaaugucuuuuuuacaaaauacuaaagcacuuacgaagcuguuauuucacaaaaugaugucauuuuuuaaucuguccuuggccccauaaaacagugagaguccuccuuccauaugcuguagcuaggcuaaaauagaaucagaaauagcaauuauauguuauauugaaaauacuaucuaaaaaaugaguauggguuaauuuuauuguuuaauuauuuuacuuugaauuuaaaauauuaguaauauuuuauccuuaauuuaucuuugucaugaagacugauuugaauuugaguguuuuagauuuagcucuuacuuuacaaaaauggaauuuuucaucuugucauuugauaagcauucuaaauuuaguucaaaguagacugcuauaauugggcuauuuuuuucaggccaaggaacaacaggccaguauggaagagaaauuccacaaugaauuaaaugcccacauaaaacuuucuaauuuguacaagguaaauaucccaccacacauguuaguaucuaaauguugcauuguugacuguuagguaacuuuuuaagauuaacuuuuagagugccgcugaugacucagaagcaaagagcaaugaacuaacccgggcaguagaggaacuacacaaacuuuugaaagaagcuggugaagguaaguguuuucaguuaugggaacauuauuuuuguuauuguacucuuuuuuuuuuuuuacccuuguuuuguauagaugauuggauuuagguguuagacuuuauuugggacagaauuagguacagaagaaagaacuuuggauuaggaaauucagaauuauaucuuaagcaaauguaaguuuauauauuuuugaaaauacagacagcaggggguuuuguuuguuuuuuaucuaauaaucuuguauaauuugcugauuucuaaugagaaaguuuucuuuuuugaaacauuuacucugauaauguuugaauacucuuacuuuauaaauaagacauccucuuuauuugcauuuuguaaagucuuuuauuuccucaaauuuuugcuuuuuucaauguauuauauuuauggucuuuuccaauaauuuccuuuacuuaggauuaaagaucaaaaucgaaaucaaagauauaccuagaaccacuuuuuacccuuuggguuuccuuauuuucuuuguggguaagagacaucaaaaggagaaacaccaggcgaagacaauuccaaaauuauaaguagagcaagaacuuucaauagauacugucagcugaagccucucuagaaauuuaauauuaucugcugaggggagaagugacugaucuguugcauuuuguaaacuaaaauuuuaacuguauguuugaauauuuggucuuuaaaauuguuuuuuagccaacaaagcaauacaagaucaucuucuagagguggagcaauccaaagaucaaauggaaaaagaaaugcuugagaaaauagggagauuggagaaggaauuagagaaugcaaaugaccuucuuucugccacaaaacguaaagguauggcuaauagaugcuuguuagugaguugaaauacuacagcuuuccuacauaaaagucauuuaauuucacuaauaguauuuaucugucaugcugugauguaggaaacuccaucgaguuauauuaauagaauuuguuuuaaaauuaauacucuuaccuguaucuuuacagaaucgggcauauaaauaccauuugaucacacacagucuuguaaauucccagguuauugcaugauuuuuuagaauuagauguguuacaugacuuuuugaugucauguauuuaaaauuuuuauaggaauuacuauauaauguacaguacaugucacuuaccuugaaaaauuauuaauggcuuuuaguuuggaauuuuacaaauuauacuagauguguauuuguuggcacaggagccauauugucugaagaagagcuugccgccaugucuccuacugcagcagcuguagcuaagauagugaaaccugggaugaaacuaacugagguaagaaugguauuaaauguuguuaaauucuuuuucuucagcaaauguauacaaaucucuucaaaauuuaauucucccaaaacuuauuuuuaaaaucaucuuauaauuaguggaucauucuaggaaaggcuuucuuugguuccuagugcuguguaacuaacauaguaaacauugccauuuuguguuaguguuaaagaauguuuauuaugaaacuagaucaacuaaauauuugcguuguuaugguuagauuugaaacaacccuuugucuacuuucagcucuauaaugcuuauguggaaacucaggaucaguugcuuuuggagaaacuagagaacaaaagaauuaauaaguaccuagaugaaauagugaaagaaguggaagccaaagcaccaauuuugaaacgccagcgugaggaauaugaacgugcacagaaagcuguagcaaguuuaucuguuaagcuugaacaagcuaugaagguugguuccauuccuaaaauuuagccgugguaacaauacaaaugagaaaugauuuacuagguauuuuuuuuucuuaaggugauugagucagaaaaaucuaaauacgauuuucaauaaacacauuuugaaacuuauuaaacacugcugaucucaaaacgucauaccuuuauuuagcaauuuuuauguauuucaauuuuuauauaaaauugugaaagcauuuuaaccuuuuuuuaaugcauuuacuauguuuuccuuaggauucucaacuagagaauaauagccaaaucuccuaaaacugcucuucaaauuaaaauaaucucuguguaauaaaacucuccuauuugccauaaucauucuuuaucagacaguuguaauagccugccuagaaauaauaauauuguuugaccauagguagaacuccuuuuuuauaccauuucacaauuuggcgugucucuauaugcauuauuuuguuauugcucauuugcuuauuagaaguguuaaugaaauucauaaagauuuuuuccuuuuaagagauacugauggaaaaagagguuauacucugaauguuuugccuuaugguacaacuauuaacauuacugagggaaauugucaagauuucuugaacaaguuuuauggaggaaauucaguuaaaugaauuuauaucuacucuucuaaacugauaaauuguuucccuuuuguuggaaaagaauauaaauauaucccuauuucaaaauuaaaucucuguugcuguuauaauuuagaagucaguuuaaauccaaguacuuuauuauaucagcugguuuuuuucuucuucaucaagugaagucuagcagucccgccugccugagaauauugacuuuuuuaccagcaguguaguuugcaagagagcccuuggauccaauuagaucuuccuugaauuuuucucucuguugaaagugaggguuuuaccugaagcuuguuauugucugaaugagaaauaacauauucaaauuuauacaaaacuucuuuuuuaguggcuacaauauuauguaggauuuuauuuaguguauaaguugauuacuggugguguuugaguauuguaugucuuuauuacuuguauaaauccuagaaggaaguacaaaauuuucacuugaauuuacauuuuaaaggagauucagcgauugcaggaggacacugauaaagccaacaagcaaucaucuguacuugagagagauaaucgaagaauggaaauacaaguaaaagaucuuucacaacagguuagaauuuuuuuguuuguuuuccuacuuuuaaaaaccugacugcccaguaaucuuugaaucuguuugaagguaccuaagauagaacuaccauguaugaaauucuaauuaauuaggaauaguacucgagcagaguugcacccccauuguuucuuuucauagccccucccuuuuuucaaauguuugauaaauuuuuaaauuauacguguugguuguaauaaaugaagaaauaauucaaagauaaauaaaagcuuucuccaauuucuaccccucuacccucugaagucccaaaguguagcuaaguuaacagacaguuguguauuuuuuucacauccuucucuguauguguauauacaugagcauauauaaacauauguaagaauuauuugauuuuacugaaguaagacuggacuguaugcauuacucugacacuuaacaagcaaaucaauaaauuaaugucucauucauauauuuuacccuaauuuguguguguguacauccacgcaaugcacaaauguaaaaauuucacaugaauggcauuauauauaugcuuuuuguuuaaaugucuauuuuucaugcucugcccuaucauauauacaaaagcacacacaaaaaaauagauauuuguggguuuuauuugaucacuguuuuacaaaacuggagccauguuuugggaauuguaauuuggcuacuuuguaauaaguaauagccuucaauacauacuuaaaaguaauuuuauucuauuaaaauuugauuguuuagauuuuaauauccaaggaugcuuuauuuuuaaagauaauuugaggcaguacaaguugaagguuuuauaaguaauguuuuaauuugaaaacuuucauucuaaacuuguccagaauuguaacuaauacuauuuuauaacauauuaaaacuuuguuuuuagauuagagugcuuuugauggaacuugaagaagcaagggguaaccacguaauucgugaugaggaaguaagcucugcugauauaaguaguucaucugagguaauaucacagcaucuaguaucuuacagaaauauugaagagcuucaacaacaaaaucaacgucucuuaguggcccuuagagagcuuggggaaaccagagaaagagaagaacaagaaacaacuucauccaaguaaguagucacauaccucagcuuguugagcaaacauuuaugaaaaccucagcuaggcucagugucucaugccuguaaucccaacguuuugggaggccuaaaugggguaucauuugagcccaggaggucgagaccagccuggacgacauagugagaccaugucucaaaaaaaaguaaaaaauuagcugggugugguggcacaugucuauagucccagcuacucaggagacaggcugaggugggaggaucacuugaguccaggaguuugaggcugcagugaagcaugaucaugcaccacacucuaagugggacgacaggguaagacccuguugcccgcaaaaaaaaucuauguguuccuaacagugcuagauacuugggauauagugauauagggaggaaagaauugagcaacaauaccaaacaaaaaauuucuacuccaagaccucagguuauggguaagacagauguaauaaauagauaauaaaauaggcaaguagacaauuugcauucacugugauuagugccuaucugugggaucauagcgguagaggacuuguccuagauuucagggagcagaccggcuucauggagaaccuggagaaccuauguaagaauuagucagagguuuuuucaaaauacauguauaaugucuucuagaagaggaagaauggcuaagaaagcaagaagacuagaguuuggagugaguggaacugauuuaauuuuuacaaacaaauuuuucagauugcauugguaaguauaaguaccugaguccugugugguggggauuuaaaaaguaguucauaaaauacucagcaugaaaaaaaauaaugagagagacaaaaaugguaugaugaaugguaggcaaagaugcuugguuaauuacaguagaaauuacaaucaguuaacucucaguucaguccugugaauuaggccgacuuuuucuacagaaucacugagcuucagcucaaacuugagagugcccuuacugaacuagaacaacuccgcaaaucacgacagcaucaaaugcagcuuguugauuccauaguucgucagcgugauauguaccguauuuuauugucacaaacaacaggaguugccauuccauuacaugguagguuuuuauaaaguuauuuuaaggaauaauuuagaaauguauauuaagggauuaauuuugcaacauaagcaauagccacucuaaugaugguagcuucaaauuugacuaccauauauaauugcuuauaacaucccaucaacuguaaaacauaccauuauuuuauguauugcuaaaaagaaaugcuuucuauuguugaaaaaggugcauuucagaaucaaugaauuacaguauuuauuuugguuauguuuuaaugaccaaaacagauauguuuuaauaaaacauaaauauggauuauguuuuaacccauaaauacugaauuaucucuaauaaccaucaaaaaaucuuaauacauuguuuaguagauuccuuauuuaaaaacuccuauaaucuuauuguuucauuucaauaaguuuagcuuguuuauuugauaauaguguauuugcaaagaagcauuagauuaaagcugauuuaugaaagccaacaaagcauuuuauuagucuuuacuuuccugaagcuucaagcuuagaugauguuucucuugcaucaacuccaaaacguccaaguacaucacagacuguuuccacuccugcuccaguaccuguuauugaaucaacagaggcuauagaggcuaaggcugcccuuaaacagguaaagaucacaccuuuguccuggguuagguuuuuagagaacacaguguuaccuucucauaaucuccaauauuuaguugcaggaaauuuuugagaacuacaaaaaagaaaaagcagaaaaugaaaaaauacaaaaugagcagcuugagaaacuucaagaacaaguuacagauuugcgaucacaaaauaccaaaauuucuacccagcuagauuuugcuucuaaacgguaaguuuucuuuuguuucaaauuaauuaagucuaaauguuauacuuuacaauucaaaucauuuaaauucaagagcuaauuugcaauaguguugcuuuuuuugugaacuguguuccagaaugagaaccucugguaguucauuuuuuucauauugauuaaugauucucuaggcagugcuaaggguuuagcuuguuugauaaguugaagccaggcgcagcagcucacgccuguaaucccagcacuuugggaagccgaggcaggugggucauuugagggcaggaauucaagaccagccuggccaccauggugaaaccccaucucuacuaaaaauacaaaaauuagcugagcggcaguguugcaugcuuguaaucccagcuacucaggaggcuaaggcaggagaaucacuugagcccaggaggcagugguugcggugagccaagauuggggccacugcacuccagucugggcaagagagugagauucugucucaaaaaaauaaaauaaaauaaaaauaaguugaaguucaugugaggaauguugguaguuuaccuuccuaagauuaaaggacuuguuucgguaggacuuaauucuuuuaaaaaugcaccagaugaugagagaaaugagagcaaauuuuauuccaccuuuucuauucuagguagaagagaagcaagugcuauguaguuuuaggagaauuaauuuucuuggucacauccaaagaaauaauaaauauuucaugauuauuuguuauuaaauucauugaaugcuuguuaguuuaguuuguuaggacaauauuuauuuuuauauaguacaugauaaaacuguuucuguuuuauagcaggcaggauauauugcaggcaguuaccccuauacaucuaauaguucagcaaccccaauuaaagcacuucuuuuuucucuguugauaccucuagccagccauuaugucagcuuucaagcacauaagaaaauaaaacugaggauuauagaagaaaaaaggauuagcaaaaauccaucacuaacccuguauaauaacuuaauuuguauacugcauuguagugggugucugguguuaucaauauugcauugucauuacuuuaaauauaauugauuuuuuaaaaauaagauuaaaaaguuacuuagcaugaaauacuuugcuuacuuagaacuugaaccacuacauuuggaauugggaaaaaagaaugaagguuuuaccuuauuacacaagccacuucuucauaaaucauaaaauuaaccccuuucccauuuagaaaaaaaaaagugcagcuugcugccagcgcucauuuaauuuuacauaagcaugcuguuugagguugaggcaaaucugacagauuuucagugugaaaauaaaauauaaaaacuguuccuggaguuauuucuaagcagaauucaacuuaacagaaauauguaugauguuacauuaggauuagagacaauauucucagggcauuuggggaaauggguuaagcuauugugaaauuucuucaagggauuaagcuaggauaucauuucaguuacuuguagaauuacuuuuuucauaccaguuaugaaaugcugcaagauaauguugaaggauaucgucgagaaauaacaucacuucaugagagaaaucagaaacucacugccacaacucaaaagcaagaacagauuaucaauacgaugacucaagauuugagaggagcaaaugagaagcuagcugucgcagaagugaguccaauaucccuuguccaacuugcauuauaaguugcauuugacauuucuuuaguuuuuacuuugaauuuuacucacugauaggacuuagguauuuaagaaguuuggagguuacaccaaguaauuaauacauaguuugcaaauagccagugugcguuaguggggugauuguuucuauuaagauagaagagggaaaggaauuuguuuuucugcugggcuaagauauacucgcaagucuugcauuucaaaauaaauuuguaggucaguguuugguucuaacaaagacguuuuuuuuuuugguuuuuuuuuucuugagacagagucucacucugucgcccaggcuggagugcaguggcacgaucuuggcucacugcaagcuccgccucccggguuuacgccauucuccugccucaaccuccugaguagcugggacuacaggugcccgccaccacaccuggcuaauguuuuguauuuuuaguagagaugggguuucacuguguuagccaggauggucucgaucuacugaccucgugauuugcccgccuuagccucccaaagugcugggauuacaggcaugagccacagugccuggccagacgaauauguuauucauucuugcucaucuguaauaaaaagcaauauaaaaauuacauugcauugaauuuauauuucugaauuuuaacuugaauauaaauguccauuugaaauuauuacuuuuaacuaaauacuuaguuuugugaugauaaauuuuuuauauaguuuucuuuguuauucaguuaucucuucugucuuugaucauuacuuguaagcuagguauaguugucccccauuuuaccuguguaaaacagacucaagagcuaauguauaauuugccuauuuugggacagucaugagagauggguugguuaggacuugaacccaugucuuauaaugcucuuauaaggcuguauucuuuauuuuuaucuugcuccaacuccauugugaggagugggcagcagcacuuuuucaaacugguagagugaauuuuaucauugaucauuuauaugaaucuguguguaaauaugaguacuuguguguaaauaugaguacuuugagcuuucaaaacacucucccugguccccuugagacucagacucuugggguugaggggagggagaaacuuuaaauagaucaaucaucacuuuuaaacagguacuuugaaaccggcuuggauucuaaaaguuacauaauuuaauaguagucagguaugaaugauuacagcagucaugcaauucugcuuucuucuucucacauauuaaauuuuucuugcuguuauuuuuuaaacuguggauuguuagagcaaggaaccauaaguauuuguaauugaaagauuuuuucauugaugauccccaauaauuuuugcuucguauuuuagcacaugaaacuguuuuguauuuccuuauacaaugaggagauauagucccuaagagcauuaaaaaaaaguagugauguaugaaucauuuuaauuuuauaaucuuaauacacuugacaccauguuuuucagcauuuuuuauuucauuucuacuuauguuuagguaagagcagaaaauuugaagaaggaaaaggaaaugcuuaaauugucugaaguucgucuuucucagcaaagagagucuuuguuagcugaacaaagggggcaaaacuuacugcuaacuaaucugcaaacaauucagguaaccaaauaaaaagccuauguagaaaaaauguauaaaaguuaaauuuagauuuuuuuuauccucucaauuuccuuaauuagaaaauuuauccaucacuuuugucauccauuaugaucauugaauuuugcaguuuauuaagacauuuaaauauuuuaaauaaaauauugaaagagaauugauugaaaccauacauugguaaguccucagguauauuuacaguguccugugcaguuuuacuauuuauaagauuaauucuuugguuuuuauuuucuuuaaaacuuugggaaaucugaaugacgauuauaauacauuccaucucuuuccuguauaauagauguuuuaauauaaaaaauaccagaauacuuucuugauaaauacuguagauuuuagcugcuucauguagaaauggguuguaauauuguaauucuuucuugccuucaauuuuuauuuuuuuguauugccuuuuucuuaagcauaaccaaaaaucuuuucuuugcuuuagggaauacuggagcgaucugaaacagaaaccaaacaaaggcuuaguagccagauagaaaaacuggaacaugagaucucucaucuaaagaagaaguuggaaaaugagguggaacaaaggcauacacuuacuagaaaucuagaugugaguccaucagaguucugaauuucuguaggguguuuauguucaguaauuaaucugguguguggacagucugccauccaagaugaagcaugauuuugaaaaacuuuguuacuaaguuuuucuugccucacucuauacccaguaauuuuuuuauugggugccauauauugugaguuuuaccauguugggugcugaguauuuuuguauuccuuuaaaucuucuugagcuuuauucugagaugcaguaaaguuaauuuaaaaugauuugauucuuuugacuuuugccuuuuaugauguauuaggugggcccagagcagugugcauucuggaacugaggccaauacuuucaugaguauuagugccaguguccauugcaauugugggguuuuuuuagucuggcugcagaacaggcauuauucuugacuuucuuugaguaacagguauucuucacucuuaauuccuuuggacaauucuuccccugucugggguaagcuccuuauauauuugcagcgaucgcuacucugaugaauauuuaaggaggacccucuguagagcuccaggguacucugugugugcaacucuccugucuuauauucugucuuacaaauuugagcuacuuuggucucccuggacucucagaucuguguucucaauucagagagucuccugggcucugccucauuuccucuuuccugugucauagccuggaaacuuuuaaaucaguaaacuaaggcaaucuaagguucaccucuuugguuuucugucucaggaucucgguuguuucauguguuuugucugguuuuuuuuggcuguuucaggugugacgguaaaucuguuuucuguuacucucuuggccgagcuccaaaggucuauaaaaagauaguuugaaccuuuaguuacuuaggaaccuaaagaauguuauaagauuaauguauuuuauagguucaacuuuuagauacaaagagacaacuggauacagagacaaaucuucaucuuaacacaaaagaacuauuaaaaaaugcucaaaaagaaauugccacauugaaacagcaccucaguaauauggaaguccaaguugcuucucagucuucacagagaacugguaaagguaaauaaaauaaguagaccaauauaauuguaaauaaacaaguacuucuugggauuauaauauauccugucaguaaauagccuaauucuuugugaaugcuaguaaaaugaaacaaacacaaaaaaaaacccaacuuuuucuuuauauagugguacucaauuuugggccuaaacuaguaaauuugcugucuuaaaagauucagaauaguucagcuuggcauuugaucaagguauguacccagcuuucuaauucuugaaacuauuuauugauacuuuaaaaauuauucuuucugaagaggguuauuugauuuuuuaacccgggccccuuggaaauaagguugcuuaccaaaucugcaagaauaaguuucucuuaaagaaugaguugauuugugaucuccuuuaaagcaguauucccaauauuugcucguugguagccucagguaaaagauuuguuucauagauuuugcuucccuuuuuaaauacaucuuucaaguucgaagccuuugugucuugauaaucuuucuauaugguuuuauuuauuuauuuauuuuuuuuuuuuuuuuugagagagagucucgcacuguugcccagguuggagugcaguggcgcgaucucggcucacugcaagcuccgccuuccagguucacaccauucuccugccucagccucccgaguagcugggacuacaggcggccgccacaacgcacagcucauuuuuuguauuuuuuuuuuuuaguagagaugggguuucuccauguuagccaggauggucucgaucuccugaccuugugcucugcccgccgcggccucccaaagugcugggauuacaggcguaagccacagcgcccagccaguuuuauuucuuaacacaagggaaauaaauaacuaauaauuguaugcagacuuucugauuuacacaguuuuucaaccuguggugcaaaagcaguacacauucaguagaaacuacuucaguauaguauuuguucaguaaauuacaugcaauacucaacacuucauuauaaaauaggcuuuguguuagaugauuuuucccaacuguaggcuaauguaaguguucugagcacauuuaagguagucuaggcuaagcuauaagcuaagcuaugguguucagugaguuagguauauuaaaugcauuuucaacucaugauaguuucaaauuaugaugaguuuaucgggaugugaccccacugggaguagagaagcaucucucuguaucuguccauauauacagacccauaaauaucugauccauauaaauaauggguguauaauuaucuaguagauaauuauauacuuuccuauugauaucaugugauaaaacauucuuuccaauuuacaguuuucugccuauuuuauguacuuacaauaaaaauugggcuaaauuuuagauuuaagauuuaguguuuuagaguaaauaauguuuaauuauugggagaacacacccccaaucuuucaguguagguucuuucuauuuucuaugagugucggcuggcugagaaauagacaguacaaagagaggaauuuuacagcugggcugccaggggugacaucacauaucuaggaccgugaugcuggccugagucucagaccagcaaguuuuuauuaaggguuuuaaaaggggagguaguguaagaacagagaguaggugcaaagaucacaugcuucaaagagcaaaagcagaaccacugauaaggaucuaacaaagaucacagggcaaagggcaaaagcagaaccacugauaagggucuguguucagcccugcauguauugucuugauaaacaucuuaaacaacagaaaacaggguuccagagcagagaaccggucugaccacaaauuuaccagggcugaguuuucccaacccuaguaagccugaggguucugcaggagaccagggcuuaucucaguccuuaucucaacugcacaagacagacauucccagagcggcuguucauagaccuccccccagggacgcauucuuuucccaggguauuaauauuccuugcuaggaaaagaauuuagcgauaucucuccuacuugcacguccguuuauaggcccucugcaacaagaaaaauauggcuguuuuugcccaaccccacaaacagucagaccuuaugguugucuucccuuguuccauaaaaauugcuauuauucuguucuuuuucaaggugcacugauuucauauuguucaaauacacauguuuuacaaccaauuuguacaguuagcaguuaucacaguggucuugaggugacauacauccucaacuuaggaagauaauaggauuaacagauuaaagacaggcauaagaaauuauaaaaguauuauuugagaacugauaaauguccauauuaagaugaaaucgucacaauuuauguuccucugccacggcuccagcugcucccuccauucggggucccugacuucccguaacauuuaauaaauuaagaauucugucauuucuucauauagcuaacucaguuuaguggaaauauuugauuguucucuuuugaauauccuuuucuuaauuuuuguaacagauuuaaaauauuaauauuugaauuuuuuuguuuuugaggaaguaacauaacaaaguaccugcuuuuauuuugguauucggcauggauugaaauauacuuucuaaauauaucuguauuugaaccuuaaugcuaauuucauaagcucuuuauaacagucaucucuaauacuauugaaaauguuaauuuuaacagagcuguuaugucuuuuaggucagccuagcaacaaagaagauguggaugaucuugugagucagcuaagacagacagaagagcaggugaaugacuuaaaggagagacucaaaacaaguacgagcaauguggaacaauaucaagcaaugguuacuaguuuagaagaaucccugaacaaggaaaaacagguauguauaauucugaauucagaauucaaucucaacacauuuguuaacuuuguuuuuaguaacuagaggacugcuuuuuuaaggcacucguaugaauuagaccagggucauugccuuuaaccuugugaaaguacuugagucucauaagccagauaaaacaaaaacacacaaaauucaugaagcaaggagguuauccuugcuguaggaaugguccagauaaaauguugaggagacugagagguagggauuguuauuugucuacuggguaugcaugccuucacaagagagauggcauuugugcaggcaaagccuugaaugaagguaucuguauaggaaauagaguagaaagguauuuuacgugaugggaacccucagccaugguagaaagucuucagaagaugacaauuuguaaagugaguagugaggggauacaguuauaaauguaguugauaaucaaaugugaaagguuuugaauaucauguuaaauuauauucuguagguuuauuaagagccauugauuuuuuuaacaugucauaaucagauuuuuuuucuuuuuucugguuagaaaauuaaugugguagauuggaagauaccguguucauuuugaaggcuguagcaauagucuagggcuucaauuuuaaaagauccuuuugugguugacaucauuguaaauaaaucaaaaugugugaggaaaauaccuuucgauuguagaauagauggauuuggcaaguggauaugaggauugagggagaaaugagagauuggaaauuucauuucaaaagagaaaaauggccaguagccaagaugaaugguaaaugcuuguagauuuauaugguguuuuugcuuguuguugaaucuucuaaucaccuuugauggauucuuuuuuuaauauacaacaaacauuaauuuuauuacuucucaaauuaguuuugauuuggagaaaauaauuguaugacuuuaaauguguguaauuuuuauauccuacuguuuguaauaugguaaaggugacagaagaagugcguaagaauauugaaguucguuuaaaagagucagcugaauuucagacacaguuggaaaagaaguugauggaaguagagaaggaaaaacaagaacuucaggaugauaaaagaagagccauagagagcauggaacaacagguaaauagguuaaccguauuaauuuuuuuuuuaacuuguaaggauuugaauucuuucaacuaagucauuaguugccauuuaguucaucucaacagaaauuuauugaacacauaggcaaaauuuuaguuuuauguuuuacucuuuucuguaccucuauauacauuucccguugaaauuuuuagacuacuuuacagaaauagguaucacugguucuuuuuaaaagccccuaccugagacuugacuuaugcaaauguuagggaauggauauggaguugcaaaacugauuauaucaggguguaaacauuuuaaauuuagcagcaguuuuuugggcuaauuggaucuuaaaaaaugagacuucaauuuaguaacacuacaauacaguauuuuccaaguaaguuugcaauuaauuuugguuuuaaucuuguucuuucugcuuaguuaucugaauugaagaaaacacuuucuaguguucagaaugaaguacaagaagcucuucagagagcaagcacagcuuuaaguaaugagcagcaagccagacgugacugucaggaacaaguaaguauagccaauuauugagaaaugagcuucgauccuagagaaugauucuugaaguauauuuaugcauuauaagaacugguggaccuuacaaaaauucaagauaauuuccacuuuuguggaacuuagacaagacaaauugaaaaguauagauggaaggcuaaaaauaaauacauagggcaauauucauuaacaaagcaaucuugacaaugggaaaauaaaaacaggacuaggagacuaaaauuuguacuuggcucucauuugcaaaaauuauuuuacuauuguccuucacuagaucugauuauaaaauuacagauacaguugauuagaggcaaccuuugcuaacaaaacaagaaccucuugauaacauuguuaaugcauuaccaaguuugcgcagauaucuauauacuauuuauaaaauguuaaaaaaguaucauuauuuugaguguauguauguaugugcacacaguauugaagcuuuuuauaauuuuuuuaugaacaggaaaugauaaaacaauucaggauucagaguuacuaaaaugguaggaugggauagcaguacauuugagcauauugguaauguucuuauuuuaaguugggugucauguuaauagcuauucauuugcuuacuauucuuuauugccuauauauaugugacguguauauugcuauuuuaaaauguaauacagggaagaaaugcuucaaaguaaauuucauuaaaaucaauggaucuauaauuuaguacuuaauauagcugaguuauguuuagcuucuuauaucaaaaaguuuguccaaauugcuggucuucuaagcuucauuucugacaguuuuauaauauuaaguaacuaaagcauuaacuuuuaauuauuuucuuauuuugcuacauuuagauugucuuuacuuuuauuauuuaaaaaguccaauguguaucuuuggacaagugcuaacuaguuuuauggauuuuuaaucuuugguaucaauuggguaauaauuucuuauaggcuaaaauagcuguggaagcucagaauaaguaugagagagaauugaugcugcaugcugcugauguugaagcucuacaagcugcgaaggagcagguuucaaaaauggcaucaguccgucagcauuuggaagaaacaacacagaaagcagaaucacaguuguuggaguguaaagcaucuugggaggaaagagagagaauguuaaagguauuauuguaaaucugaauagaauguucuguugaauugaaagaguuguuuuuuucuuuauuuuauaauguuuugagauggagccucgcucugucacccaugcuggagugcaauggcgugauauuggggucacugcaaucuccaccugcuggguucaagcaauucuccugccucagccucccaaguagucgggauuacaggcguuagccaccgcgccuggccaaguuguuuuuuuuaaauaugcauuggaaaaucuguuauucugauagacucuuggcuugcaggaugaaguuuccaaauguguaugucgcugugaagaucuggagaaacaaaacagauuacuucaugaucagaucgaaaaauuaagugacaaggucguugccucugugaaggaagguguacaagguccacugaauguaucucucagugaagaaggaaaaucucaagaacaaauuuuggaaauucucagguaaaucauguucuuacugcuucauuucugugguauaacaacuaugaaaugaaacuacaaauauauaaauuagagaaggagauuauacacgauuuugauauaaaguucauucuuuuauuugucaaagaacucauaacuuuuaacauuuacacauauuaaacaagugacuuuaaaguugaaucugauaguaagaacuagagcaguuuucucuugaaaaacuaaaugccuuucagaucauuuuagagauaaacauucuaaagccagugucuauaaaagaaaauagaaauacaucucccauuauuauuuauuauuaaugaaaacguguaauaguuauuaaagucaaugauuuuugucaucuuaccaaauuaccuacguuuuguaauguuggcuuuuuaaaauucacauaaaauuuuaauaucuguauuuuuguagauuuauacgacgagaaaaagaaauugcugaaacuagguuugagguggcucagguugagagucugcguuaucgacaaaggguugaacuuuuagaaagagagcugcaggaacugcaagauagucuaaaugcugaaagggagaaaguccagguagguauacuaagcuuuaagaaagcacuuguuaaaucaaaagagaagcacucauuuauaucucuaccauuuaacguaauguaaaauuuaacuugaaguaagcauucuucuaaacuuguaaauucauuaagcauuuguuaaacacuaauauaguauagugcuuaaaaguaaaggcucuguaaccaaacugccugguuucagauucuagcuucauaccauuagcuguggccuuggguacauuguuuaacuucccugcucuuaguuucuucaucuguaauauuuggauaauaaugagguuuaauugaguuugugcacaugaagcauuuagaagcaugucugguauguagugggugcuuaauaaauuccagcuaucuuaauuuauuauaguuauggauuauacguguggauagucauucuaggauaaagugauuuaaacugcuacagaauaucuuucucacccaaggagcaaaaaguaguaaaaacuaacaaccaaaggaaaagaagcugugguagugaaauggaugauaauaagacaagcuugacuccuuaccccacacuaccacccaaagcuuauuguugaguuacuucauucuuaggagcuacaguaauauacccccaccucuagaaggaaggaaauuaagaucuuaaaacauuuaucuucuuuuaacugaugaguagucaaaaugacuguuaagaagaaaccauuggacagggaaaaguaaauaaugaauuuuaugggauuuauguguucagcaaaagcuaaagguuccagaauuauauccuguuuaauucaaauguaucucaccauggaaauaauagagccuccaguucaauagaguuaauacuuggaggaaaagggacagaaucagagucucuaacaaagacugcauauuguuucagucuuuuccgcuucauuuuuuauuccuuugggcuauagaaaguaaauacuagaaaaugcccgccuacgaaugaguucauagggggaaaccaaccuuaaauacaggaagaagagagucaacaaguaacauagauuauauaaaaaauaauauaaugggccgggcaugguggcucaugccuguaaucccagcacuuugggaggccgaggcggguggaucacgagguuaggagauugagaccauccuggcuaacacggugaaaccccgucucuacuaaaaauacaaaaaaauuagcugggcauggugguggcaggcaccuguagucccagcuacucgggaggcugaggcaggagaacggcguaaauccgggaggcggagcuugcagugagccgagaucacaccacuggacuccagucugggcgacagagcgagacuccgucucaaaaaaaaaaaaaaauuauaauaguaauguaaugucugucuaagcaugaacaguguagcauggcaaccaugaaauaugcuauagcuuuaaaaacagugggggaagaaaguaauaccaagugcagaagauggauaauuauaaccuaugagaaggaaaaaauucuucacagauaauucaguaaaauuucucauggccaaagugaugaaacaauggaucaaaaugagagauuucugaacaagagggaauaaacugaggauuagaauaacauuuuagaacuaauaaauuuagugcagcaaggaaaaaaagauacagaaagguaaauagagauuuggauuaauguuuuuaccuaauguuaauacuuuguuggugggauuuguagcaucuuuucacuuuugucuuuguaauucuuguauuuguuuaaagucugcaguucgcaugccucacagaaaaguaaacgugaacuuucaaaaauuuuaguucuaaaaguugaaacuuaaauccucuuuauuuugucauagggaggauuugagcucauaggaacagguagacuuucaacuauuguuagauguugguauguauauuuauuugaaauguuuagguaacugcaaaaacaauggcucagcaugaagaacugaugaagaaaacugaaacaaugaauguaguuauggagaccaauaaaaugcuaagagaagagaaggagagacuagaacaggaucuacagcaaaugcaagcaaagguuuguugcuuaguuaucaagaguggaagcauguuguuuuuaauaauaaaugaauuuuuacauuuguuguuaaauauuggcaugauuuucaggugaggaaacuggaguuagauauuuuacccuuacaagaagcaaaugcugagcugagugagaaaagcgguauguugcaggcagagaagaagcucuuagaagaggaugucaaacguuggaaagcacguaaccagguaaaugcaguuaaaacucuuccaaaacauggaaacacguguuuuuaauaauaggggaaacuuaggggaauaaaaauauuugaggaacuagugaaaauuacuguguuuauuagugaaagucuauuauguuauuaauacauguaaauacgugacagauguuaaacuuauaacccaauuuauaaaaaauuuugguuauauuauauauauuucuaaaaagcaguuauuuuccauaauuuuaaaguuuuagccuuucauuuuaucucuaaaauauuuuuauacaugaaaauagaaaucugaggccagacacgguggcucaugccuguaaucccagcacuuucggaagccaagaugggaggauugcuugagcccagaaguuugagaccagccugggcaauguagugagacuccaacucuacaaaaaauuaaaaauuagcugggcguggugguacaugccuguagucccaucuacuugggaggcugaggucagaggauuacuugagcccaggaggucgaagcugcagugaguugugaucaugccacugcaugcuagccugggugagagagggagacccugucucaaaaaaaaaaagcaaaauaggaaucuguauaauuuauugaauuuauuaaagcacuuuaaaaagacuuguucacuggaacguuuuuagggagaugaaaccauguaacauacugugguucgaaacuccagcccuuuauucaaacaaaagguuagaaaucugccuugcauguauuauuuauaugacuugggagaguuucuuaaccucuuggagcuuuaguuuucccuuaucaccuuucgugugauaaaaauuuaacaaaugugaagcacauuaccuggcaucuacagaagguuuguguguuuaacuuguaaugcauugucuauauuuuuuuucuuguaaaugucacuucaaugaaauuagguacuuaauauugaaaguuuugauucuucagaucccuuuauuuggcuucauuguaacuaauaugaaauguuuauucacaaauaugaaaaaauaaugaacauuuaaugacauuuuauuuuuuuuuccucuuguauuguggguagacuucuuagccaaacaagccaaagcuuaguuugaucuuaguaucuuguaguuccaugcuugauuacuuuacaugcaggacaccuaauauaaacauaaucagauauucugccauuuuauuauagcacauuuguuucauaaaaccuaaaaaaaucaaguaugcauuuuuguuauucuagcaucuaguaagucaacagaaagauccagauacagaagaauaucggaagcuccuuucugaaaaggaaguucauacuaagcguauucaacaauugacagaagaaauugguagacuuaaagcugaaauugcaagguauauggaaagaagccuuaaaucauauauaauauaaaagaaguuuauuuuacuuauuuacaugacuccccaagugccugccuccugguuuuagaaagaauggaaagugcuagagcaccuauaucugacuuccaucuacuuuguagagucaagcagugauuuaauauuaugccuuuguauauaaaauauauaugagacuauccucauaauuauuucucuauauuuuauuuuuuaaagagcuacucagaagucuaaagcuaaauuuacagcuaucaaaaacuuacaaggagguuuuuuuuuucuuuugguuagcuuauauuugugacucuauaagggaaguggguuuuauuacuuuggcuuuuguguuccuuuuuguggagaacaguguuucccucuguugcccaggcuggucucaaacuccugggcucaagcuguccucccacuucugccucccuaagugcugggauuacaggcaugagccaucaugccuggccaagggaagcuuguaagucuaauuuuuucucacaugaacuaauagcaaaguauugccccuuuaaaauuaagaaauuaaacauuaaaauuaauguuucugguuuaccuuuuguaagcuuuaguguaauuuguccauaucauggucccauuuauauauugcuuuacaacuuacaaauuuuugugauauauauacguacauucucuuuauagcaaucaucuagcauguuaaguaggagaguuauauuuuaaucuuaaaaaugaggagccuaagauucaaaaagauugacuaccuaauucaggccaucugauuucaaguucaguucagaauuaacccauacucuuaauucaggccaucugauuucaaguucaguucaggauauaggacagggguuggcaaacuguagcccauagaccaaauguggcccaugauuugguuuuguacagccuauaagcuaagaaugauuuuuauauuuuuaaagcauuguuuaagaaaaauacagcaaagacuuuguggcuugcaaagcauaacauucuauccggcccuuuuacagaaaaaauuugacaauacucagugcaguaggaagaggguagguuuugcucuuaaagcaagucugaauuaaaaucuggguaccaucacuugauuuuaguuuguaaaauugcgcauguuacuugaccauugguagcucuguuuuucucaucucuaaaaugugcauguaaaccuauguaauaagaucuugccgaagggcuguaaauucguaaggucuuaccuuugaaguauauggguauuuuuuaggauuuucaaaaaaaaaaguuauuaaagcaguauaacauaaaguuacauuggacuucaaacuuugaaaaaugucucauauauuuaaucuuucuucuuuccuccauuuuuuaaagaucaaaugcaucuuugacuaacaaccagaacuuaauucagagucugaaggaagaucuaaauaaaguaagaacugaaaaggaaaccauccagaaggacuuagaugccaaaauaauugauauccaagaaaaagucaaaacuauuacucaaguuaagaaaauuggacguagguacaagacucaauaugaagaacuuaaagcacaacaggauaagguauuuugaagaaacuuaucuuacaaaaaaaaacuaggaugaauguuaugaaaucuuauuucuuuguaauuuugaauauuacuagcuuuuagauaccgaaaucguguaagcauauaugauaucuuuauuuaagauuaguucuuuaauaugucugaaaaugcauuauaaacucacaaauuuugguaaauacuagauaguucagucuucaccuuucaaauacucuccauuuucaaagcuauguucuuauaacucauugcuaauuagaauuguguauauuaaaaaaugaugacuaaucugguuuuguauaguuuuaaauaaauuguuuauguuaaccaccuaucaaaaaaauucagaaaucuuuguuauauuuauauuuugaaucuaaauauuguuuuuaauuccugaagguaaggaauuuguauguugagaauuauguauuuauuucauguuggauuagaaaauaaauauaaagaaaaaaaauucacaauuaauaccccuuuguuuuagccacuauuaguacauuaguaucccuuuucauacauguaagcgacguuuuuccaaagaaauaauauuauaugcuuauauucuuuuguauacuuuuuucacuugauucauuaucaugaaaauacaguuaaguguugaaaauucaacuauaaugcaucauuuugauuagcuguuuaguauucaguuauguggaaaaccauaacuaguuccccauuuuuggagauuacaguuguuucauagaaaauucuguuuugaauaccuucagggauaaaauuucuuugcaaagcugugauuauuuucuuagacaaacuugcagaaauggaauuacugaauauaaauaugugaguguauuauuacuguuuguugucuuagguuauggagacaucggcucaguccucuggagaccaucaggagcagcauguuucaguccaggaaaugcaggaacucaaagaaacgcucaaccaagcugaaacaaaaucaaaaucacuugaaagucaaguagagaaucugcagaagguaugagugugagaacagucuguuccuaauucuuuccuguuauacaccuaaagaaauauguguuaacuacugacacuuugucuuaccaugugggaauggauacauuuuauucuuuuuacuuugaauggcucauguauguaaguaguacccaaucaucuucaagugugcauuuaguuggucugaccaccauuuuuauacuuauacuuccauuuaaucuuuuaaaaagcaaauuaauaaguuauacuuuaaguugcuaccacauacaguuuauauugaaaugauugaauuccauggugaauacuuuguuuuccuuuaaagacauuaucugaaaaagagacagaagcaagaaaucuccaggaacagacugugcaacuucagucugaacuuucacgacuucgucaggaucuucaagauagaaccacacaggaggagcagcuccgacaacagauaacugaaaaggaagaaaaaaccagaaaggcuauuguagcagcaaagucaaaaauugcacacuuagcugguaaauaucuguuuaaaguuugaacuugguagugaaaguugauuauguguugcaggccuaaaacuaaauggaauagaaauaaaagguaucuacuuaugaaggguguuuguguguguaugugugcuuuaaauauuaggaauaauuaguuggacacaaagagcaauccuaauuuucaagugaugaggauauccuugauaugaugaaauuuuucucaauuguuggcuggcaguagauaauggaauacugcuauccuucugcuuucauggauaacaauucuaucuugugacagagauccuuugagcccagaccgugcugucuagaaaccuuauguagacugcauaaagaucuuuaccagcccagggauuuuuuugugccucguuugguggaggaccccucuagcuuuucagggagaguaucaugucaaauuuaugaagaaccuaguucuucaaggcucagggcuuuauucagccuugccuaucagucugcugaguaguuaaauaaaaugucaaaucaguuggauuuuguuacaggcauuuuuuuaaaaugaucucuaagacaguguccuaacaacuuacuugauuuuaaaaguucuugaauuauuuuuaaacagugcuguagauuauaugaaauaaaaauuuugcaauucauaguaaugaauugcaugauacauugaaauauaaacgggcuucuguuaacuaggaucuuuagcuuuuugagauuuuaguuaggaaaaaguaaauuuuuauguuggaguaaguauauuuuauauucuaguaauaaguuaaagcaugaauguacuuagaacuuugcucauugagauguaugauguaucauaacuaauguagauguuauaguaguagaaucugaugugaccaugugccaauuaagugcauaaaugcuguuuuaaauguuugauuauaauauuaauauaaucgccugguuacuucuuuagguguaaaagaucagcuaacuaaagaaaaugaggagcuuaaacaaaggaauggagccuuagaucagcagaaagaugaauuggauguucgcauuacugcgcuaaagucccaauaugaaggucgaauuagucgcuuggaaagagaacucagggagcaucaagagagacaccuugagcagagagaugagccucaagaaccuucuaauaaggugauuagcuaauucugcuuaaguaacaaauuguuuuucuuuguacauuuuacuugaaagugcuuggugauauaggagccuuugucagugaauuuuggcuaaaauucaauauaugcggagagaauuaacaauaaugacaauuuuuuuguggcauuuuuaguggacucuugugggcuaggaacaacaaucaagagcuuucucuuuauaggucccugaacagcagagacagaucacauugaaaacaacuccagcuucuggugaaagaggaaugugaguuuuaguuauuucauagucuguuauuuuucuuuuaaagcucagggaauaucuagugaucuuucuguuuaggaaaaagaaaucuguguauucuauuguaaaaacauacacuaaagaguuguuuucucugcagaacuguaucauguauuugccagcuuguuuucaccauacuuucaguccuaucagaugaagcuuugugacagagaaaacgucucucaucuuuuaguuuacaguugguuucuaaguuaggcugcuacugauuuuccccgugauguuacaugaugacagauagaaaaugcugggcugagacuuggguucagcaauucaacagcuagauacauuuuacauugucaggaugcaccacucuggagcauucccuguguaguuuuuaaugcuuaaauucaaaacagcuuuaauaaggcucugaaauauuuagugaacaaaaaaauggagaccuauacucacuguguuuuuaaaaguauuugcauaauaauuuguuauuaauuauucuuccauuuucuccucuauaagugccagcacaucagacccaccaacagccaauaucaagccaacuccuguugugucuacuccaaguaaagugacagcugcagcuauggcuggaaauaagucaacacccagggcuaguauccgcccaaugguuacaccugcaacuguuacaaaucccacuacuaccccaacagcuacagugaugcccacuacacaaguggaaucacaggaagguuaguaaaauaauacagaucugaugagacugcuuauuuagauuuauuaugagaagaugacaguaauuucaaagacaaaugaagcauccacuacagcugaagucacgucauuguaaaaauggguguuuaauauuugaaggacauacuucuaggaccaaaauuuucacuuguaaugacaaagaauauaugaaauccacuuuggaaaaucauacugaauuacuggcucaauccaacauugcuuucucacugaaacugaccauuucauugcuuucuucaauuuuuucccaugacacucuuguuauucauuacagcaauuacaacuuuguauuuuauucugugguauacaugcuuuuuacuccacuacauugagcuccucaagggcaaaaaucucagcuucuuauuguuuaaucccuuuaccuaacuccacaguagguguucaguaaaacuuugcuaccugcauauuuccuuagauucuuaucuugacaaauguuagaauucaguaaauuauucaaguauuucugugcugugaaaguagagaauguuuuauuucagcuacauccaauaaacuaaauauauuacuaaucaaauuuacuaucuguuauaucaauuaaaaacuaaaugaugcuuaaugaaaaauucuaauuuuacuuugagcuuaauuucauuaauuuuauucaacaguaauuuaaaugaauagaugcaaaaucaguuacagauauuuauuuaauucaggcaacauuuuauugcaugcuaccauaucaauuacauagggaauauaaaaaugcauaauacauuaccuuuaccuacaauguauuugucuaccaagugccaaaucugugugaaaggugacauguaccacagaauaggaaggauaauuucagcuuugauaaaaguagaaggcuuauauucagcauuauaauuauuuuucagcuaugcagucagaagggccuguggaacauguuccaguuuuuggaagcacaaguggauccguucguucuacuaguccuaauguccagccuucuaucucucaaccuauuuuaacuguucagcaacaaacacaggcuacagcuuuugugcaacccacucaacagagucauccucagauugagccugccaaucaagaguuaucuucaaacauaguagagguuguucagaguucaccaguugagcggccuucuacuuccacagcaguauuuggcacagguaaaauuaauuuuaaaaugaagucagaguagaccuaugcauuuauaagaucuugaguguaucuugaguauauauaucuugaguauucuuuguacaaaugaaguuagaauagaccuacgcaauuauaauaucuuggauauaauacguaucacaaguauucuuugugcauacaugcuuucuaccaggaauuagaaugaaugaauauauuacuaacauuuuauuucauguuuacuacugaauaugacuauuuuaaaucaguuguuugucauuaagaugauucucccccuccaguuauuuuuuuuacuggucuuacauauuaaugcaaaacauuguauauaauuuaacggaaguccugaggacuaaaagacaccuaagauaagacuauauacugauuuacauacaguguacauuuuuucuuauucaaggaguccugaguuuuauagaaggucccauguaaacuuuguagauaacaacauaguaauacaaucucagugaaccagauauauuguaaaaauuggcuggcuuuauuaagcaaagcuuggguugguauaaaaacauugacucagagcauaaguugcucuuuguuuacccauagcuuagcagaaacaaauuauguugauggacauugaucuaggaguugauugauuguauuuuaguaaucuguacaauuaaauguuuacuguguucuccuuuaguuaagugaccauauuggguaaacuaucuuuaucuaaauugaguuauuaucaugcucuaauucaagauuuauauaauuucaaaguuucggcuacccccaguucuucuuugccaaagcguacacgugaagaggaagaggauagcaccauagaagcaucagaccaagucucugaugauacaguggaaaugccucuuccaaagaaguugaaaagugucacaccuguaggaacugaggugcguaaaguucuuucuguguauuuuaacuuuuaccaguagaguuaagguacucuuuucagcuacagccuaaagaaaauuaaccuuuuggggccaaaauauauuaucuggaaaacacuuuuauugaacuuucuacaaagauuccacugacaacccagguauuauuaccaacaguguuuuauauucuugcauaucuuuaauugcauuuguuucuauuucaauaaaaaagcucagucauaaaaacauaaguugaauuucaucucgaaguuucuaagucucauggacauaaacuguuaccugcuaucuuuuucuaagauuagccaaaauuauauuccuuuuugugguuaagauuaaauuguaaugaagcagguuucaaaucaaacauuaaggcuacuaaauuaauuguauuagcauguauuaauguucauaaaccuuacuuuguguauacugaggaggaaugugauuauaauuuuuaaauaaaauuuuuuuauuuuucuauaguuucauaaaauauagauuugaaggguuuuuucaaaugagagaacuaacaaaaacagguaacccuucaucuacuacacugauaugguuaauauauuaguguauuaugauacaggaagaaguuauggcagaagaaaguacugauggagagguagagacucagguauacaaccaggauucucaagauuccauuggagaaguaaguaaaaacauaccuaaaguaccacaccguugcuuuucgugaaugaaauuagcuuugacaaauugaaacauuauuuggucuuuuuuuuuuuagcuuguucuuauuauauguaaugaaauacuacuagaauuaaucauugcagagucugcuuucuuuuacuccuaugaguauaguguacugccuucuaaacuuauauuaaagaaauguuuuuguucauauauagcacagauuuccagauuuuuuagaguugugagccaagauuuuucccuauuuuaauuacaugaaauacaagagugcugguugcaucuugaguuaauuuauagugccccauuugcugguucucucuuacuccccuguauuauuucccuuacagaauuaaaguaauccauaaaaggaaaugcauuuauauaccucuucauuuuuugaucucucauugagguuccccuagcaguuuuacuagcggagagaauauagacccugaaguuacaaagcaugaggugucauuccuagcuccaccacuaggaagcuuugugacuguaagcauaucauuaauucccugcauugucucacuugucaaaaaauauaauuuuuaggauuguaaaauaccuaaaguaguaccugccacauauuaggcacucagaauauuauuacuuuccuuucuuccuucugucccacaaaaugagaauucauauugucaucaagaagacccccaggguggcuaaauaguguuuaauagaaaggagagcuuuauuagugauaucauuuugcucaugaggaagaaauagucuccagcguggaccaaagguguucugucuucacacagggcagggacaggugugguuuuaugccucacaggguccuuauuacacaauagagucaugcauauucagcagguuuuggggaaacgcuauacauauuuaugaggggaacugagcauauaaacaguagguaaauauauauaauauacaucccauguucacuuuggggcagcguuuuagcaugaaaaugagcuggaauuuggcucuuuacgugaagagugaacaaaaggugaacuacaggacacaaagacaguuugugcgcagccucuuuaagcagguugaaacuagcuuaaggugucugcaguuccuugccagugcucucuacagucagaguuguaguggucuggauuguaaaucagagauaggagucugauaacuugcccgauaguuccaguuagaggaguuuagcaaaggcuuauauuuuuuuauuguaaccauaugaauuuagaaauuuaccaugccagacaggcccugaacccuugaccuacggguaacuuuuguuuccuuaaccuuaggguuugucuuaguugagaaaauggcaucuauuuuggucucucaaaucacaauguaugauaguaauuaaauaucaauauuuaacacagaacucauuacuauaugccaaauguugaucuaagaaauuuuuauuuauuaacuaauuuaaucuucauuauaccucauaguuacagaaacugauacccagauaaaguaguguaccgaaguucacauagcauuggagcucagauucaaacccaggcuguguaguuuucaacuguccuaagcuugaaacaguacuuuugucuguauaaacuuucuggaucaucuuaugcuauaauuauuuuaucauguaaaauuaaggaauugucucaagcuaaccauaaauagccauaucgcaaguaaauuuuaguuucuuagcugcguuuauuuuguaaguuaauuuuaccagcuuucuuugacugaaaacacuaaacuaaaucuucagaugauuauguaguacagguugaacaucccuaauuugaaaauucaaaacuuuuuaggugccaacauugcaagccacguguguaauguuccacaccugaccucaugugaugggccacagucaaaacaguuagaacuucauuuuauacacaaaacuauuaaaaauauugugucagauuaacuucaggcuguguguauaaacuucaggcuguguguauacaccuuuguauaugaaacauaagugaauuuugcauuuaugcuugcaucuuauagcugucucauuauggauaugcaaauauuccagaauucuaaaaaauccaaaaucugaaacacuucuggacccaagcauuuuaaauaacuuauucagagcguacuauaaaugauaucuuuuucaucuauccuucagagagcauuguuucugaagaacauaacaauuugaaaauaauaagauuuucugccuucuugucagacuugguuaaauuauacugaaaucuucugcaaaagcuuuuucuugaaauuagcaaaauugucugugacuccaaaauaccauuuggauuuuuauuccaccccucuagcauugucuacugaauguguaacaguucauuuuucugauuuucugacagugaagcagacguucuuuucaaguguugcuuuuucugaaauaagcaugucacuuugaggcacuuuuuaaauuauaccaugacuuacucauuuuuuccauuacggcauauguaauuuuuuaugaaugucuuaguuuaaaagauacuguugcuagcuuguauaaaaaauugauuuuagugagugcuuaagccaaaaagacauuuaacuuuugauaguaaauauuauaaaugaaguuaaaauaauaguuuauuucaguaguuaacaaaauagaauuguggaaauagauugagcaaggaauuauuuaguaucugauauauuuauuuugguuugaaggcuuggaauaauuggaauuuugaggagggaagaaguucuuuguaaaaggacaaugauacuaacuuauguauucagugcuuuucuuuguaaaaagacagugguaauagcuuauuuauucacugcauuuccaaauuaguucuaguuugggaaaaccuucuguuuaaacauugcagacccaugaguauuuuuuuuuucuuuucugacuuuggucugcagcuguauugugcacuaaccgcccuggccauugagcaacugaaauauggcuguccaaauugauacaaauauaaaauauacaucagauuuuugaagacuuaguagaaauuuuaaaaugugaaauaucugguuaauaauuuuuacauugauuacauguugaaauaauauuuuggauauauugguuaaguauauuauuaaucaccuguuuuuaaguggcuacuaacaaauuuaaaauuacaugacauauuccugucucacagcacugauacgcgauaucacgcuaguaguuuugaaugcacaaauauuuguuuauauuuuuuucucuuuuucuuauuggaguauuaaccaauaagauuuaugauaauucuucuauaggaagacauuaaggaaacucaaagguucaucuucuuucuucaaaaauacuugaaaugccauuuuuaaaauuaaauguagcuggcugagguagcucacaccuguaaucugaguacucugagaggccaaggugggagaucacuugaagucaggaguucgagaccagccuggccaacauggugaaacccugucucuaauaaaaauacaaaaaauuagccagacuucgugggguggugccuauagucccagcuacucaggaggcugaggcaggagagucgcuugaacccaguggggcggagguuucagugagcugagauagcaccauugcacuccagccagggugacaagagcgagacugucucaaaaaaaaaaaauuaaauuaaaugcugcuaguccauaaguacucauuauucuuuacuuugaccuauaauaauaccucacauauaguuuuagguauguuuauagggcucuuaauucuuuuuuaacuuuuuuauuuuuaaagggaguuacccagggagauuauacaccuauggaagacagugaagaaaccucucagucucuacaaauagaucuugggccacuucaaucagaucagcagacgacaacuucaucccaggauggucaaggcaaaggagaugaugucauuguaauugacagugaugaugaagaagaggaugaugaugaaaaugauggagaacaugagguaaguuugauuugaaaucaucuaguguuuuuaaacuauuggaugaaagugcucaaauccuugggauacuaaugcauuggcuguaaauucugguucccagucagcuuaaauagauuauauuuauuuauauuauauauuauauauuuaauauauuauauauuauauauuuauauauauuauauauaaauauauauauuauauauuuauauauauuauauauauaaauauauauuauauauuuauauauauuauauauauaaauauauaauauauauuuauauauauaauauauauguuauauauuuauauauauuuauauauauaauauauauguuauauauuuauauauauuuauauauauaauauauauguuauauauuuauauauauuuauauauaauauauauguuauauauuuauauauauuuauauauauaauauauauauuauauauuuaauauauuauauauuaaauagauuauauauauuguuuuucuucuaucuuaauuaguucagaaaucaacauuuuauaaugaaaauuaguguagagccagugauggaaugcccauuuuuaaaauuuuguuucauuuuguuuuuuugacaauugaugagucuuuuaggauuuguuaucaauuagaccuaauuuuaagucuuauugauaaaugacuguauggcuuuaaauguaagugcuaugguuuccggagauaaaaagaagaaacaagaauuguuuuuguuuccucuuggagccccauaguucauuuuugucauuuuuuuauauauaaaguguauuuuauauauauaaggucaaauuguuuguuuuauuuugggguuuaauccuauauugacagcuucuuauuuuagauuaauaaacauuuuuuaaauagcuccugauauaguguaauuuuaucauuuucuucaacuccaccuguuuaaauuuagaauuaaacuggaccacuugauauuuugcugacaccugaggucuauauuaucuuugagcaaucucaugcaaacaguuagaauucagaauugaucauuauugcacuaauuccaguaaguaucacaguugugguauuuggugcugcuguacuaaucccauacaacucucaggacaauuccuaucuucugauuaaugagucacuuaaauuucuaagugugguaucuagacaugcagagcaugugggccauauucuaaacuuuuauuuaugccuggggaacuuucuacuaggauuaugaagaggaugaggaagaugaugaugaugaugaagaugacacagggaugggagaugagggugaagauaguaaugaaggaacugguagugccgauggcaaugaugguuaugaagcugaugaugcugagguaacuggcuagaauuuuaaccauucauaguucuuucuaugagcuuucuuucacuugcuguuuuccaaggauauagaaaggcuuaugaaauucacuaaaaccuuugguuguuuuguucauuuguuuuguuuuuuguuguuaugguuacuuauuuguuuuuguugugguuugguuugguuaauuauucuguccgguuuuuuuaacauauuuauuuuauuugagcauuauguuaccacguuuuguuuuuaggguggugaugggacugauccagguacagaaacagaagaaaguauggguggaggugaagguaaucacagagcugcugauucucaaaacaguggugagauuuuuauuagccuuuuuugaauugaauaucucugguauuuucuaaacuagaauugcacuuaauucuaauauauaaauuuauuuauugaauugguaaaaagagauuggccccuguucuagcuuugugacuguugugcucucauaaaaagucuacuauauuuaugauuguuaggugcugucauuauacucuuuucugccucauugggcugcuguaagaugcaaacauuuuguaacccuuacgguauuauaaaugcuauaugcugccauuaagaggaaaaauuaaauuagggacuacuuguaacagcaguucacaaccagaggaggucagucuaaucaagcugcaugcuucaagauuuggggcuauuggagcuuugcaguauggucugcuuuuccaaugaauaaaagauuuuuggaucaauauagcauauauuuuguuaaaucuuggauaaguccuggagguccacugaaaaguugugggcauuaaaagaguauggaagucguagaaaauaauuuuauuuugaaauguguauuaaauaauuagugauuaucugguaauagauaacuaacaacugauacuaagcugaaaucauuaguguugacauaguaaaaccuuagcuguuuagacuaaugggaaaauacuguaucuggguuucuguagaggccuggguauuuaaaagggcaagauauauucucauuuuaacuaaagaacagacaaaacuuuuaaauuuuuuaagagaaaaauacauuaaugaauauuaagccauauaauagguaauacuauucuuacuuuuaaagggagaugagaaauugauauacuuugaacaaaaauuuacauuuauaaacaauuuguagguuaagaaacauuuuuuguguaucacguaguugaaauauagagggaggaauuuuugcuccucuaggucucccucccucccucccuuccuuccuuccuucuuuuuccuauuuauuuuuauuuuuauuuuugcaaccaagcaaaaauaggccuagugcccugaacaaaauuaauggauggauuugaguacauuucaagcaacuacacuuguauugaauuguuuaauucuuguaguaaacuuaauaagguuuagguaucaaugaagaaucugaaucgcagaaguaaagugacuugaggugucgcauagcuuacuaaguagcuaaguagcuuaaguauuagagcaaggaucugaaucuagaccucagacuuuuaaacuaugaaauucugugacauccuguucaacuuuucauaguugaagauggcuucuuuuguugcuacaguguauguagaagaauacccagacauuugagagacauuuguuaaaauucaaaauucaggaaaaccaaaagauuaaaauguaguuguaaggcuucuccucugucuuuauccuuuuugauuguuacacugauucucuaauggucuaaccuuuagguaauuugucuacuuuauuaaaauuaauccagauuuauuaaauguuaauuuuaguuuuauuuuauuuuauuaaauguuuacuuuaauuuuaguguuuuuaauguuuaucauaggucgagcuaagagcuuuauguucauuaucugaaaucuuuagaaaaaccauuuuagaaacaccagacuuggagguuacauuugcucuauuaaccaaccaaaaaauagacucaaagagguuaagggacuugcccaaagccacacagcgaauaaguacacaucccauugucucuggguguaaaacccacauuugcuuccaucacaccucacuacuuuacuucugaaaauauucguacggugaacauuccuguuggcaagauuuauacuucuagggauuguccaaguuuuuuugugguaaauuuagcaguucaaaaguaaauuucucuuuuccuacaggugaaggaaauacaggugcugcagaaucuucuuuuucucaggagguuucuagagaacaacagccaucaucagcaucugaaagacaggccccucgagcaccucagucaccgagacgcccaccacauccacuucccccaagacugaccauucaugccccaccucaggaguugggaccaccaguucagguauuaaaaguacuggucauuaugaaaaaugaacuugaaaaaaaucuuggcuuuucucccuuuccauuauguauuucucucucucucuugguuuuuuuaaauuagcaaucccaugaacuuuuugguauuuuggcauauuuuuauaaaauucuuugaacuaaaacuaaucucugagggauguuuagaaaggcaaguguuacuaaaaguugugcauacauugaaaugguuauagucauagcaaauaaaauuguuauuucucaagugagaaaagaaaaagauuuucuuggguuuuaauuaaaguacauuuucgcagcucaccauuaucugauuugaagguuucuuucucuacagugcacguauuuauaaaagauaaaggaauuucuguuguacuuaacagaagaauauuuuuucucauuucuugguaaucacauauuuuaacuuuuaaguuuaaugaagguauguaugaccccuuauauuuagcauguaguagggucgggcaucucuuaaucagaagcacuuggaaaaagaguaggaaaaguacaaaaguucuauuaauuuagcuuaaguuuuucccuauaaaauaguauguguaaacacugucaaauauagauucuacugaaauaccacuagugaaaauaacuucaugaugggaaaauauaaagucuuaaaggauccuguauggaggcuacaaaaauauauccaaucuguccauuuagaauuaucuuaacuggaaaacaguuuaaaaaacaauacugcuguuugaacuccaaaagaauacuugcuaacacuuccaacuaaggaaauaggaauuaaauuuguuuacauacaagaugguaucauagaucuguuuuaaguauugguuaauaauuggucuguugguuaauagaaugauuuuuauugguuaauauuauagacuauaauuaaaaauuugucauugacaaaagugauuucuuggcagguuuuccugggaaaauguccuaauuaccugucugcuaacuauuuuguuggcagcguaauaagcuguaucuguugauauuugguguuuguuucauugccucauuucuuaaagcaaauguaauuccuuuaucuugacacgcagagaauucagaugacccgaaggcagucuguaggacguggccuucaguugacuccaggaauagguggcaugguaaguacuuacccauuauguaaaaguaauucauuucuugagcagauauuuauauaguccauaugugugguguuuuguuuguuaacucuguuuucuuuguuuuagcaacagcauuuuuuugaugaugaagacagaacaguuccaaguacuccaacucuuguggugccacaucguacugauggauuugcugaagcaauucaguaaguuaaugaaagagaaacauacuuuauaacuaaucaaacuuuuagucuuucucuguuaguuuguuuaucauuugguuaacucauuguuuguugagucccucucuacuauguacuaauaaguacuugggguaggucaguugaggauguauuguuggggaaaauuauacagaggugaaugacauacaguuacuucuaccaagaauuuugaaguuaaagacaauauaagaauguuuaagaacauggccucuagaguuagaaugccuguguuugaaaccuaacucuacuguuuacuagcgguagcaaguuccuuagguucucuguucaugagcaccuucauuuuaaaaaugggaauaacaauagaauaauuucuguugcauaaguuauaagaauuaagugaaucaguuaauuuguguuaacauguuuaagauguuaccugacacaugauaaauugcuuuauaguuguugauuaaguguugguaauuacaaugaucauaauuuauaguauucuugugaaagcuaagcaaaugagcaacuaacuguaauguaaacaauguagaaggauaauagaggaauaagcaguaggcuuuguuacuacaaaugaagaaguaauuuauuucaacaacuaaugagaaagaauaugagaugauuuaacgcggaugauauugaauucagucuugggaaagaauagcuagcauuuauugagcauuuucaugcauuaguuuauuuaaccucauaacuuaugagaguagacauuauuaauguugucaucuuauaguauacugaagcacagacauguuaacaaauuugccagaggucagacagcaaggaaguugcaguuuuuaguuucaaaccaguuagucuggcuguagaggcuaugcuaaguguugugcuauaccacuccucuuaaacgguugaaaggcucuccgugugaaaguauacacauuuauucguggcuaagguauuaguugcuuaacaggauguauuugaagaucagaauuuaaaaauuucuacaaacuuggggaaagguugauuguucuguagauguaacauguggcgguuagaaccaguuuuaaacuugcucaguuagccacaauuuaccuuggcuaacacauucuuacaaaccagccaaucaauuucagcuccuuccuucugaaagucagcacucaggaagagacucacuccaauaaacaugcagaauucugaguaccagcaaucaacagcauuuucacucaaauaaaugucacuaccccugugccucuagaagucaccacuuccugaacuccauguuuccuaaagacauuaauagcucacuagcuaaggaaagauaggcagaguuaaauaaugcuaaguuuuauguccugaauuauaggcagaaagauaaaugauaguguuauuaggauaacaaagaaagcaaguuuuuagcuaucuaauauuagaauuuuccuaaaccuugggagcuagcuagugaacucuuaauaagcuagacaggugacuugauuuuucuaugaccaaaugaaaacuaagauaaaacuuugucucaugacuucauucuaacaacucuuuuuguuauguuuuauguugaguuuguguugcuuucaguuuaucuaugugaggauaucugagacauucaagaaaugugaggcauaguucaggagagcugaaaauuaauuacauauaaaucacagguuauucuuauuacuaaauucauugacagcugauaguauaaaaggauuuuuauaaguaagaaacccuuuaaaauaaauagacuuuauuuucaaucuguuuccuucccaguuuguugauguucauucuuccuucuuccuauauuuuuuucaccauugugguuuaaauagguuaacuuuaaauuucaucuuaaauuaguuuuuguccauuuaguucgccgcagguugcuggugucccuagauuccgguuugggccaccugaagauaugccacaaacaaguucuagucacucugaucuuggccagcuugcuucucaaggagguaaauaguuaaaccuuuagauccccugaauuuguauguauuugguaauaaacuauuaagaugugauuuaaggggggaaaaagagcaaauaugaauauuuuuaaaauugauauuguuugcuaauuuauuuuuuuaaaugcuguaguauacuuauuaagcacugccuuacaucuuaucuuuccaacaaaguucuaauuucuuugagcauaaggauuagcuuuuacauuaguaucucuucuggcuccugguguaaugucauacacguaguuuaaguauucaggaauauguguugaaccaauaaauauagguacuacuagccauuuuaaaguuguuggaaggaaugcagcauguuuucuguuuacagcuugacacuuguaacauuucuaauuaaauguauaaggcuaguuauauuuuuuguauuaacauuacuuaaaaaaacaaaaaauaaaagaucaaaauauguggaauaaaauggccacuacauuaaguaguagaauuagcuaguuuuccacaugugaauuaugcuguuuguggaauugauuaccuuuuaauccucaguuggaauucauauuacccucuuuauuucugggaagcugucuggcacuugguaaaugaauagagaaugcauacuacuauuacaauaagcucaaucuuuagccaucauaaaagucauguaauguaacaucugcuuguuuaggauauuaguucuaacacugaaggccucuucuuauaugaaauuguaaguugacuuuguaaauuuaaaauguuaugugauuuugugacuuuguauguuaauacaguuuccuagacuugggcaucuaggcuuaaauuggaaugccaacauuuuaagcuuaguaaccuugguaauuacuuuguuaauuacuuuguaauuaacauccauaguuggauacucaauaaaauuagcuuguaugaaacucuuaagagcauuuuagcgaauguuuuaaggguacuguagcauuagaaaguuuaaaggaugucuuuaaguuguauuuaaaauuuugaggccaggugcaguggcucacacuuguaaucccagaacuuugggaggccaaggcaggaggaucacuugaggccaggaguucaggugcagccuugacaacauaacaagacugaccccugucucuacaaaaaugaaaaauaauuagcugggucuguguugguagcccuagcuccuugggaagcugaggugggaggaucacuugagcccaggaguuugaggcuacagugagcuaugguggugucacugcacucuuaacuugggugacagaacgagacccugucucuaaaauaaaauaaaaaauaaaaguuugagagauggauuuuugcuugauggaauaauuaaaucguggacuuuaguaaaguuguauaucuccaauaauuaauauuuuucuuucacaucccugacuuguugauaauuuuauguuuuuuucagucauucauuaauauucagaauugucuuuagguuuaggaauguaugaaacaccccuguuccuagcucaugaagaagagucagguggccgaaguguucccacuacuccacuacaaguagcagccccagguagggaucaaaggcagauaguagguucuguuuuauugguaaaaugaaaaccuaugaaguaucuucuggcuaaaaaugugauaaaccacaaaguuuuaaaguucuuuuucuuguguugucuuuuuaaagugacuguauuuacugagagcaccaccucugaugcuucggaacaugccucucaaucuguuccaauggugacuacauccacuggcacuuuaucuacaacaaaugaaacagcaacaggugaugauggagaugaaguauuuguggaggcagaaucugaaggguaaaaguuuauuuuguuguuuuugcuugcuuuagucucaacagacuuguacauuuguuuuccuuuagccaagaaacaaucugcaaaguuguguuuuguuuuuuuuuguuuuuuuuuuugagacagagucucgcucugucgcccaugcuggagugcaguggcgugaucucggcucagugcagccuccgccuccuggguucaagcaauuuucugccucagccucccaaguagcugggauuacaggcacccgccaccaugccuggcuaauuuuuguagucauuuuguacugaaauuuucacaugacuuaaacuggagcagauucauguuauucuuguacugucucccucauuugugucuugaauggaagagagaaagauggauguagccacugagccaggaauuuuacauacccauagccuaucucaucugggcuagagcccgugguuugguuacugguauacuauuuaguagugugacuguugugaacuuuuuauaguacugugcuuuccuaaaauguuguuuugagauuuaucaaaaucuggaccauauauuucuuaugagugucaagaaugugaacauccuugucaaaaggaaacauaagaagaggaaaaucauaaacuaaaauuggaacaugucauagugagaaaaggaaugaggaaaaaacaauuugagcucuuuuccccccugcuccuuugaaaaauauauaugguaaccaaaucagucuauaauuuuuuguuuaagggagcucuggauuacuuaagugauaaaauagauuuaaaagaguggauauaauuuaugauugacuguaggaucaguuuuguauuuucucauuuuucuuuuccuuaguauuaguucagaagcaggccuagaaauugauagccagcaggaagaagagccgguucaagcaucugaugagucagaucuccccuccaccagccaggauccuccuucuagcucaucuguaggugagucccugcccuugacugcaauacaguuuuuauacaucaaacuuguuugugaaaacacugcuuuauuaguaacaaauuaauaauccuuuuuuccuguauuuuaaaaugcuuuauuuaaaagagaaauuuuauuauuaaaaggaacuugguuuauauugaaauaauuauucuaagaauauucuggcaucaauaauaagaaauauggacaugguggauccaucccaaaagaauagcucacucauguuucaucuagacuauugguugucaacauauguuuuguagagcucuugggucuuuuagaggugcuacagggguuguaguggguggguauacugggagggaggcuaaggagugcuagggcacuccaggccucuugccucuguuugaaccacagcagcuccauuuuuauguguucuacauauugggguucuacaugagauuugauguggagaguuaagggguaagagcucaguugcuuaaaaaaauuguuugaaauuuacugauguaaacaguuucagaguuuggcuuuucaaauuuuugaaguuauuuugaaaaaaagauauguauuauuccuguaauagaaguuauuuuuuagaauaacaguuagcauuuacugaacacuuaacuguguaucauguaguauucugagcccuuuacuuauauuuccuuauuugauucucgcaacucagugcgguagauauucauccacauuuuauagauauggaagcugaggcacagaaagggugaauaaccucuucaaagucaaauagcuaauaaguaacggacaagcaacgauuacacugaagaagucuggcuccagagaccccacucuugaacaauacacuauacuagcucaucuaucucaaauuuuuagacagagaauuaccuuuacuauuaaggauauacaguacuuggucauucagucugauuauuuuaauuuuuaauuguuuacagugguaauucucaaacucugccauggaaccuucagauuuuauggcagaccugcucaguuauuuauuacuuuuuuaaaucacagaacuuugcuaucccaaaaucucuuccccugauucucagcugcuuugaugugacacaucagccuauugguuaauaucccuaauaucuaccguuucauaucugguaacuuuaaauuucuauacauuauguaauauggauacucauaacuaaucuugcaaucaggauuuaaaauaauguauguaaauuacagaaccauuucauacgcaguaaggcuuaaaaaauguauaacaaucauauuaaugauuacugaaguuuugugcccccaguuauauuuugacgucccauaaaaauuggcuuuccucaauagaauuagcacuuguuauaucuuaucagagcuuguaugagaaaauaugguuguuuccuuuaaaguauaauaugaaauuacgaugucuuuaaauuuauuugauaauguaaaacuguacuucccccaucugaguauucauuuggucaacaaauauuugacaguguagcaggcaguuucauaggaagcaucacuaagagaaggugacauuuaagagcugaaagaagaaagggaucaaagcugugcaguuacuuaaugaagagcauacuagaucaaagagaauauuaauagaugccaaguccauaaggcagcagugugucugcuuguguucagggucaacaaggaggccacuguggcuggagcacagugagugagaacagagaguagcaggagauauguuaagaggcgggagaggauagaucgaguagaucauuguaauugccuuggcugucauggauaccagaagcuauuggagggcuucacacagaauaaugacaugacaugaucugaucaguuuggcugcugcauacagaagagauuaaaaaugaauaauggacagaaacgagaaacuuuggaggcuacugcaguaagucaggaaaagauaguaauggcuuaggugagaugguagaguuaggauugugagaaguugucagauuugggauauauauuuaaauuugagcauucaugauuugcuaaugauugcauuuggggugucugaaaaagaaucagauauaauuuguguucuguuguaggcuguuugcugagggacuugauauuuuguuuucuguuguauuucucagcaccuggcaguauguuugauacauggguagucaacaaguaaauauuuauuaauauaagugaaugaaugaaaaaaagucaagcacuucugguuuuuuuuugguguuuuuuuuuuguuuguuuguuuguuuuuuuuuugagacagggccuuggucugccugguuuuuuggguguuuuuuaaggcaggaucucaccggucucccuggaguacuguuagcuugaucauggcucacugcagccucaaccucacccgggcucaagugauccucuagccucagccuccugaguaacugggacuguaggcauguuccaccaugcccagcuaauuguuuuauaauuuuguagaaacagggucucgcuguguugcccaggcuggucucgaacuccugagcucaagugauccucccaccuuagccucccaaagugcugcuuuuuuuguuguuuaaccauuuacccuuuuucgguuuguuaaauguuccucauuguuugaaaaaaagaauugaaaucaaaugaacaagucuacaucuuauucauucauucauuuaguaauuaguuuguaucauuauaaaugcuuucucauuuuuucacuugcuuuucuuuuaucuuaauguuuuucuuagauacuaguaguagucaaccaaagccuuucagacgaguaagacuucagacaacauugagacaagguguccguggucgucaguuuaacagacagagaggugaauuucugacauaacuggauuacaugauagaauguggaauaguaauaaauggaacaaguuuucuaauccuuaagccuccaauuuauuuuuuuaauguuccaaaguuuuauuaaauaauuacauguugagcaggugauauuuaccaaucuguaaacuucauguagacagauuuguauaccuuagauauauaauaaauaugugcuuauauuuuauauuuauugauuucuuccuuaaauccaaauuaagauuuggaaaauaugaaguguuauaguguuauauucauuuguuguaucucuaccuauugccauuauauuguuaauuuuuuuauacaacacgauaaagcuuugugauuauguuuuagcuaguaaaaguguaaaauuuuaauauuuccauguuuuccaauauaacuuuuagauuguacuugugucacaaaaagagggauuaaucugcuuguaauaauuuccauugaaguuguagaauacccaacaguuuuauauccacaaugccuagauauuuuuuauaaugaacuaggguaagugaauacacuaguuuugaauucuuaaaagauauauucaauuugauucuuuuuucuuuuacaggugugagccaugcaaugggagggagaggaggaauaaacagaggaaauauuaauuaaauggucuguaaacaauaacaacugugaauaagauuaucaaaucuguuuuaguguaaugauugucaaguuuaaaaacauuuuuauauauaaacugguauacucaugucaauauucuuuauuaauaaaauguuuuucagugucaaaauuuauuauucauuucuucauuaguugacuccuccuuugcucaucagucuaaggacaguuguaccagacuuuggauaaggucugcccagaacgaguaguaauugcucuugcuguucuacuaggcacaucaauguuauaguauugaucuaaauggaagagaaaacauuuuuuuaguuaaaaagaaaacaaugcccaaacuaaaaaauaacuuauguugacuauuaugcucaaagacaauguuuaucauuuuaauagagauguuuuuacuaauuaauuugaacuuuauaacaaaaagaaaaacaauugccuagacuuuucagcuuuuuugauguuucaaaagauugacauuucaccaucuuuuuguaaaaucagguucagcucuccuuuaugaaguaaacauuaaagaguaaccaaguuugaaaaauaauuuacuugggguuauuccuuuuaaaaaauacaugccaaugucauucauauuaugaaauuacaggcagaauaacuuagauuucugggcauuucaaagaaaagcauccugaguaauauaauuuaauuaauaaaauuaguuucucaggaacuucuuucugaucuuacagacucugcagugaugcaaaucauuauaaccuugugccaaacaagguaucuguuaaaugccacaaaugauagaaguaaaauacuauugucaguagcaaguuuacucuaguaacuggauguuuuaucguaaucucaugaagguuagagcagaauugaauugcagugccaucauuuuaauugaaauuaaagcaaaagucuuaacucuuuuccacagcaauuagaauaaguaccguaguguaacuucucacauucagucaucauugcagccagcauuuuuacuuuaucuucauguuuucacaaaugauaucaccuccuugggaaacuguuaguuaauaccuuaccuuuagaaaaggcauaguaaucauagccgucagguuuucugauguugggcagugauauagcugagguaaccacauuuggaaguccucuccacaguauacucacuuuaacuucauuaugaaggacaccuguaaguggcauguuuaauaaaagauaccagauuaaaaggcaauguacuaucuuggaaagagccagacaucugaguuuuaaucucaguuuuagcccucugauguagaacuauugaggguuauagacugguauauaauguucuugguaagaaguacuugauaaauaguauugguuauaacuaacaaaccugaacaaacugcuuuacuuacccaca

SEQ ID NO: 12892 - RNA, 396 nt, Homo sapiens
ggcggaggucgauaagcuggaacugauguuccagaaagcugagucugaucuggauuacauucaauacaggcuggaauaugaaaucaagacuaaucauccugauucagcaagugagaaaaauccaguuacacucuuaaaggaauugucagugauaaagucucaauaucaaacuuuguaugcccgcuuuaaaccaguugcuguugagcagaaagagacuaagagccgcauuugugcugguaugacuaaaacuaugaaugugauacaaaaacuacagaagcaaacagaccuggaucugucaccacugacuaaagaagagaaaacugcggcagagcaauucaaaucucacgugccagauuuaugaagaaauggacuuggaaaggaaauucuaacagagaa

SEQ ID NO: 12893 - RNA, 16206 nt, Homo sapiens
ugagugcugugggagcaucucaccguggcagccagcccaguuuuggcaaucaggggcuuccugaaagaggugacaucaaagcccggaugugucagaggacugagggagaguguuacuaaaggacuuucaggcugagaggauagcacaggacucagcccaaaggagggccaguguggacuguccagggccagccugcaguacagaggcuggagcuuggacuuguagagggagagagaagagcaagggacguggacggggcagugagccaggcuagccacagaggguucccggggcuuugcuggggauucagggagcauaaauaagagcuuuagguggugcuguguccucugcagcccacugcugagguccuccagacagguaagguguggucacaaucagggccgggguuucccugcucacugcggcagugcaggggugcuugcugagaugauucaucccaggguguccucugucccuuacccagccccaacuccucuuccucugccaaaagcuauuugaauucaaggacuuuaaccugggccggaucugguuuggagacaaaggggacagcucugggucagcaugaccuucuuuagagccacuaaggcgaaaaauaccguuugggaccaggcuggccuagacccagggaugagaaugcacccuaaaauaaauauacgggaagcagcagagggcuucccugucuagugugugauccuaacuaaaggcagcucucuuggacagccuuccccuggauuaggucacauacaccugguggccaagccucugcugggucccaaauacacacccgaguccugccaaagaaaggagauuuuuaaaaagcacagacaaauuguaugcaaguggaaaauacccauaggccuagacagcuguggagggaagaccucguggguaccuggaggcugccagagcugggagcucugcagguaugagucagggaaggcucagagacaagcagaaucucucuauggagacaacuugcagugccuuuuagguuuuccaaauaaccucggaguucagagcauuggguuuuuuucuccccuccccacccccagaaaaauaauuagaaaaauguuuaggagaaaggaaaagaauuagaugcaucagaauaccagcuauaagccaacacuguuuccagaaacucaagaaaaagcucaaacagaagacaguuccccugagaggcuggaggcguuggugcugaaggcaauuuuccuagcuaaggggcacugggccuugcugcaccuuggggcugaccuuuuuugcaaaacacccaccccugcccuccuggcauacucaacagcaacgccagcuuucuggacccuuggaaagauguuagcucaaacacccacuuuuuccagaucuuccucuugcucuucacugaggaauuuguaauucugaggcuagcgaugcccacucggauauuccgcaggcccagguguuuagauuagaauuuguccagcgguaauccugaugcuggaaaccaacaaacauuuggccucauauucacccauuuaaaaacuagagccccuggcagguccccuuagggccauguguucauggaauauaagccaaguuugccuuaggcuuguucauggaauauaagccaaguuuaccucuccccauuuucugcccuggcccacuucccacucaccuccaccucauugccaggaagggaucaaaaugccuccaugccaguuguuaauggcuacauauuugcccuucccaaggguauuugcauuuuauuuaggaacauggccuuauauucaaggaaaaucuagcaucaagauuacgaggcaucaccucucaaucaggucugggagguaucuuggggcauugcucuucugaacaccugcagaggcuuccucaggugagugugggagcccggaaggguggccucccuaaccacucugccugcacaugaauucuccaaagcagugggcccccaucuguuucaauuacacaugccugucagcaaaaacuucgugagaugcacucucucuguguguuuauuaauuuauuuaaagcauauaucccuuuacuuuuguacuacuauauuaggcacauuauaaaaaguauacagcauagaaacuuuaaaugaauaagacacaaaauauuauaaacagagguucuggcauuuucucucugaacuccugagggggaccuugggcaccuccugguaugugcacaccccacuuugaacacccuugcuuuagugcaaaucagcacgccuaaauagcaucccaaaccacugugcgacauuuggccugcagaauaagaaaguccuaaggcagaauccccaggaacuucaaaucugggagaugaggaaagaaaacucacucacaaacaacauaaauguaaauaauucaaaacccuaaaggagagcugucccuagacaguaguggcuacaggugcuaagcaaaagucagguacacuggacagagccaugcgauugauuguucaucuucccucucugggucuccagaaaaggacacuggcaauauccccagcucucuccugauuggaauucuuugaacccucgaagugcuccagcaguacuaccccccacguagcagugggcccaugucgcuugaauauuauuuuugauuugaccaccaagauguaaugaugauucuauuccauuuugaaaagggucugagaaaguguacaggucuaauuauauauacauauuuauacauguguauuuuuguuuauuguuacauuuugacauuggacuuucuauuaaauaauuuuuaagaguuggccuggcuuuguucucuuuuaugucuuucuucuuuccuuucucauggaggaggccauuguaaauaucugcaaaagacccuguuaguguccuugucccuccucucuuuuugccuucccuauuucguguacauaagggcuucucuuaccauucguaaauguucuguuuuuacuggauaugugguacagcaggcacccauauggaaggcccccaaccuuguugucaccuccuccaacuuucagggacagcccacacuguccuaucagccucagcaaauucacaaauucagaccugaugaaggugcaagaaugggcaaugcauaaaauaacgccaugagccuucucuccugcucaauccccaccacacacagacgcgcacacacacaccaugugcacacacacaguccugucuaugagaccuuggacaagucauuuaaccuuccggagccuacuaaaaacaaucauuuucucaugaguuugacuugaggagaucccacaggaagugcuuaaugaacaaccuucuguuacacaaugacucuuuuuuguuuauucauucuacucauucagcugacauuuguuaauuguacaguguaugccagggccugggucacccacaaaggggcucagggaugugugaauuuaaggaauuccccacuccaaggucaaaggccagaguggcagcaugaagaaugaggccaguaccauauaguuucucacauaccccacugucaacuauaacuaccuggcauguuuuagaggcugaaaacauauggauucucccacugcacuggccuuccaggauuuaccgaacagaaauacgcacacacauggacaaacggucucagggcacuuugucaaagcaugaagccaaaagcuguuucccucugcucugucuucacugucgcaugagccuguucauuucugacaagcguuggucccaucagcccagccagccuuccgcccuccagccuugcucuugggaacagauugucuucaugauuuccaacugguguggugagaaggagggagggagggaggucaagccaaggacaggggaaggaguugauaacuauuccuaggcuucuuccuccaagccauggagcuggaaguucagauuugcugcugaguuuuaugagcugucaaauaaggcaaaaggaaacuugggacccaaacuuguucuuucaguaacaacaaaccuguuucuuccagcagaggcuuacuugaaaucacaaaggccagccaagcugaaagagcucccuaacuccaccuaccuuccccugucucucucucucacacacacacacacacacacacacacacacacacacacacacacacacacacacacaaagcuggucucccguaccucugacuggaacuuggggagcuuccuuagucucaugccgaagaggagucaagcuuaggagaccucuggucugcuucuuggugcucccugaaugcuuguuagugacgucagcuuccaguuuacugguaacagcuggacugcugccggaggccaguaaccuggaguucucuugcuuggaagcaggugaugggaagugggaugugagugauggagggaaaaggaagcucaacuccaccgagccucaacacuugauggauggggcaaagugaggaaacagaccacagaagcacaggaguaagccacuguuucugccccucaagggucuccaggccaccaucaucccugccacuggcacugcccaaccugccacuuccuucuacaaagcugaaaugcaguaaucugauggaggacacaaaccuuuaacuuccucaguucacaucacguuacuaauccagccuccuacucuccagcagcacucagcuuccaucugcuggccagcucuuuacgugguccucuccugacacuaccacguuccuuugccuaugcuggcucuugcugucccuucgccaagaaaacucucccauuucuccuucccacugggaaccaagccuccucugaguuccaguuaauauugagcacucacaugaagucuccucaccguaugaccuaacauaugcccuucguuccugccaaagaacauucccuuuaggaggggccggguguggguggcaaggugggguaggaaucccugacaaggaugauccagggagaauucuggugaguaagaccuggucuucaagugcaacuuggucuucaagagccaaguugccaugcugaggaagggugaccccagagcagagccuaggccaggugaggagcaggucugagagacgcgaugaucacagagaguggaacaccuguguuuaaggacauggcuacagaacauacauuguaaauaauguuauagcauuauuucuaacaguaaaaaaugggacacaaucuuagcacccuucagaaaaagaaugaauaaauaaauaauaaugaaguugaucuuguaucaauagggauaaaccucagaaauacaacagugaaugaaaaacacacaaaggauacaguaugacaccauuuauauaaaguuugaaagcuugcaaaaccauaucuauuauguguggauacuuacauguauaguaaaaguauaaaaacauacauggaaaacauaaauaccaauuucagaagagcaggaagaaggcaggaaauggcacaggugaggguuaacaauguucuagucuuuuaaaacaucagcugaagaaaauauggagacauagggacaauauucucuauacuccugcgugcuuguacuauuuuaucauuuuuaaaggaacaaagagugcucuaggagcaacuucauguuggugauagacugcagcugguugagcuuugggugcugcagucagccacaggugagaacggugacggugugacagggaaugggcaccacuccucucagagcucugguggcuuuucaaaucugcuucaucuccuauuucuguguccuugucucuaguuuucauauguagaugacaugggaaggagacaaaguuuuaacuuccuccgaucacaucauguuacuaauccaaagucccagacugucucuuccucugaagucccacagcuuuaguaugcugcaugugggauuggaccucaacaauugcuuucggaucagaucucacucaucaucuuugcccuggaugaggcucuauucagucuucuuggguguguuacaauuuggcacaaaacaucuuguccacauauauguuccccccagggcugccugccccccccccacccaccagacccucacacacagcccuuuuggacuugccacagcucuuuccacaaggacucagagucccucaggggagagcaccccccagaguuuugagcaacauugacugacuggcugagaugaccugggacagcaggucccacucugcaaaugcauaagaagaaucacugaggaggcuugaaauacacacauacacgugcacacacacccacacacacacacauggccucugacaucugaccccucaaaaggucucauuuguaacuacuggagugggggauucugacaaguaccaaguuugggagccgggaucuacaguguaguaaacaguggcagguacagaguagagcuggaggagaaugagagcacgcagucuguugcagacagggauuucauaagacucagugaguucuucagugcaguuucagacaugccugccaauaggucucccuccagaaguugguucuccaagaguuguauggcucaaacaaaugguauuaaccauggauagaugcuaaagaugaauagagguugagaaucugcuuccucaccaccagaaagagaaaaaaggaggugucacuuggucagagccaccuuguugauucauugauggucuccuuugggccucugucauggcugcacacuagaaucaccuggggagcuuagacggcccauguccagaccucaggucaguugagucagaaucucugggcauggggcccagcauuggcauuguaaauaucaucucaccucaggcaaccgagccacagggaguguuugagaacaacuuguccacccugcaugccacugaguugggcaccagcaaacaaagcugaacagacuaaagccugccucugaagaacuuggagaugauagggugcagguuugcaaacacguacuccaacgggcugcaagagcccgggaaaggaacucaaaagaauccuucaggagaagguggugagaauaggcagccacgaaugaguagguucugugcagggacuccccagugaugcaugaaggagcgucccucuuguugaaauaggacaagagagugaaccaaccccuacaagaccaagaguucaggcuagggaaaagccucaauucagcugggucccagauaugcuuuugcucaagccauccugaagaaagaauucuugaagcugucuugacaggggaccugcuaaccucugcugagaacucccuuacuguacaggaguuuuaucccccugagcuaaccucaggcaacagcccagaccuguccuacccuuuccugaaccagcugacccccaucccucagaacacgccggccgugggaggcacauucaggcuagaauaggcauccaggcaaugagccccuucccuauaagacaugaccaacaaaccacaaggaaagcaaauccccaggaacacuuuuguaugaaggagggaucccuggcuuaaaggggcugaggacaguagcugcuuauccucucugcaggguccccuccacugaauaaacagaaaagcaggacuuacacaccugaugccuuuggaaggggcauuagggguuguuacuauaaugggggcugcagugguuggauuccugguaaaagaucaucccagugaguuugguaauugccaaccgguauguuacccaagacauaugcauccucucauguggagcggccaggcucauggcuggaauuucaagcacuugcuccaauuguuugcagaguucuggucauugguaugcucggcacuuggccaucaacuugacgcuagguucucauggcuugcuguccuaucagggacugacagcuuggaauacaaccaacagagaaaauccaauaaaaagccauuguagagacugaucugccaccauccugcucccuaguggcccaucuaggggguggggaugcuggguggagugcuggcugauuucccagaggcuuuuuguguccacugaagacuccucuggacauuucuugucaaucacaaacucaaccuggggcccacaggcaagcaagucucccauuaucagacuggaauacaaaugggguuuuagauguaaagaucagguuugauggcaugugaugccaucaaacaugaaggagaaaccccuucccaaagcuccaucacucuacaagugaaaauucaagacucuaacaaggcucugucuugaguucccacccccuauucccaggcuuugcccaaaaaaggaaaaaaggaagcuuuaaaucaggucacccuaaauccucuuuaauccuugagauuauccaucugguauuuguguauuuguguuucugccaauacagugggauuugcgugcccugggcccucucugguuccugcuacaagccacagaaguggcuucaaacaccugucuccccuuucccccuuuagagguaauuggaaaagaaaagcuugaguagccuccaaaguagaaauaaguagaguccucaggguaaguaagaagaccccagggcacagugaggccucuucccacauugaaacauggucagcccugaguuccugcccucaaguuaccggugagauggucuucuuagcagaagccaagucuaccaaacuguggcaaaguccucauccuucaggugaaauguggcaucaaggccauugcuggguccccagucgauccauucucauaacagucucugcuacuuauugagcagugacuaaauguucucugauguaaucaugacaaucccuuauaaaugggugcugaucacucauuuauggcuggggaaauagccucagagagguugaguaucguaccccaaggucacacagcaggaagugauggagccaugauaccaacucagguccccaggcacauaaccauucagugccacucacacaugggucaccaugccaucaucaucacacuuugguuacacccuuugccagcguuaccacugccaccuucuccaccucccauccaguauguccuagccuuccuuuguucaaccaaaacaucuuuccuaaauuugucccuccuggaccaaaucugaccaacaaccucucacuaguggaaaagcacugccgagagugugagcugaagcagccagucccugccccccgccagccuggacccaggcagaccguccucccagcagcuaccauguggagauccuuccuccuucuucuuucucccacacugccuucucaagcuuucugcuauuuucuggagcuuuucuagucgucacccagaugaccuggagauagucccuauuggucaugaguucugcccuuuucucuccaagccacuccagagagaccuguucccgugagucacuguggcauccuggcccaucagcccagggcuucccacagcucucagcagccuucugcuuugugucaaaggaacuucguuugccaaagacuuguucauguguugucacuggauuuauuuacauuugcuacauguccuauuggacugaaggacagugaagguggcaucccacuacccacaaagccaccucucccugccccuccagagugcucuguucauaccgcugaugcugagaugggcagccacugagcacgcaugacaugaguaaccauuccguccucuuggccuggguuuccuuccuggagcaaaggggagguggaagcaggcacugguugggaaggugacugucagauuaacucugauggguaaaaauccucagucucacagcaucugugagcaaggcaacucagccuccugugaacccccuaauuuccaggcuggugggugguuauuuuuccuccaaagcccucagccagcccuuccucucacccaagggcugugguuuggggcauguuuugacuugaaacagucagacccauggcgguauuuggaguuguaagccccuucugugcuaaaaggaaaacaugaauggucuauuuagaaccugcuaacaauucacaguaugaaaaacagccaacaauucugcugccgaaaugccggcuuucugagaguagccccaggggagcuggcuguguggcaauucuggccccuacucuggaagacccugcacuagugguggcaaugauuccagaauaucaugccucuguccuggcuuuuucucagccucuccuuaaccucuucccagaaggcuuuccuccaggggccugcgguguucuugcgcugugagggagaccacuuuucauaaaccguaugaacuuugcucuggacaaaugagagaagggugaguauuugggagggccucagacagauucuccugggccugaguuguuagguuuucccucaccaucacaaacauacacagaguucaccugagggaggaagcuggcuuccucucaggacaaaauggcgucccuggagcuguagauacauuccaggauguugucagcaccagagaaugacagagguuuuauuuauuucauugcauccuaggauuaaaagggaaggugucaaucauagguuuguaaauauucaaccuaauuaaaaauaaccaguuuacugaaauaccaaaagcuuguuuucaaagauuaucuacaauuuggaauggcauucaucuaauuuacaaaaacugaauuuccucauagauaacaaguaaucccaauaaaaauccugauugguuuuguguaggaauuggcaaacugauucuagaauuuauggagaaaugaaaaggaacuagaauggcaagaacaauuuugaaaaagaagaacaaauuuggaagacuggcacuaccugauuugaagacuuacuacaaggcuacaacaaucaagauaauaugauguuacaaucgguauagacaaauuaauggaacagaauaagcauccagaaauaggcccacacauauauggucaacugauuuuagacaaaagugucaaaguaauucagcgagggaaaggauugccuuuuuaaaaaauucugcugguauaauuggacauucauauauauaaagugaaccuugacccuuaccucaaaccacacacaaaaauuaaccugaaauggaucauaguacuaaauguaaagacuaaaaucuaaaauuucuggaagaaaacacagaagacaaagccuuugugacccuggauuaaguagagauguuuagauagcagacaaaaaucaugaaucauagaaguaaaaauuaacaaauuagacuucgccaaaacuuaaaacuucugcucuucaaagacacuguugagaaaaauuuuacagacugugauaagacaugugcaaagcauauaucugacauagguguauauauguuugcacauauuugauaaguaugcccaacaucauuagcccuuagggaaauauaagccaaaccacagugaaauaccacuccacacucacuagaauggcuaacacuaaaaaagacuaaaaguacuaagugcaaggguguggaacuauuggaacguucauguuuugccaaugacaggugcaaaaaugguauacaguuggcaguuugugaaaaaguucagcauuuccuuagucaaccagcaacacaauucuuagauauuuauccaagacaaaggaaaacauauguccacaaaagacuuguauuuuaauauucauaacagcucuguucauaauaaucaaaaaguagaaaccacucaaauguucaucaaccagcaaauuauuuaacaaauugugguauauccauauaauggaauacuacuugauaacaaaaagcgauacaagugauauccaacucacagaugcagcaacauggaugaaucucaaaaguauuuugcucagugaaagaaguuaauuacaaaugacugugucccauauaauuccacuuauaugacauaguggaaaagucaaaacuguagggacagaaaacagaccaauguugcaaaaugggaaggaaauugcaaaagaacaugaaggccccucuugauuguguuguaauuacaugacuauccauauuuguuaaaacuccuugaacaaauugaacacuuuaaaggggcgaauuauaugguauguaauuauaccucaauaaaucuaacuuucaaaaaaaaugaaucuccaaacuagcuuggauaauggaaacucacuaauuuggauccccuuuauucauauuucagugacaauuuauacccacaggggccaaauuuuacauuuccucuaucuaaaaaucguuauuguuaaguuuuucuuuuuuuuucuuuuuggagacagagucucacucuguugcccaggaugguggugugcaguggcgugauuuuggcucacugcaaccuccaucucccagguucaagugauucuugugccucagccuccugaguagcuuggaucacaggaacccaccaccacgccuggcugauuuuguauuuuuaguagagacaggguuucacuauguugaccaggcuggucucgaacuccugaccucaggugaucugcccaccuuggccucccaaagugcugggauuacaggcaugagccaccgugcguggccuacugugaacuuuuauuaucccacuaggggaaggaggagaaagauucaaauuacuauguaccaggccggcaucauaccaggcauuuuguacuauagcacaaucuaguauaguaggauaugguaccguacaguaugguaugguacaguauggugugguaggguauacugauuuuaucuggucuuuguuaugggcaaaauuguguuccccaaaauguauauguugaaguccuaacccacaguaccuuagaauagaacaguauuuggagaucggggccuuuaaagagcugauuaagauaaaaugagauuguuagggugggucuaauccagucugacugguguccuuaaaaggugcacgggggaaggacuaugugaagacacagugagaagauggucaucugcaaccccaggaaagaggccucagaggaaaucaacccugccaacaccuugaucuuggacuucugcccuccaaaagugugaggaaauaaguaucuguuguuuacguuccucggucugcgguauuuuguuauggcagcccuaauccagcccugauacagucucuuacaguccucccaacacacuaaggugagauaggcaggggaaaaaagcccaaagcucugagagugucgguagccugcccaaacugcaguggcugggguggcaaccuggggugagacacgggccugucugacacccagagcucacacuucugccacaugcuguacccccagccccccaccaccuagauugcaauucucaggggcucaacugguucucucaugucucugaacaaccugcacugugcuuacuuaguaaauguugaauugauuugaauaauuaaagauuucaggaugcagggaccuacuuuaaauauccagcuauuuuccaaggcaaauaaauaucacugauuuuuacaaacuaugaaugugaacauaagaacugagagcuuacccacccaccaugcccugaguucugugauugcugggcccagugacaggcguagaguaugccaagggauggcucccggcccugcucucaggcagaucuuacaggaccugugcaaugaaugcuguguuagccccgauguucauucauucugcaaauauuuaucaagcaccuauaauaaagccaaaagccaaauuuuuuuucucucagacaguuuuaucacuagauacuaaauuguucuaaccucuggcccauuaaaacaaaggggcuuggccgggcgcaguggcucaugcccguaaucccagcacuuugggaagccgaggcagguggaucacaagaucaggagaucgagaucauccuggcuaacacggugaaaccccgucucuacuaaaaaauacaaaaaauuagccgggugugguggcggacgccuguagucccagcuacuugggaggcugaggcaggagaauggcgugaacccgggaggcggagcuugcagugagccaagaucgcgccacugcacucuagcccggacaauggagcaagacuccgucucaaaaaaaaaaaaaaaaaaaaaagguggggggggauuuguguuguucauuuauuuuguuuuuuacaucagauuuaauuuuuuuuuuuuuuuuuuuuuuuuuuuuuuuugccauucuaccaaagccaggugaagaaagcaaccuggaguugaaggucuugcaguucagaaguggagaaggaucucuuuauauucugagcauuuccuggagggcagaaacugaccucgugcucaucuuuagauucugagggcucagcaaauagugaauuuuugguaaauguguuuuggacuuagaacuaaauuuuagauaaaucaacugcucagaguaaaaggcagccacuuggggaagugauuaaaugcacguuuaaaacucagccucugggacagcccggagcacugggcugcucugagagguguccucugcucagccaagguaaggacaggguggcccuggcgacaaggggagcaaaacuggaaaugggacuugacggaaaggagaguaggggaccauugacugaaacuagaaaaugaagagguggagaugauuuugugcagaauccaguggaggguuugagaggccagaaggcugugugcauggagauguucagccagcagccuggagcuguggaagggagccaucaggacucuggcuggggaaggagagccugaggacucagccuggcuccuccuucugccucacucccccucuucaccaauuggcagguuugcuaauucuaccuuuuauguauucuuaaaucuuuuccuuccugccuacuacuugcaaccauauguccucauaaucucuuccuuagaugacugccuucucacaggucuccccugccagccucugcuccucuuagauucacccuucacaccaucaccagucacuugccugaaaugaaauucucaggaucuccuuugccuucucaaagccugucccaugcuggaaucccucucauucuucaagacucagcacaggcauccuguccuccagaagguggucccugaaguucccaggcucagccaggagggcccugugcacuuaaaggucauuaaguguccugugugaccacaccaaacugcaauugccuagcgguuauuaugucuuccuccccuguagccaaccccucagagcugcaaccauaccuggacgucucucuccucagcaccuaucccagucccuggagcauacaggcauucaguucuucuugggagggagagagaaaggauggaggacgagauacuaaucuugaaacaugucuguauauggugggguagcagccaaguuucccauauccuacuugaggggggcuuggcuuccugcugagucaggagaacucagggcuaacuccuggcuuugucaccaccuagcugucugaccuugaucaggcugucuaaccucuaugggccucggguuucucaucuaauaaagggguugggccagaugaacuccacaguuccuucagcucugauucuaagggcaccauaggucuccugaccauaggggucuuggcugcgucucugcacccagggaaucaccucccagagccucuagcauuuucccugcccugaaccuaccucccugguccccugacuuccuucucccugagcuggagaagcccauggcagccucauuaaguggcacugacugucacagccuugcccauggagacuaccaaacaguuuucaauggaaauuaaacauacuuggcuucucuucuaaguuuaaccagcuauuuucuggagccaugauuacuuucucauuaagagcagaaguccagauggccaggucuuuggaucuucuuuauugucuucuuuaaaagcucauuaaauuccucuucccacccacugcuagagaggaguccaccaggccucugggaagcccagucccuccucccauaagcagccccuccucccugccaaaacugggcagcaaccucuaugaauaaugaagcccugcugaccucaaaccaggccaccuuuccuuggaccugugccacuuguggagacaggagaugaaggacacagucucucuccucacguuucucaugguuucuuuaaaaaugcaagaaauagcuauugacgaagauugagauaaguugcagaauacacaucccacuccugaaucauucuuuuaucucccaacagaauaacccccacuggauagggaccucgucuugcucacucaccaguggauucccuccucuuguacauaccaggcauucaauauaucuguugaacgaauaaauaaaugucaucuuccuugucauauccccagcuccuagaacagccuuugaaucaacaaauucuugcua

SEQ ID NO: 12894 - RNA, 22598 nt, Homo sapiens
cccaguuucugagcccucucgcacugcagcugcgagccucggggaagcggaacccacaggcgcgcgcgccgcugcuucuggccgggcgcgggucguggugcaccacgggagcgccgcaccggccggcauggaggagcgcggcgauuccgagccgacccccggcugcagcggccuggguccgggcgguguucgcggcuuuggcgacggcgguggagcuccuucgugggccccugaggacgccuggaugggcacucacccuaaggucaggaggcgcgagaggagcagggcgccguccaggccccuaacccaggcagaacacucccaggcagcucucuuucuuucuuccucagugggagacugaggacgcgcgccacccucaccgagggggaccggugugcacaacugccagccucaggcagcaucgguuuuguuuguuuaaacaaguugcacuaucucaaucccccagccaaagccauuuuggaacugagagccagacaguaacuccgccccucucaagccggagaucccuaauaagcgcuccacuaguuuugcugucuagguaaauccccuuugggggauaaauuuauuuaauccucacgguaaccaugcaagacaauuugugggcgauggauaagaucuagggguccauagugauaaagauuuaagcacagucacguuuacacuuagccuugggcccagaaugcaucuuuauuuugaaaaggugcagauuccuaauauuucagauuucuucgaaaguuugaauagguucuugcucaaagcagagcuacucacauuuugcguguauuuuucuagauuagcagcaggcgagaucaagauaguccucugcuuacuucugcuugagacauuacugccuuguacaaguacgguuccaagcagugaauagacagugaauggagauguggguuuuguaagaaucucaaaaacuagucucuacgguacuuuaacagaauugcacucuucugcuagagagcaauaauucauaaucaucuaaaaacagccaagaaaaaauuugaagguauaaguuugaagaguuaaccuuuuucagcuucucuugcuuaauuuuaucuuccuacucuguccccuucauccucccaaaaggugagaaaaagaaacaauagcauggaaauauuauuuagugcccuuuuagggaaacaauagcauggagaggcagcauauugguuaggcgcaugaacucaaaaucagacucaguuuaaauccugauucugucacuuaucaaccuugugauuugggacaaguugcuugaucuuauuaugccuuaguuuccucaccugaaaaauggggauauuaauaguccauacuuacuuauacgguuguuacaggauuaaauuaaugaauauuuguaagccauucaacauacagaaagcacuauauaaguacuuaauaagcgaaacaccaguaacaacuuuuuaagacuuuaucuagauuuggugguguuauucaguuuauauacuuguagauuguuuucuuuuucaaguuaauggcuguauacaccuugaccaucaaaucuccccuuuugauuucucuucuugaaggaucaaauuaauuuuuaaaagaaaaagaacaaguaauaaaauaauaggggguauuuguuuuuccaauuucaccuuucuguuaauuuaaaaauuauguaguuucauccaguaaaaugguaccagauuuauuauccccaaacacacuuuuauuuuauuauucuccugcuuagaaauccucaguguuuccauacugauaaaaucacauguuuagcuugaccaccaaagccuuguaaccuggcucaaaauuauguuuuggguguuauuuucaaaacauguuugaagucgacaacuaauuaaccccuguccuccugaaccuguacaguuacagugaagcugaugggagaaugugacuuuagaccuguccccaugcaggucugcuaauaauucaacucagcauuagcccugcauauccaccuagucgcuggcauagcugggcagccucagaauucuccugcagguguaggccccugaaaaguauuccccuuaugcugaccaguagucugaaagaagcagcuuucucuaguuccuugucaauuccuuuuaaaaaaucuacucuuaaagugagaaagaguggguagagaggcuaggacugauacucuagcagauucucuccauauacaaauaagaggcuagggaaauacacaguacccacuaacaugucccaucacaaguuuuauuaaaaagguuucucuauugcuggcagauagguuucuuuacaggcccuugaauguauguggcuuaaucccaccuuuguguaauuaccugcaguauuacucuacuucuccacuuacuuaaaucauaauguucuucagugcucaacuuguaucccaucccaccucugcuauaaaucuuucaccagucccucugaguagagcucuucugaccugcugugucauguuuuuuauuccauuuacaugguuuuuaaucacuuacagucauauauuguuauuugccuaacaauuuuaagugugcauguauuuaacaauugcaaguucuuuagagacagagauaagaucuuauauugccuuuuaacuuccacuauaccuagaagaauuuuauagauuauauaugcuugaugaccacuugaugauuggaagaaaauauuaaauaauuuuuucuucucaauuugacaauuauauuuuaauuuucaguaucuagaaaugauggaauuagauauaggagaugccacccaaguuuauguagcguucuugguuuaccuggaccucauggaaaguaaguuguuuguuuauauuguuuuguuauugggacugugguagagauuugggggguuggauugggauauagcauucuuaacauaauaagcaaucuuuuaugcauuugcuguuaauuuugcaauuuauuuauuuacauugggaauuacugaguaacagaagcuacuagaaaagcaaagacaggagguaguguuacgagugauauuugcucagcugaguauuagguagaaguuuggaguuuuuauuuuuuguauuuaauaaacauuauuguccauucaaugaugcucuuucaggcaaaagcuggcaugaaguaaacuguguaggauuaccagaacuccagcucaucugccuuguugguacugagauagaaggggagggguuacagacuguggugccuacccccaucacugcuucccucagccauaacaggugagcaggugauuuuggucuaaguuccuuucccgaguaaagcaguaggaaacauuaaacauagugauguaauacuuuuaaugaaauuugggauacaggguucauagcuuuacucuuggcuauuugaggaauaaguuaaauaugaguguuguauucggccauucuugcauugcuauaaagaaauaccugagacugaguaauuucuuaaaaaaaaaagaagagguuuaaguggcucauaguucugaaggcuuuacaguaagcauggugcuggcaucuacucggcuucuagggaggccucaggaagcuuauaaucauggaggaaguucgugaagcaagagcaggcacaucauauggcaaaagcaggagugagagagaguguugagggggagguuccacacacuuuuaaaugaccagaucucacgagaacucauuguccugaagacagcacucagccaugaaggauuuaccccuauaacccaaacaucucccaccaggccccaccuccaacauuggggauuacaguucaacaugggauuugggcaggaacaaauauacaaaguauaucaagcauucaacaaguauuuauuuagcacuuacucuauggucaguacuuuuucagagacaguauguaugguagaaauauuuauauucuugguaaggaagcaagaccauuacauaugaaauaacagcuguuauaagauguaccauguaauacaaauuauacuuuauauagcaguuggugaaaagcaugauuaacaugcaagcugaaaucaaauuuucauguagcuuuuuuuaaaagcuuuaaaaaagagacuuuuuuuaggaccuuuuuuuaaaaagcuuagguacacagcauuggauuaaacaugucuuuguuucaugacauacucucauuauuaguucaugcuugguuuuuauuuauuuacuuaguuauuuuuaauaauguaauaaguaucucuguacccaucacccaaagcaaaacuagauucuugauaauaacuaacaucuaaucuuauaagucccuuccuuaacgugcuuucacugaccugagguaacucauucugaauuccauguacauugggaauuuuuaaauuuuagauguuuuuaacuuuaauuaaaaaaucuuaucuuuuaaggcugaccuuauacacuuaauauuauauuacuaaaauucauccauucuugugcauuuuuugagcugccacauaacauuccauugugugauuauaccaccauuuuuacauccacucccucgaugauggaguguugcuaauguuuaacuuuaggagauaauuucaaacuauuuucaaagugguugccucaauuuacuuuucaccugcaguguaaauaagauccuuuggagcuguauugucucucacauuuaguauugucagacuuuuaaauuuuugccaauggaauggauuauucuuauuuuggucuuaauuuacauuucccuuauuacucauaauacugaauauuucuuuauauauguauuauuuauaagaaauaucuguucauaucuuuugccuguuggguuguuuuuaguuuucucauugacuuguaugaauucuuuauauauucuugaccuaauaguuuuuuuauuguguuuuccaguuuuuaagucugucuuucacugucuuaagaugucuuucaaugaguaacaguucuuaauuugaauauaaucauauuuauccaucuuuuauaaucaacgucuuugugucuaguuuaagaaauauuuucuaucuaacggucuaaaaaauacuuauauuuucacuaagaguucuauuguucuuguuuuuaauggugugagaggcgguuagggauaccauugucauguggauaaccacuuuuucuaccuccauuuacugaauagucccuccuuuccucacuaucugacauaucacuucugcuacuuuccaaaguuccaaacaugcauuaauuuguuucuggguucucuauuauauuccauuagccaguuuaucuguccuuuugccaauaccauaucucuuaaucgcuugcuugguaagaagucuugguaucugguuagcaagccucccuuaugcauuucuucuuuagaagcuguagcaggcagcuucuaagauggcuucuccuaauucugguauucacucccuuauguaacucucuucccuugagugugaccuggacucagugacuucuuucuaaugaauaaaauuuggcaaaaaugauaggaauguaacuucuaagauuagguuacaaaagacuguggcuucuaucuugggcacucucucuugcuuacuauaaaggaagccagcugccacgugagcuguccuacagaaagucugaaaauagaaaagagaugacaauuauugauggagcaagauucuugagagaugaggaaggauggauucaagaggauaguggaggagaguaauauugagcauguaaaggggugcuguaaaccucugagagugggguaugggaagaaugaacaaaugaaaacacagcucuauuuggguggcauauaaguagggaaaagagcagagccucuuaaauuccagcaugaauaccguugaugaauacuuaacauuuuuucuagcugacuaugacugaauacauagcagucuaguagaaagagccccagacuauaaagucuuaagaccuggguucuagucuugggacugacacuuaacauuuuguuugauguuuagcaacacaccuaauuucucuggguuucaguuuccucgucuuauuuuguuguugagggauuuagauuaccaguacaugcaagaucccuucuaaauuaaagcugcuguaacugguuauuuucauugugcauauuucauaaagccauauuaaacuaaauuugcagauuucuaugaaguauuuuuuguauuuauuauucauaaugagaauuguuuuuuaauaugucagucuauucauaugcuucuuugagaagcuccuuacuguuuucucuguguuugagaauuacaaauaguuguuagcauugacaucagauuuaaucgcuaguacuuuccgguuuuuacuagcaugauuuccaagccauccuauauccaagagucuuaauucauuccucagaacucauuacuucugucuuuuaauuacuguaacaaauauuguccuagcuaguauuaauguuauauuauuuguuuggacaaggagcuacuauuugaaauuaaccugcauuuauuccuaaaaaauaaaauuaaugaaagcaauagccuauuuuaaucaaaaucauuucauaagucuagaaguacaaauuuguuuccauuguuaauuucuaguauuuuccaggugguaauuaaugcuuuucuagcuugaauggcuaaagcuuguuuucuucuucaaguagaauuaguuggaaugauaacuugguaagccauuuugaugcuguugcauuuaauaacugagagagcuuaaaucuuuaugucuuguuuuuauauaaauauucuuaacuauauuauacaguagaauacuaauauagaauguagcacaaaugaggccugauacauacuagauuuauaugccuuuuagugcauaacauuuucucaacucaaacuaugcaaauaacuuuuuaacaaauggaaauguguggguguauauguguguaugugugauuucauuauucagucuuuaacagggcagucuuuuagguaguaggcauacuuuuaucuauuuuuacuuuuaguguauuuuauaauauaaaauguuauauaucuaacaguaaugcugcaauuccagccuuucauaguuaaugugggaauuuuucuguguuaguaacacagagaagaaaaugauugauguugagucucugauaaccuuguauagcaaagaaauucauugggacauguccuaaaaguauuuggugggaagaugugagggcaacucaccaugaaagaaaaaauacuuuuuauuuaagagggaaaacagcuuuuacuuauucagugauaaaacaucuacauaaauuaacgauucuguuuucacuuuuaaauauuauuauuugucagauaauauugcuugggcuuuuuggucuuaacaauuauuuauugagugacucuuaugugucaggcaaugaucuaggugcuggggauaccaugauaacaaauacuuucaugacauccucaugaaaguaguauucuagcacugaauauucgcuuagaaaauacuuuuuuuuuuuuuuuugguaauuguuggauggaauuuuaaaaaacagaauugcccuuuguucagauauuuaauugaaugugugauuugggacugccuucacuuauuuuguagcuagauaauugaauaacaaguauuauggaguacugauaaguaguuuaacagggauauguacaaaauuaugucaaaacccagaggaaggacaggaaaagucucuuuagccaguaagagaccaugguuuaguaggguaacugcaaguaauuaagcaugauugccuaccuagcauggugucuagucagaguaggugucuaguaauauuccuuaaggcagcaaaugaaugaaugaaugaaugaauaaaauuucagagaaaagagggaaaggauggaaaauuagaugggaaaguuuauuuagauuaugaaggccaucauuguuuuuacuuuuuugcuauuacuaaugguauucuaaugaauagccuugugaguaccuccuuguacucauguaugagaguuuuccuaagaauagcugggacauguauaccuuuauaccuucuuuuuuuuugagauggauucuggcucugucacucaggcuggagugcaguggcacaaucucggcacacugcagucuccgccucccggguucaagugauucuccugcuucagcguucuaaguagcugggauuacaggcaugcacuaccaugcccaacuaauuuuuuguguuuuaguagagacagguuuuugccuuauuggcuaggcuggucucgaacuccugaccucaaguuaucugcccgccuuggccucccaaaauucuggcauuacaggugugagccacuaggccuggccuaucccuucaucucuacugguuauugcuaaauuguuuucaaaaggauuauuaccaguuuacacuugcacuugcaauguguaaguuuucacagacugggagaagauuuauaacaugugcauaacugacagguuaauuuagaauuagcuucugugauuucagaaaaaaaaucccaaugggaaacaugggcaaagaauaugaacaggcaacucacagaagaggaacucaaaugcucaaauauguuuguaaaugaaggaauuacaaauauaaaauguguuuguguugucuuaacuuugaagaagacuugcagacaguuuguuuuuauuuuuugacagaaauaagguacuguuuaauggggaacuuuugaacagaacuacagcuagcacuuagagagucucugaacaguuuaggaaaaggagcucccucucgacaugcaaaggaaaaugucucuucacuaagguucaaggcuuggcgaacaaugaaggccagauuuuagauccacuugugccaggcaccguugugcaaagcacaaucugcauaucuguacaugaugcccugccccugaagcaugucuguggagucuuagguuuccacaaagaacacuaugaaaauuacugcuaaauggguggugucauugaagggcuuuaagcaaggaagugagacuauuguuuauucuaugugguuuuaagaauacuuugcauuugcagagaauguuacagaauuucaaaguauuucaaaauauuuuuacaaguagacuuucauuaaaucagcaccaaaaucccuagugguauacgggguguuuguuuuauccuaacuuuacauacaaaaagcugagguuaaaaguauauuuucauuuguacccccacuuuuuccaaaagauaauaaaagauuaagugagcuguaccacggucucaguuagccucacagcuauuagaguuucucuugcuuuauugguuuuuaaaaagauuuuauuguaaaugaaacuagauacggaaaaccacacaauaccaauguauaaauuaaugaguuauaaggcaaacgucuagaacucuuguaauuauaacuaagucaagaaauagaacuuuucuaggcaccccacaaacuuuucaaugugccccaucccaaucauaaucuuucuucccccccaaaauagccauuauucuuucuuuuauaguaauaaugggcuuuggcccauauauuguucccaggaccucuuagugcuaauuugucuuuugacucucacucaagaaagaauguuggaauaucacuggugagacugauaauauuaucaggaauauuaguuuuauauuuaaaaauacccugccaacuuuacuacucuauuguuagaaacaaauuacuugccacauacuauacaaccaaccucagcauaccaguuguaaaucaccauuuuagacugugcgucuuagcugcuugaauauagugcuuuaaaaaaugcuuuguaguccucaaaaaaccuuaaauaacauuuuuauuaguaggagaguuggguagcauacacagcuguagagccagaggaguuggcaguuugcuggagcuacaauuucuuauuauuuacaaagagcauauagcacauaaggccugauaacugucucuuuuauugaaggagacaaauuuuauaaucuguuguuuguaaaacugaaccaaacucugucauuuacauaguuaacuacaacuuaguuauaaaguauuucccuagugaugacaaauagucccacuguuucagucaccacuugacuguuauguggcagaguggcauguauauuuauaugguuuauuauuuauuuuaugguguauauguauuuucugccuccuuaaaaaguaauuguucuaaggaguguuuaauguuauaucugugugcuauucuaagaaugccugaacaguuuuuagugucugcuucccacuuacuuucccaggcuuuagaccuggugguuuuguuuacauacuuucuggcaagagugucgacagauuccauuacagggugaauguguauuugaaugacugugagugaaugcauuacuuugagcacaaguacguuuuguguuuagcauuuucuguaaagcaguuauauaugauaugugaucacaguuaaaacacuuugucauauuuuucaaguuucagaaggucuuguguguaauaguccuuaugaaaauauugauuuaauguuauuuccugaucuguaaugggggaauaaaauugauaaagugcccauuucugauuaucuagugggaaaauuuugcugauggaguaugaaguaauuaauugcuaguguuucuuguuucucucaucuaaaaauacuuccuaaagcuaauguaaaauaauuuuuaguuugcauuauaaugccauauuaaguuguauauuugcaugguauccauauggacaguacucuagauuguuucuuugcuaaauugaaucuaaggaauacaugaagcaacuuugguaaaugacuguagagguacaguuugcucagacaaagcaaugguauaaaaucauauucauagauacacagagaugaaagagaucugauggauuuaaagaugagacaacaagaggaauacuaacuaaaacuagugaccuaucuuuuucagugcuaagauugcaaaugaagucaaauuuauguucagauagccugauuagcuucacuuuggaccaccuuggguccauugguauuuauugaguacccuaaaugguaaaaguauacuauacugaaauuaggauaauaguauuacaauuuucuguaauaguaguaguacuacagguaguugcaaaugggaaaauaucuuaagugacuuauacagggacucaaauuauaagggaacaaaaugguuuucuagucuuuaacuacugguaggguuuuuuuuguuuguuuuuuuuucccccucauagacccaaugucaccucccaauucuaauguaaauuuuguuucuucaguaagauacaagaggugggaaaaccuuaguugacauauuuuaaacucaucugugguuauauguaaauuaaaaaaaagcugagcgaagugaaaugucuuauacaauuauaaaauccaggcacaguuaagauacagcuuucugaaacuauuaaucuccuuuucuuuccccaaaggauuguaguuccuuccuuaguaauacgugaaucauucauccuuucaaaccugacuaaauuguaaaugguucuuucuucucagugucagagaagaauaguggaugggagaauggagccucucccaucaccauuuuguuccccuaggaccucaaauaguggcauuucuuuuguuguuauuguuucguggcaguugguaaccuuucuaaauugaauacacucagccaucuuaucugagacaaaaauauuucaaaaguucuucuuggcaucugcauauuacuugggaaguuuagaaaaaagauguaaacauuccauauaccaaauugcuccuuugcaagcuuagcuaccaugaagcuaaaagucuaagagcuuuuaaaaguugguuugaauaaaauuauuuuggcaagaguauuguacaauuaaaggaauuuaugccuuaagagaagugaaaauaauucugugcacauuagaaaugaaugucagagccaaaguuaggauuccuagccuguggugauuugcuuaaucugaugcuuagcuuauuaaugcauaucauauccuauuucccucaauguuguuuucaaaagaauguacucucuuuuccucauacauugaauccgaugaauuuuaguuauuuuuucuuugucagaauuaauuuuucccaauauagcuuuuaaagacugccaauaguaauuuuucuuuuuuaaaggacaugauuaaagaacauuuuauuagcuguuuguauuaucacagcaguaacccagauaauauaaauggacgaauuauuuauuuuuaaauccauugccuuuguguuuucauggggagaagaaaaaaccuaauauuuuaaaaccccgagauguguagggaaaauuaaaaauuuauuuauuguucuuacccaucacuaaaaauguuauaaauguauuugauuuuacuuuuuauuuaaauauaauuaauacaaacauaauuauauacuaccuagaggcaaaauuugguuuuaggauagaauaaaaagguaaauuacaaauuauuccaguauuuucuaaguugcuuauuuauuuauuggcugccugggcucaucgggugcaaaauauuauggacuuugccuacaagaugcuaacagucuggagcugagauggacagucauuuacaucuagugugauaaacguaaugacagauauguacaggguacugaggaagaccacagagggaggagaccuaacuuugacuggugggauaaagagacaagagagucugggaaaacuuacuggaggacaagauguuugaaauaugcaagaacaaggaacaaggaugggaauggaugcccugguuaaaguaauaacaugagcaagguauugagggcugagagggccugaaauuugccaauaguucauuaugacuggguauguaguaauggcagagagaguaccugccugcaguuggugagaaagcccuagauugguguggcauggguggagaaggagugaguaugugugauacaagagauaugggaaugaugggaaaaggaggggaggaaaggagagacagacauagaaaaaauaugaaaaaacaaacaaacaaacaaacagcucuccuccugggaaguaacaguucaggagaagcaaccucuuaaggauuaaggaagucaaagguaagagaaaguuaaaucaagaguuuugccacuacaaaaucuguaggaaauccugaaacaaaggugggaaaauuauuugagucagaauauuaggaauuguaaugcuuguuucuguuuucuguaauggauaccaauuacaaugugcaaaucuguaaggauauagauguuuagcuauuaaugcaagaaccuaauuuggggauuugaggagguuaaguaacuaggguuuagucaucugagcuuuucucuucauuauacucacucccuaagcggccuuaucugguucuaagguuuuaaauaucaucgauauacugaugacucccaaauuuuuaucuccaucccaaccucuuccaugaaccucagacucauauauguaagugccuacuugacaucuccgcugugaucuaaaaaaggcaucucaaauuagcauguccaaaaagaaaucuugauuugcuccuauacuuucuccuucugucguuuucuuuuugucaauaaauggcaacucuauucauucugaagcucagaccaaaaaccuuagagucauuuuaaaauguauacacacacacacacacacacacuuuauuuuuuagaccaauuuuagauuuacagaaaaaauugagcagauaguacagagauuucccaucuaagucccaguccagcauaguguuuccccuauuauuaacaucuuuguguuaguaugguacauuuguuacaauuaaccaauauucauacauuauuaguauuauuaacugaaauuugucauuuacacuaggguuuauucuuuuugcacaauucuguggauuuugacaaaugcauaaugucauguauucaucaucacauacagaauaguuucagugccauaaacauacccuaugcuucauuuauucaucccuuucuucacccccaaacacaucccuggcugcuacugaacuuuuuacuuucuguguuguuuugccuuuuccagaauggcauauagcuggaauuauacaguauguagccuuucagauuggcuuucacucagcaauauguaucccugcuagcauggcauuuuggguuuuagcuacccuagugggcacacaauggcaucucauuguucuuuuaacuucuugcaauuuccugaugacauaugauguugagcaucuuuucauaugcuuauuugccaccuguauaucuccuuuggugaggugucuguucagauuuuuugcccauuuuuaaauuggguuuucuuuuugauaaguuucaagacuucuguguauauuuugaaugcaaguccuuuaucagauauguguuuuacaaauauuuucucccaguccauggcuuauauuuucauuaucuuaacauuguauuuugcagaacagaaguuuuaaauuuuaauagaaucugauauaauuuuuuuccuggaucaugcuuuugguauuuuaucuaaaaacucaucaccaaauccaaggcauccuauuuugucuucuagaaguuuuauaguuuugcauuuuacauuaaggucugugauccauuuuuaguuaauuuuuaugaaggauauaaggucaguguuuagauugauuuuuuccaggugaauauccaguuacucuaacaccauuuguugaaaagauguuuauuucuucaucaaauugccuuuuuuuuuuuggucaaagaucaauugacuauuuaugugagucaauucugagcucucuauucuauuccauugaccuauucaucuauuccuuaaccaauaccacaugaucuugauuacuauagcuuuacaauaggucuuuuuuuuuucuuuaugugauuuuuuugagacagggucucacucuguugcccaaguuggaguggaguggcacgaucucggcucacugcaacccgguccgccuccuggguucaagcaauucucaugccucagccucuugaguagcugggacuacaggcgcauaccaccacaccuggcuaauuuuugcauuuuuaauagagacaggguuucaccauguuggcuaggcuggucucaaacuccuaaccucaagugauccgccugccuuagccucuuaaagugcugggguuacaggugugagccacugugcccggcuuguaauaggccuuaaagucagauaaaaucaguccucucacuuuguucuuuaacacuuuguuggauauucugacucuuuugccuuuccauaucaauuuuacaaucagcuugucaauaucuacaaaacaacgugcugggauuuugaaugggauugcacuuguagaucacauugagaagaauugguauccaggaacauggacuaucucuccauuuguuuagaucuccuaugauuucuuucaucagaguuuuacaguuuuccucacauagauccuauaaauauuuuguuagauuuauaccuaaauauuuaucuuuuaugaugcugauguaaaugguguuuuguuuuuaauuucaaauuccaauuguuuauugcugauauauaggaauacaguggacuuuuguauauuauccuuguauccuguaaccuugcuauaaucucuuaguuuuuauucuuccauuuucucauacccccaaauuaauuuaucaguaaacccugucaauuccuuaaaauuacauccagaaucuguccauuucuuaccacuuacacuacaacuguuaccacucuggcuuaagcugcuauuaucucaccuccuggaccuacuaagugguccuccuuuaaaacacuugauauauuaaugcuacucaacauauuucauauuugguuuucuuugauuaucuacugucuguuuuccuccacuagaaaguaaguucccugaaagugagaacuugguuuuguuuauugguauaucccuggggucuaaccugguaccugguacauggugcuaaguaaguauuuguugaaagauuggguaagcuaucuuaggcuacuguguuccugcagcagagacuuccuaauuaauaccuuaaagaacauaagaauauacuauaagcaaccuuuuaagaauuuccaaaaaauuagaaugucugcaaaaucugccaggcacaguggcucacgccuguaaucccagcacuuugggaggcugaggugggcggaucaccugaggucaggaguuugauaccagccuggccaacauggcaaaaccccgucucuacuaaaaauacaaaaaauuagcuggaugugguggugugugccuguagucccagcuacuugggaggccuagugaggcaagagaauugcuugaacccaggagguggagguugcagugagccaaggucacaccacugugcuccagucugggugacagagcgagacucucucucucaaaaaaaaaaaaaaaaaauauauauauauauauauauauauauauauguacauauguauguaucugcaaaauccauccacuugcaggauuuaucaccauuuuccacgcuuugcauuguaaccugccaauguuaugaauagccucuuuacuuuuuaguugaauuuuuuuucauuuauauucucucugcccuuucaccccucuuuuucccuagugccuugggaaaaggacuuauauuaauucuggaguagaggguuacuagaacuaguucuuucuuuggaacaucucugaagauauucuuaguuaugagauuugauccucaaaugcuacauacuuucuugaaggaccguccauuauuauuucccuguaauugaaaaauauuuccacuuucugaaagcauaauccuuauuacaaauucauuuaaugaccacuauuuuauuugaguccuaaagucucauaauugcaaaaugacuucugucauuuggcuucucugcauauuaggauguguguccucaccuucccucugcuagaaaucugcugcuggugaaacccccaauucuggcagcuucuuuuaacugauacagcauuuuuuuuucucuuacccuuaaacaaaagcuugcaguucauuacagaaugacuucccacugggguggauagcuucauuguucaguaaacccccuuggaauuuuagcugccuugauuuuuuacuaggaaggcauuggcaugaauuucaaggagguggucuguuaucccugaaacuuuucuuugggacugagccuguggaugaauaaggcuucuuuggugccucugacaccaacuuaauuuugcauuauguuucagaguugcauuauggcaugucauuccauuauaucauaaugaggcaaaucaaggaauuauucccuuuuacuaauaaggcuauagcauauauuauuuggccacauugaagaggauaggagauacuuucuauggguugaaauuaauacuacuuuuaacccaugauacauucuauuucaauagcauuugaaguuaaaaguaaugcggucuucaacuucuuguccucuguguaaaucuccagagauuacuuaguaucuguuucagaaucauuacagaaaaaucaaugcuaagauuuauggaaagcauuuaaauagcuuggacuaaagguauuagccaaauaguguuaacuguguauuugcuucaggcuuguuuucaaguuagcuauaugaagcucuggaaucacuuuuuuucaguacacagagcuccucuaugaacaguuaugagaaauaaaaaccuguugugagcaucaaauuuuguugcuguuauuaaauagcuauuauuauugauacauauuuuucuuuaggugggauuuuucccuuuagauauaacugaguuuaaaacuugaaacuguuaguauuaauacauagguuauauuuuucauagguugauuucuauccaauaugaacuauaaagaauuuuaucguuuauuguuguagauuugugugaugaaacauacaauauuuccaguaucuucacaauauuuuuccaaagaacugagcuauuaaaauuuauacauauaaggaaacauucugucauuucuaaagugagauuucaaaccauaagcuuguuagaaauuaagugagauuauaguauucuggugauacuuaaauguucuugggaucuuuacaaucauaugugguuuuuuaagaacuuaagaaucuuuuguuacugcuauuauuaauagauugggaaaauauaaucuguugacuaaaaggcaaaauaaacauuuuuaagauuuuaugcaguauccuauaauggaaacaaacaagaaaggucuuguucuuguuuguugaggaaaagaugauggcuuugcuuuaaacauacuugaaaaaucgacuagaagagauccugaacaagaaacuguaagacuucuggaauguaccuugaguaacagaggcagauaaacuauuuuauucuguuacuagugagaagauucacugguaauucacaaucaccgcccccuccaaccaaauaccauaaacaaggccucagaaaugggaacuuccauuucauuuuugacagugauuucucucaacucugaaaacaaaaccccuuuuacaacucugaguuaguuuucaaauguuaggguuuccugcauggguauuugggguaaguaugaaaauguuuugcugcuuaaaucaaagaacucuggaaacagauauaaauugagaauggaaaaagaguagugaauaagauggaaauuucuauucuaaauuucacuauaugggcuacaauucccauauaguuuuccuuagugaacaccaccccccaacacacacauacaaacacaccuucugauuuaaauaacauuauaucuucagaaauggaaaauguguuaaaguuguguuaacaggcuuccuucuugucugugucccauucucaucacagucuaccaguuagggauguuuagagaaauuuaucuuguggcauugaaguggcuuuaugugcauuauauauuggguuuuauguauauugcauacugugaaguaaucaugauacaugcugacaacaaaagauguagauaaguuaaaauuuuaguugauccauugucuguuucuucuuugccaucuuuguagaaaaaaauuaauucaagauggacagccuauaaaaauguaucuuuuucuauuauuauuaauuuagauauuggcgugccacuuuugaagaaggaaaauacuuagcuacauuaaaagauuugcauugaagaagcaauugugauaugcugccuuuuaucacagugugacuucccaucagugcugaguaaugaaguuucugauuaauaucuaucguugcuuuaucagaauaucuuucucuaaaguaaaucauucuugugaauaagaaucuagcuaguuguaaugcaguucagcauagguggaaauaauuuuuuaaggacuaagucaauuucugggauucagacuguuucagaaaagaaacauuuucuguauuuccacuaauggcacaguguaccuuaguauguuuggguuaguauucaguuuuagcaauaaucauggaggcagggguaucuauaaauauuauaucccaauuugcaagguagcaaaguuguauauauacuacauaauaugaccacuugacaguuuaugaagucuuuucauauaugccauuuaauugauucauauaauaaucuuauguguaaacauaaagguguacuacuaucuucauuucaaguauccuugaaaagacuuucuccauugaauugccuuuguaccuuugucaaaaaucaacugaccagccuuauagcacguuaagaaguaacuuauaugauguuauuaacacaaaggaugggggaaggaaugaagcuauauuggaguaaacaaugacaccagacaguuaugugaagaaaugaagaauaccaggaauauuaaauaugugaauguaaaagacccuaauauauuuuccuuucuccucuuaacuuuauaaaaagaaaauuauuuaaaguaauaauuacaacacuauauuacuggguuuaaauauauaaacauauaugacaauaauagcauaaagguggaggaaaggaauaaagcucuauuggagcaauuucuauauuuuuuagaaucaaguuaguauuaagcugagagaaauugugauaaacuaagacgcaauaguaaucucuagagucaucacuacgaaacucaagaaacuauaguaaaaaaaaauacauuaauuaaaaugguguacuagaaaauaccuauuuaauagaaaagaaggugauaaaggagggugagaggaaguaaaaagacaugugauauauagaaaacaaauagcuaaauggcaggcaugaauccaaccauaccaauguuaauuuuaaauuugaauaaacacucaaaagggcagagauugucagauuggauauaaaaacaagauccaacuauaugcuaucuacaaaagauacacuucagauucagagacaacaauuuuggaaaacugucaacuauuucuauaccauucucuuuccuuuccuucugugauuccaauuauguguaauguugaacuuauuugauacuauaccagaagacucugauguuauuuuuuaaaauuauuuuuucucuuuuuacuucaguuugguuucuugugaccuguuuucaaguuuucuagugcuuucuucugucacaucucaucuaauugagugaccgcaacuccuaaguauauugugacuuuauuuucaggauaagggagaucuugaaggcaucucgaaaguugcaaggugauccagauuugccgaugucuuuuacuuuggccauaguggagucugauucuacaauagucuauuauaaacuuacugauggauuuaugcugccagacccucaggucaguuuugagguaacugacagcaagaaguacaaaaagaggaaaauuaugacgugauuuuaagugugacucaagucagucacagaacugccacuuccuuugccauagggaaaauucaagaaaaaaagucuugauuuucagacgucagaaaauugguuauauuuuguucaaaguagcauguuccuaguuauuuuugcaaaaaaaaaauugauuuccuuacucuuuggagaauuucaugguuuuccaaaguauuuuaugaagucaucaugcauuuaauuauuuagugaguagcugagguggaauguaaaggcuaauaauaguuguaaguaaaaaaacgcuuauuuaagaaauguuaaauugguugacauuuugacaggaacauuuuaauaagauaaaugugcuauaugugauuucuuuacauacuuuguugguauaauuuggauaauuacauuaaauaucuuucuaauuuugcuuuuggauuacauuguuuaucggagaaaaguccauccugaucuuuuuuuuuuccagaauauuucucuuagaagaugacauccauguuuccugaugcuuguuuuauucauacaagauuggauuugagacccaucagacugcuucaucuuuuaucucagaaauaggguugacguacauagugaggguugacuuccccauuccauaagguuuucauucugaagaguaaaacuuccccagguagaagacuuucuccuucuuaaaaaauauagggugauuucuuuaaaacuuuguuaucuagagacaguuuaauuacaguuauauacagguuuaugccuaggauguauucagaugggugggaccugugugcugcuuuugucaucccacacucaaaguugucucuuuguuucuugcugccacugccagcucauuguugagacugccauuucuuucucuuacucagcucuccccagugccuuuuggccacugcagcuaccguagaauggcauuuuauauguaccuugucacccacuucuguuuacuuuuuccucuccaguaaaaaguaaaagauuucuuucaauuggucuucccauugcaguuacuguuauuucucuuuuuugguuaacuuuaaaucaaaacucaaaauauguucauccagagugugucuuaaguaacuuacgugucuuaaguaacagggaccagagacauguuaccuacaagaguucugggcuauccuuuucauucuuaucacauaucauagcuugaauauuacaacagugugggagagaaucaaccguaaaaaugucuucauuaauuagacccaguuauuccacuuuuguuaaugucucucaaauuguacaaaguauaaaaaauuauaugcacaaagauguuccaagugacauuacuuuuaguagcccaaauuauaaaccacuuuaaaguuugggguaaagauuggcaaacuuuuucuauaaagggccagaaaguaacuauuuuagguuuuuaaaccuacugucucugucauaacuugucaacacugcuguaugaagcacaaaagcagccauagacaauacauaaacaauacgggcguggcuuuguuccaguaaaacuuuguuuacaaauguggugccauaguuugucaucccugggucuaggaaauagucaauaaacagauauauacaaaugauacauaauguacuuauuaaaaauuaguaaugaauauuauuaaaaacaugaaaauauuaccuuaaguaaaaauugcaagacggaaaaguguauaaguggguguaaucauggcugaaauaacagaccaagcauaugauaaaaagauaacaaaguaaaucaaauuacuaacugguuauagugggauaggaggcagaaaauggaugacuuugucuuuucucaauguuuuuauuuguauuuuauaauaaaaauguuuuaaaauuaaaaggugucuugaaauc

SEQ ID NO: 12895 - RNA, 9698 nt, Homo sapiens
ggggcagcgugggaggcgccaagggagcgcgaaccugaggaggaagaaacggggcuagcgcgcaggcccagaacgguccgagccgcggcagucggcgacgccucagagcggaagagggaagugaaucaggcgccggguaguggguugcugggcugggcuugcugagguagaggcagcgccaagaagaggccuuugccgcuggucgggauugggaugucgaagaacacagugucgucggcccgcuuccggaagguggacguggaugaauaugacgagaacaaguucguggacgaagaagaugggggcgacggccaggccgggcccgacgagggcgagguggacuccugccugcggcaauauccuugcauucaccgcccuccccaccccagcccagcccagcccgcccuucuccugggacccgggagccugcaggauccgcggggcaccggcgcggagcugcccucucaaccugcggcuuaaccugucucuuugggaucgcccgcucugagagggcaagggggaagcccccguuuccuacccagucggcaggagacgcgagggucccacucuuggaagccugcccucccccgcgcgccuuccacgcccccagauuccucagguugcacccgagugccugccugccucgggaacuggucccgccggccgcgcccucgcggcgcuggggaaggcggccccggcugguggggaaggcuggugccgagcgccuuaguuuuucuuccuagaacucugauuuccuggggucacauuagcuccagaaauuucugauuguggggaaccugcaucuuuccuuagugguuuuguuuuuuguuguguuuuuguuauugguagcguuaagguaguuuauuccuuaccggggggcggggggagaugggacuguucgaaaauugagggucccugugcuuucagcccauuggccuuuuuaaaaaaaaaaaaaaaagaagaagaagaaggggauuuggcaaaauauacauuguacagaauuuguuaacugggggaggggaaugaauacaaaaaauacaaaacuccuagaaggaagcuuggagccuuuuaccugcuaagaaaaggacaauagaaaaaacaacggggaaugcguguggagaauccuuggaaauauuuaaaauaaaccccaaugaauaagauagaagaugagucauucguauaaagcagaaucauuuuuguaauccuaaaauuguuuccauuuuaguuaaaauauggcagucaguucccgguuucuguuuuugcauauuugaauauucauaacuuuggcuucgcauuugcauuacaucuuuuuuagaaaaauguaaauguugcaaaaaaaccgaagcuguaguuuuagaaaaucucagacacugaauuuguaugcauuucuaauucuuggguguauucauaaggaagacucucaacaauguccuguuauaguggggaaauaugagagugaaaauauuuaauggcaacaauauccuuuuuuaaaggcaccuaaauagagcauuagacauuuaucaauauauagauagugcuuugccacaacuuucacaauuaauuagcuguugcucuuuugcauuauuuaaauacuuaagugcuuggaguuauaaaaaaugagcuaaucuacaucaggcaugcuucucuagaaaucccugcagccuugaaaauaacagcuugucaaccagagauuuuguguaagaacuuuuucuuuagaaaauaaauggugaacaugcuuccuaaaaacauuauuugugauggauagaugguguuuuaugaaaccccaguguauuuuagguaauuuguggugacuuuuaaaugguacugcuguauccauaucaguggaucugcuuuuugaucaguucaucuuaaaauauaaagauacugucucuucuuaccguuacauacagccaggaaagacagcccuaguggugggguacuagaguuggaggaacaagugaacucugugguuuuccuuuuaggggaauguuuguacauucugacagucugauuggccuucuguuucucaugcuugcuaacucacuagugcuuucaaagagagccugaauuuaauagguauggucuaacacaguuugaauaaccuuugugaaauaugagagaaaauaucuaaagcaaaaaauuaagcugccaccuaagggacauaugaauuauuacaucuucugugaugccucuuuucaucaauauugagagauugcuaauguguaucauucagauugcuaaucugccagcauguucuaccagcauuucagauaauacagaauaugguucuagcaaaaguuuggucuuuauuuuuucaauuagaaucacaggaaaagacauauuuugguugauaauagguuauuucauuugggggacuaauaauucugauauauauuuuaggauuucuuuaacaccacucuagguaauguuugcauauguaucucacugggaaaugaaagacuaucaagguguucacuugauaguuagaaccaagggugaaacagucuuugcuuuauuaaaaaaaagucuaauguucuauuuugcuuuugauauuuugccuuugauuaacauccuggaaaccaacacauugaauuuccaguauugaacauagugaccaaaguaauuuucuuuuuauauguaaaucaagucauaagaaccagugguuauaaugcuuuccugggggccauccuuugcuguuacacccuuaacuuccaucacaggaaacaugacagcugcccuacaggcagcucugaagaaccccccuaucaacaccaagagucaggcagugaaggugagucgcagacuacaacacagugaucucugcugauaucuuauucuuaguaaaauccucugcaguugcaaaaaaaaaucaauauuuuaacuguuugcuaucuuugacauagaagaguuuauaauguaguuugauagguaaaaauuucacgugaaaaaauagcccuauaauguaguuaugauaaugcugcaugguaagauacaguaaguucaaacgauagugaaaucauuuguguguguuuuuagaggagaccacucaggcugaauuugagcaaagguuugaaaaauaaguuaaaccuuuacaaaaauaaacagauuguaauugcuuuuuaaagauuuuuuaaaaccauacaaauacuaaauacuuauuauagaaagcucagacauaugagaagguuaaaaagauagugguuuguggucccagcacccagagauaacaguuacuacuuuggggccuugcuguauuguuacagaguucccuuuuguuuuuuuaagaaugaaauuuuauaacgugcuuuuucagcuauaugcaauguacaugagcuuuccuucgcaauaaguuuauagcauuuuuaacacuuguauauggauaagcugcaguguauacauaacuaaucuuuuguuauauauuuagacugacuuuuuuuuuccuauuguaaaccacugaaaucaauauuuuuugguaaauuuuuaauuguucucuuugaguaaauugcuagcagugaauuacuggaucaaagaaugcacuuuuuuuuaaggcuuuugguaugcaguauugccaaauugcccuucagaacaguugugcaacuuacauucucugcagucuuuuacuaauucuuaaccuauuuacguauuuauuuaaaaugaugcccauagcaucaaccccguuguccauagcuauucauacauccuaggagcuucaagaaucucaauugaauaguaguaaguaauaacuuagguaaaugcauaauaauuaucuagguaacauaauuuuuuauuggggaaaauuucuuugguuuuuacaaguuguaaagauugucguugaaauuucauuuuuaccguggaugcaaagauauuuuucuaaaucugguaauugcagucuuuaaaccaaagauaacaguaggugguagaaacauucugugaaauccugaccaguaggaaugcuggagguaucacuuuguguugaauggaaggagaaacgaauuguugaaaaggucaguuaaguguuuccuuugcuuggccggauggguaagaaaauaacugcuuuugaagcaggcuuuugccaaagaaaaaagaucauuauuaaugaacaucacuauauuucauaucuacagucaauucauauaaauuacagucaauuuucuuuuaagacagcuugguuuauuaaaauuuuuaaauaaaaaaguuuuuaagaaaaaauuacuucugaaggauaauucaaggugaaacugcaaaucugccuccuuguuuuguugggaauuuuuuuuuuuuuuuuuuuuuuuugagacggagucucacucuaucacccagguuggagugcaguggugcaaucucaacucacugcacccuccgccucccggguuuaagcaauccuccugcuucagccucccgaguagcugggaucacaggcacacaccaccaugccuggauaauuucuguauuuuuaguagagacaggguuuuaccauuuuggccaggcuggucucgaacuccugaccucaggugaucugcccaucucggccucccaaagugcugggauuacagcugugggccaccacacccggccguuuuguugggauuuuuuuuuuuuaagaucaagacauaaauuuaaauguuguuuuaauaaauuguuaaauuaucacauugaucuguuagcaaauccucucagcucugccuucaauuauguuaauagucugucuaguuucuuaccaccuccacugcuacuaugcuuaccacauccagccuguauuauugcaauugccuccuaauugcucucccugcuucuaccuuauccccuacucccacagcuuauuuucuguaacauagaugccaaagcaauccuguuaaaaugugagucagauuauggcacugcucuuaaaaccuuccaaugucuucucauuucucucaguaaaagccaaacuccuuacaaugccuguaggccuuacacgaucuguccucccauaaccucugacuuacucacgugcuuuucucccaccaauccacuccaaccacauuggguuuuuuucuguuccuggaacacacugaacacacacuaauagcacuguucuuuccucugucugaaacacuuuccucaguuaucccaagccuucuuucacguccuucagguccuuacucaaaugucacauucauaguguagacuuucugaaauucuaaacccuccucauacagauaugucuaaauguucuguuauuuauugacccaccaggaccgggcaggcagcauugucuugaaggugcucaucucuuuuaaagcuaaugauauagaaaaggcaguucaaucucuggacaagaaugguguggaucuccuaaugaaguauauuuauaaaggauuugagagcccgucugacaauagcagugcuauguuacugcaauggcaugaaaagguaaguuaugaauuauaaaucuauaugacugguucuuuuacaauagggaaugacaaugacaaccucucucaccuaaauaaccauuuugauuuguuguacauuuuuguuauuacaaauaaaaugcaugaaaaggauaguucauauuuauguuuacuagccuuggucuuaagagauucugauuccaacacuuguguuuauucaacaaugauuauuaguaauuaaacauaaucuugaacucugaauuaaaucaaaacuuuguaaaagaaaauaagcaauacaaaucaagaauucuuucacagugaccaaaaggugaaaacaacacaaggaucauaacagaugaacagcuaaauugugguacauacauacaauggaauaugauucaaccauuaaaaggaaugacauucugacacaugcuauaacauuaauaaaccuugaaaacauaccaagugaaaugagccaaacacaaaagaacuaauauuuuauaauuuuacuuauaugaaauaaucuaggauaggcaaacacaaagggacagaaaguccuuagagguuacuaggaaguagggaaagcaaggaauagggaguuagugcuuaauagguacagaguuccuccuuggagugguaaaaaaguuuuggaaacagauaguggugauggcuacaguacauugugaauauaauuaaugccaauggauuuuacacuuaaagaugguuaaaauggcaaauuuuguguuagauauuuuacaacuuuuuuaaagaauuaggaguuuggaggaucaagaauucuuaaaucauguuuuucuauuuucauguguauauuuugcaauguaaguagaugcugguacaucaucugucaaaagaguauaagugauuuugagcuuuggguaaaaaacuggauaacauguaaauagaaccagucauaaaaauauugaguguuugaaguguaucugagugaaaacacaaacauaagaaaaaagcacauaguaaaacaauaguucccccuuuuacucuaaaaugcaccaauuuggguaguaauuuauauggcacccuauucauggaacacuuucuguugccagguaccauacuauuaauguuuuauuuaaccuuuacaacaacccugugaaguauauaaauaucuuuaucauccucaauuuacagaugaaaagcuagcuuuaaaacccaagcagcguaguucuagcauagccucaagauugcagugaacauugauuacuuauuauauuccacauauucuucaaaggacuuuauaaauauuaacucauuuaauccucauaaaaauggagggaaaugcuugcuauuauuccucuuuugucacugaggaaacugaggcaugugugaagucuucauuucuuccaaaugucagucaccaguuuuuaccaaucuucgaaguauuucugaaaucuaucuguucaagcguaucuaaugcagcuguucacagcaucucucccagucuguugccauagcuuccugacugguuucccaguuaacaguuuugccuccuucaaaucuguucuccacccagccaucaaaaugauaucuuuaaaaucaaaauugcccuugucagucaccugcaggauaaagucaaaguucccaagucuagcuucaucuuccaugucauucuuccccucaggcuauagcaaugccagccuuuuuccugaaugcaccauauuguuucacaccuccauacauuugcucaugauuuucugguguuagccugucaccuacucauucuuuuaaugugucauuuccuccaugaagccuuagcugaaacauuccucuauacuguuaaucuggguauaagccucucccuggugcuuuaauagcaccugcagcacaacucucauuucauacauuagauuaaaauuaccuguuuauaugucugucuccucaugcuagaccagaaaaugcuguauuuguucacuuuuguauccccagcaucuagcacaguacucaguauacaaagguauuccauaaauauuuuuugaacagaaagaaaccagagcucagauuccuaauacuugaucauuacucucuauuuuucaaauuagagucagaguuaaaguuucuaaguucuuagcuauuaaacaauaccuucuuucuuugggagaaaaaaaaucugacaaaggcugacuaaucgaaguggaaguugggaugguugaucccaguuugaauuuucuucugacuauguggugagaaugagaaaugcagaauguccaccuguuuugagcaggaacacuaugcugcagauuuuuuuuuuuuuuuuuuuuuuuuuuuuuugagacggagucuugcucugucgcccaggcuggagugcaguggcgcaaucucggcucacugcaagcuccgccuccuggguucacaccauuguccugccucagccucccgaguagcugggacuacaggcacccgccaccacgcccggcuaauuuuuuguauuuuuaguagagacgggguuucaccauguuagccaggauggucuugaucuccugaccucgugauccgccggccucggccucccaaagugcugggauuacaggcgugagccaccgcgcccggccuaugcugcagauuuuuuaaaacauuauuuagaauuaauguacuaaaauguaaacuaguaucucacuagaauguaacuucaugagggcagggacuuucaagguuuuguuuauuacuguaaccucagugccaagaacaguaccuggugcauaauuggugcucaagaauuuauuauuuguuaacuaauaaauucagggucuauagcagugcccauuccuucuuuaagaaaaauguuuuaccaaauaugagaauugaccuuuuauuauucugucaacauuuacaucuugguuuguuuuuaggcacuugcugcuggaggaguaggguccauuguucgugucuugacugcaagaaaaacuguguagucuggcaggaaguggauuaucugccucgggagugggaauugcugguacaaagaccaaaacaaccaaaugccaccgcugcccuguggguagcaucuguuucucucagcuuugccuucuugcuuuuucauaucuguaaagaaaaaaauuacauaucaguuguccuuuaaugaaaauugggauaauauagaagaaauuguguuaaaauagaaguguuucauccuuucaaaaccauuucagugauguuuauaccaaucuguauauaguauaauuuacauucaaguuuaauugugcaacuuuuaaccccuguuggcugguuuuuuguucuguuuuguuuuguauuauuuuuaacuaauacugagagauuuggucagaauuugaggccaguuuccuagcucauugcuagucaggaaaugauauuuauaaaaaauaugagagacuggcagcuauuaacauugcaaaacuggaccauauuucccuuauuuaauaagcaaaauauguuuuuggaauaaguggugggugaauaccacugcuaaguuauagcuuuguuuuugcuugccuccugauuaucuguacuguggguuuaaguaugcuacuuucucucagcauccaauaaucauggccccucaauuuauuuguggucacccaggguucagagcaagaagucuugcuuuauacaaauguauccauaaaauaucagagcuuguugggcaugaacaucaaacuuuuguuccacuaauauggcucuguuuggaaaaaacugcaaaucagaaagaaugauuugcagaaagaaagaaaaacuaugguguaauuuaaacucugggcagccucugaaugaaaugcuacuuucuuuagaaauauaauagcugccuuagacauuaugagguauacaacuaguauuuaagauaccauuuaauaugccccguaaaugucuucaguguucuucaggguaguugggaucucaaaagauuugguucagauccaaacaaauacacauucuguguuuuagcucaguguuuucuaaaaaaagaaacugccacacagcaaaaaauuguuuacuuuguuggacaaaccaaaucaguucucaaaaaaugaccggugcuuauaaaaaguuauaaauaucgaguagcucuaaaacaaaccaccugaccaagagggaagugagcuugugcuuaguauuuacauuggaugccaguuuuguaaucacugacuuaugugcaaacuggugcagaaauucuauaaacucuuugcuguuuuugauaccugcuuuuuguuucauuuuguuuuguuuuguaaaaaugauaaaacuucagaaaauaaaaugucaguguugaauaauuuauuuuucucugacuuuaac

SEQ ID NO: 12896 - RNA, 81693 nt, Homo sapiens
aggagccggaggagaggaagauggcggcggccgccagcacccgcggugccgcggggccgcuccgaggagccugagagacccacggaggcuucgcgggaagacgcggcggcggcggcggaggaugagccugcagagcgcgcaguaccuccggugagugccgaggccgggcugguacguagggggagcgggccgcagguuggggcauggagcaacagacaccgagguaaguccgggguggcgggggaguugcugcguccucuccucgccgggcaggucggcggagacugcaaggggaucugcgggagggggcggaacggguaugggugccuagccccuaccgcccgggcugagcucuggcgaagccggcucgucccggugcgaggagggagguuggggaagcgugagaaugugcgcgcgcgcccuuggucucggguuugcuagcgagggguggagagaaacguccggggaggcggcggcgaccccgaguggagguggguguggaggagucugauccccguggcaggggacucgugguguggcgugggauugguuggagcgaugcaugaguagaggacggggaggaagucugcacaccugggguguuggggcgggggaaccgcggagggcagacagggggagagggagaccgcaggaaacuggagcuuguucuucauucucggguugggaguauugaggaauaaugucaucuguaguuaguuggcgguguggggaggcgugaaggggaauagauggggaagugaggaaagagggaggcacuguggacaagguuggguuuuucagaagaaacuggguuagaaucaguguagucggaagauaccauucugagagucguguguauucauuaagagugguguaaggaacuuguaugucagagguagagugacacaugggaauagugugugugugugcgagaugugugucugggguggggggcgcggcgauugaugcacauuucaggaugaagauguagauagguugaacuuaguaccugauggcgagaacauauugaauggaaggacaccagcuuuugugucagcugaaagguuccauggaagcugaguaagagcuuggaggcagagguaaagugggucaaaaaucuugauagagaaaaguaagguuguuagauccugaaauuaacuggggagugacuacugcuuagaaaaggggaagacuuuaaaauugguccuuuuugucuuucaggagcagaacuaagaaagggaggccuuauggaaagauguuuuuuaaaaaauuguuucauaccuugcggaggagggaguuggaugagguggaagucugaaaugaguggaaaagucacuuuagcuguuuagugacaugaaaguauugacguguguggaucccuauauguauauugcaagagguguguaguuaccugauacauaggguggccauuauaauuuuuaaaguaguaaaguuuuauuaagcauaauagggagagaagagaaugaugagauauuugaacaaugcuugaaugcuugauuuuaacacaacauauaugcccagugaccacaggacaguuggaaugaugucuguaauuugagguccuuuuuuucaucuuagauaucccuuuguuguuuaauauuucaaauaaauauagcuaugacaaagaucuguuguaggugcuauagagagauggaaaccaucagggugcugauuagucuuaaggaauuugcaguugaguaucuguuaggcaaguaaauuaaacagcacagaguguaaguaccaugaaagauaccaaacguugccgggcacgggggcucacgccuguaaucccagcacuuugggaggccuaggcgggaggaucaccugaggucaggaguucaagaccagccuggccagcauggugaaaccacgucucuacuaaaaauacaaaaaauuagcugggcaugguggugggcgccuguaaugccggcuacucgggaggcugaggcaggagaaucgcuugaacccgggaggcagagguugcagugagccgagauggcgucauugcacuccagccugggcaacaagagugaaacuucgucucaauaaauaaguaaauacauaaauaaaaauaaaagauacgaaguguuuugaguccaaaggcaggagaucaccugagcaaugggaggaaaucaggaaagacuuuguuuauuugcucauucauguacucaugauucauuaguuguuuuguugaucaccuguaugggaggcauuguaccaacaucugagaauagaaaaagaacaacuccacccuccuuuuacagagcuuacacuuuguuagacuucaagaaaauggcacuuaggauauuguucauccuuaauguucauuuugacagauguggauugagaagcggggaauuccaaauggaaggaaacugagcagaguuauguagguagggaagcuggggggaagggagguauucaguccaguuagacaacaagguagugugauauagcugagaaaacuuaagaguuguagagauuaucaaguuugacccuuuccuuuuacacaugaggaauguaagcccaaagaagguaaaauuguugaggcucauauagcugguauguggaaacuaacugaaauguaggucuucuaacuucaagucagcuguaguacacugcaugucaguauucaucuguucuuuccacaaauauaaguugagaacauaauauauucuaguguugaggguacacuggugaauaaaagggugaacaugggaggauauauuauaguagaagggcacagucaguaaacauagcaguuaaauauauaucagguggucacaagcacuaggaagaggaauaaaguaagacagggauguacuguuuuaucuggacaaaguggucggggaaauccuauuugauaaggugaccauauuuaagaggauccugaauaucauguuccauaauuuauaguuaaaauggguagacaauggagaaucugagaugauuugcuagaauuaauauguucacagcuauguguuaggaaaaugacucuguguaauguagugguggauaacagagaaaaguaagguuguuagagccugacauuaauuggggagugacuacugcuuagaaaaggggaagacuucaaaauugguccuuuuuguaagguucuuuuccuuacaaaagauucccuuugggacuuugguccugaauaagguacuggcaguggaucuagaaaguuaugaaaaacaaauuggcagaguggugguacuuuuaauggggaagaucaguggacuuugagaggcuucuuguuaaugugccuuauauuuuauagcuugacaugguagggaagacuuccuuagauguggaaucaaugauaguuugagaugaacuuaguucuuugaagaagggagaaaaaaaaugaauacaaugauauuuuucagcuaaaauugagcaggcaaaaugggggaggcauagguccuggggucccuuaaagauuccuggagccagucuugucucaaucuuaggcauuuguccuaaguaaauuaaaacaaguguuagaagucugagaccuagguggugguugugggaaucauaaaggcuugugccagucugaauuucccuccuccucuuuuagauaaucauuccauuuaaagucugcaguggggacacuagagaaugucuuuagggaagcauuauguucacguucuuugaaaauagaacuguugguuuuuauagacacuucagggaggaugccgaguauugcugaauggaugugguugggggguguagcaauuguuuucgugaccuugacuugaagaauuuucuugccuaccuuugucagugguggaagaucaugacugggcaauuuuuaaucucuauagcuacagauccugccucauguagaugaaaauuaguuuugucuuggcugaauuuuaauuuguuagaguaaaugagcugggaugucuggcauugaaauggugggguggugggaaaccaaggagcaagauggcuguuucagaagggucagaaaugaagauaggaggcaagaagucccaguaagaccaauaaagagagaauucaacaucaagggaacugaauuagucucaaguuauaaaaauagagcagagaugaaaggaagaaaaccuaucuucuaugugggaaagaugaugauauucugggcaggaaaggauaaugaaauuuuuuguuuguugaaagguaaguaucuuuuuaauacacugacaagacuucuaagagaaucaguuaaguugaaaauacuuuguuauguuuuauaaaaauaaaaauaugaucuuaaauaugaggguucuaggccgaauaacauugggaauuuauuacucaaauugaaggagaauucagaguauuuucucuuuugauuuaugacagaaugaaagauuuuaaaagacuuugacaccucuguugaguaaaagaaaggguguauugaauacaauucauuugauggggguaggagaagguuaggauaggccgcaggugagguauaauauuaugcuuuaaaauaauggcauuuugaaaaaaagaaaaguggaaauuaacauaucaaaguuggaaaagcaggagugggggaaguauuaaaguaccagacagagaagacaucaaaguuguuuuggaagaugagaaaguagaauaaucauagcuauagggaauaccagucaaacaggucaaauccuguuauaaaagguggcacaggugccaccgaaugacuucugcugccauugugggagccacuguucauacucuaugcucccuucaacuuuccuccuuuucuuccuucacuauucucuuuugucucuaauuucuuccuaugcugugaguguuucagugagauccacuugaaguggauuccuacuguuagacuccuuuacaggaaagguccagaaaguaucuguuuuguuuuguguguguguguguguguguaugugugcauauguguauauauacauauauacaugugugcauauguguauauaugcauauauacacgugugugcauauguguauauaugcauauauacaugugugugcauauguguauauaugcauauauacgugugugcauauguguauauaugcauauauacgugugugcauauguguauauaugcauauauacgugugugcauauguguauauaugcauauauacgugugugcauauguguauauaugcauauauacgugugugcauauguguauauaugcauauauacgugugugcauguguauauaugcauauauacaugugugugcauaugugugcauauauacauguguguauguguguauguauacauauauguauaugugucuaugcacauauguguguauauauacauauauuuuuuguaugauacauguauagugaagacgcugcaucucaguggcucacuugucagaaguuuuguuacuaauauaacagccacaggguuguuuucuaagccagcagaaaaaugguugucauuuaaauaggaaguaaaauauccaauaugguauaaaauaaaaauguaucacuauaaaucuugaaacagagagauaguggagauaaggcuggauaaaguagcaagcuaagccuuauccuagccuggggagaggaacagagaagauagugggagcauugggaggaauauauaaauaggauggucuccagguucuagaagagucuaguaaugcuagaucagauagucacuguauccugaagcuucuagaagucuuagagcacaugcugauuuuaguccaugugguccacgaagucuucuucaccugccccauccccuuccuuuccaccagguacaugcuuuacagaauguaaaguagcuuuugucccggaauaucagccaaagguggugacauuuuuugaaugaaugacugucucuuuaggcuuauaagucuuuguuauaacaguguuaauagcuuauuaccugcuuggauauugucugacuaaauuauuuuggcaguuaauuucugcuucccuugugguuucauuuggauucaaaauguauacuuccuguccuaucuuagguuucauuucuuugcuuucuaacagcuguggucuucugccuucaugguagaagaagcaauugcugaguuuuauguuguuguuuuuaauggauguguuacaguaagaucuggacccacuaguauugcaaguuucaugaggcaguuuugagguggagagugguucacacuuuaaaagggcugguguguuuuauacuugagaaaaauuguuuccugccuccggcuagccuuucaaauuuuuguauuagugucaugaaugagugccugaaaguuuagauggguuaguuuaauugaucuuguguagagaauaaauuauaaagcauacgucuuguagauaguggauuauucaucuguuuguagguauauuggcagauggccauuauauauugccauuaaaguuuugcagucaagccauauuuuaguuuaguugcuguauuguuaugaauagacuuaucagcugucugggaaauuguaacuaagcauuuacaaggaaauauaagaguggaauuuuggcagguaugucacaugguaagugacagcuuguaaccagcucuuuuuuuguuaguguguaaauggagcugcuuaggaacauuguuuuuacucucccuuagacccaguuuuuagucaguggaaagaggaggugauucuacuaauugucuaagaaaauuuuaggaaucucaaguagacuauguggcagcuuuggguuuuuuucuugucuguuucauuuacaacaggauuucucaaccuuggcacuuauugacgacuugguccagauaguucuuuguugugguggguugucuugagcauuguaagacguucagcagcaucccuggccucuauccauuaaaugccaguaucuucccuugcaaucgugacaauaaaaaauguccacacauugccagauguccccuggauuguaaauucacccccaguugagaaccacugauuuagaaaauauauguaguaaagauauauaugcacugcauggguucauuuucuuguuuucuccucuaagccacagauuggauuuucuuuucaguuuucuuuuagguaguaauaggcuaguuaccauaggcagacauuauccauaaacauuuguacauauuuuaauuucuuaaaucuguguucuuuuacuggcaauuauugaauacuuauuguauagagcacaauuaccgggguuaugccuuuggcaaauuaaaagaaagacauuuaaguagcuauaauaguaggucaaagguauuauguaaguauaggcaagaaguuuauuccaacagagguggagaugggguggagagggugucuuugaggaggugagauuugguuuguacauugaaagauggaugggauuuuaauaaguggauauugggcaaauugccauuucaggcgggaagaacaacucauggcuccuuuauuccaaauaaguuuuuuaaaaauugauucacucacuuaauacauugcauuaauuaguaugcugaccacaucuaaguuuuucuuagauaagguagguuuauggacagagaaguggugauguggaagugguaguucaaagauuugguggcugcuguaggccucaaaaagggaaaaggaauuuggucaggcaggauccuacagaaucccuuccuuuaacuguacucuuuaauguuuaccauccuucaggaucuuuuuucacuugugucgcucucuucuuuuaaauuauucccuuuaccgaucuuacuuucugugaaccaaucucaauuuuccuuuaaaaggccuuccugaucugauuuuucuuuucaaguucuguccuucuuuaccuuuguuuuauggccaagcguuucaaguuugcccuaaccuauguuuuuccuuuaguuaccaucuacuuuuccuuaaucccuugcuaucaguccauuuuuuucugaguacauuauugaaauuaccauuuccaaaggugccaaagaccucacgguggccaaauucauuuacugauuguuuuccuuucccucaaacucacacuuuuguuuuccuuccucugugugucccccucucuuguaucuguccuucuauccauuccaccaauaaacauucaguuugggccaugcuauaucccaggucccuggggauaaaaagagacugugcccucaaguaguuucacugggcauacaaguaaguacucaauuaccaaauaguucauacuggcagugguauauacacagaggcuuuacaggguguucugagcucuguugcguuuagcaucaagauuucaugauucuaauuacauugcccauucuuuugaaaaauucuuccuacuguuaccuuaccugcauuucuuccugcaagcaucaagaaggaagcauugaucuggggcuuuaagcaccaucugcuacuuucugugugggcuaacaacuuaacauuucugugucuugauuucuuuauuuguaaaacggaacauugaucuccuaaaauugcugucaguguuaacaaagguuuacauguguuuaacaaauucugguucuuuuucagguucuuuaccaccugucccccugccaauuaaucuuugcguugcuucuauauuaauagucuugaaaaaguauuuguauauggcuuucacuuccuuaaacucauuuaucugguauuguuggccuuccauaaaaugaccugcaccuaccucugccucaugauaucuucuuacucccugauagaaaccaacugccuuagccagaguaaucucauuguuuucuaaucauggcauaugcauuccugcuuaaaucucucuucccaugucauuucccaugugggaagugccacacuguacuagcuuagcuuaaacuucaccuucuuuugugaagacuuccuuguguacucuggugauuucugcauucuuuaaacuuuguagcauuuccuguaucuuagucauuugguacuuguaauuucuuaauuuuguaaugaucucuuuuuuuauaugugacuuaucucugcagcuagacuaaguaugguugagaccauguuucagcaucuuuuaaauguacaguguacauaauugguguuaaauaaaauugucaugcuuuuguuuuguuuuugcaaaacauuuaggacuauuuaccguaugccagugcuaggcucugagaauauaaaaaugaaccgauacuuacucuuuaggauaguggcuccugagggagacagauguggcacaaauauuucaauauaauguaguaaauacagugugaaauguuuucaaggaauuccaugaguguacuaagggaaguggaacuuuuccugcauaggagguuuagggaaagcuucuggaguugaacaccagaguucaguuuuacuuauuuuuuuauuuuucucagagacaggauuucgcucuguugcccaggcugguuuugaacuccuggccuuaagugauccucuugccucaagugauccucuugccucagccucccaaguugcuuagauuuauagccaugagccaccauucccugugggcugaauuuuaaaaggaugagcaggauuagccagguaaaaaagaagaguauagcaggcaaagaacaaaaugaguaaaugccucagugcaguguguuugaagaacucuaaaagaauccugauacuaggaaugacugaguuugguugauguaaacauuaugaucagauugagacuaccagucacauuaggccauauaaauuagagauuuugauuaguccauaucucauucugcauuuuuuuguguggggguggggggucuaagguuuuuuucagugaaccuggucauuaaucuuaagggagcaguuuauauuugaguagcugguguguguuaugcacauuccuacuggaauagggagacacaagagagaaagauuuauauaaugccuacaguacuuccucuugagauauguaaagauuuagauuuccucccccuacuuuuguaaguagccucaucuuagguaaaaaaaaaaaauagcuauuuggaacauuauuaaaugauuacgugggaaaugaugacaguguuagugaguacaguaguccucccuuaauuaugguuuuaguuaccuuguggucaaugguaacuaaaaguagguggucagaaaauaggugaguacaguacaauauauuuugagagagugagagaccauguucacauaacuuauuauagcuuaugucauaauuauuccauuuuauuauuagcuauuguuagucucucacugugccuaauuuauaaguuaaacuaucauagguaaaucuguauaggaaaaaagugguauauauaguguuuguuaccaccugaaguuucaggcauccacagagucaucucccauggauaauggaggacuaauguacauguaauucugaaaacagcuuugggcuaauaggacuucauuuauagaauccucaccuugagauaaggagguagaauggagguagaguugugggaaggagaaguucuacagcauuagggggaaauaucagaaaucuuuaguuacuaagguuaagugaagugucuuuggauuuaacuuuuucaagucauaaagaagaaaaacuuugcagacccuuugaugauuaguguuuuguucucacaguucuugauggcauuuuccuacuguugugucuugucuuaaaugacaagcaugauucugaaagucuguuauaacugcuauauugcauuaauauucucaucuguuucccaaaacucuuuggguucuuuucucagaucgcagaaguugaguucuuuuucuuuccuucuccuucccaaagacauauaauaguauuucagugcuguguuaguugggauacaguauaauggaugugucuguuuuacuaauacugccucuuagaaagguuacgaauuauuuacuuuuguaucaggugaucaccuaaccagauuaucuuugagauacuguacaguaaugagauaauuaguagugagguaaucaaaggaaaaugcaacuggaagaugguauucaaagagaaaaaugaguuaaagacugcuuacuugaaauuuuuuuuauuacuggugaaaaaaguaaaaaagcauaguguugagagaaccaccauaggauaaauuuggacauuaaagagugucuuaggacaucugcagaauuuugugugugugcauacauacaacuuguguaauauauuaugaggugaaauuuuuguacuuuuaacaucuaauucuaugaaaucauauuccucaauuucuguuuaaguaaccaaaaugacaguauuauaccuugucugaaauaaucauuaguuuuguuuuuugaugaaaaaagguuagaccauuuuaagaaccacaacucaaauaauaaggcauacuggccauaaauucugguuuaugaaaggaaaauaauguaacagauuaauugcuuucugguuuucuaauguaauauauuaauuugguuguuuaaacgcauacacaggucuuuuuggcucccuaagacagcggcacggcauagcaaguugaaugagccaaggaguuugaauuaagacuggcuuaauuuguauuuugguuguccugaguucagaucccuauuauauacuagcaauguaaccuugaagcucucuaguuuuuuaccuuggcuaccuguaaaaugaccaugguagaauuacuaggagaauuacaugagaagauagacacaguauaaucccuccauagccgugggagauugguuccaggacccccacaauaccaaaaucuguaggugcuccuuuauauaaaauggcauaguacuugcacauaaccugcauacauugucuacucuaaaucaucucuagaucacuuacaauauguaauacaauguaaaaguuguuacacuauauugcuuuuuaauuuguauuuuaaaaaauuguuauuuuuuucugaaaaaaaauuuuuuuuuuuuuuuuuggucuacaauugguugaauccauggaugaggaacucaccgauagagggccagcucauaccacaauaacccucaugcuuucugcuuuuuuguuaccugugcuguuucuuuauaccugaaauaacaauuagucuuuccacuauuuuuggcagcugauuugaagcuacaagugauggcaguucucaagaaugugucaccaggaacaauucucucucccuuuaaaugcuaacagggaauuguuagcauuuccuuuguaugaggguuacuugcuuuuguguuggauuugggagaggugugcaguauauccugauguggccauauagguauauccuuuaauauuaaucuuugugaaacuuaggagacuccugaguuaauauccuuuaucuaaaaauuuuuugguaugugauuuuauuauuuuauaaauaauguuuuuaguaaucauuuugaccuguuguuugaaaggcuuauuauacucuuagaccaucugccauauagcuucuggguuagcuuccauucgcauguaaucuggcauacacugacauaccuuuucuuuuuucaguucugacauugaggcuuguauagacuagcaauaaggaauaacuucacagagaggcuguuuguuuguucuuuugacaugauuguuaguaguaauagccagcacuuuuauguugugccagacaguauuccaaauauuguguguuuauuaacucuuugaauaguagauguauacuauuauugcucuguuacacagcuaggcaaacaggcauaggagacauacaugcagaaaguggcagagcuggguuuugaaccuagauaucaggcugauucuaucuguaucuguauaguuuuauaaucuuauuugcuuaggauuguaugauuuuauuuuuauuuuauuuuuguuuauauaaaacauaauguaauauguagaauuauaaacauauauaaucugaacacucuucucaucagugucaaccuuccuaaugcacuuuuucuuuguagauaauaagcgggaagugggccggguaguuuugccaaaaaacuuacuuaggggagauaaguuuuucuuguauauuugaaauuaauucauuuagauugcuuuaucuuacugacuaguugaccugcuauuccucccuuauuauagcuguucuuucugcagguuuugucuuuaguuaguaucacuacuuagauacaguuuauuuccuagaacacuggggaauauugagaaccagcuauuaugggggaaaauaacuuugaccuaucagggcuaauaguacaaguagugaaugacuugccaguuuuuguggauaacuucacugcagaagauuuggauuccauuuuccucacugacuugguuauuacauagagauguuuaggugccagcuucugacacugaggauuauaauuuugcauguaugaaauuuaaaucuuggauaauaacuugcuucuaaaggaaaauucaauguaacuuuuaaaaaguaacagauuacuaaagcuauacuuuauaugugaccugauaucuuugaauuuaauguuuacccuuggaaauuuauuguuaccugaaauugagacagcaagacugugguuaacuaggaaaagggacagcuuuccuuuacucacuucccagucuuaauuucuuucuuucauaugacuuuacauugcucuugaaaauuuccuucuuccagaaagucuuucuuuggaucaucuuagaauuuucucagguaaaugaguagauguuucucuuuugugugugcaccauguuguucucauguugucauuuaagaggagggcuuucucuuaauuauuuugggacaaccuuagaaccauacugacacccaguaaauguuggcuaauaauauaugagauugcacuuacugcaaacauuuugaauuacgugaauuucucagaguaauugacauauucagucuucaaggaaugguagagucugaauaauuaguacuauucuucauuguuacauaaaaccaagcacacuugacuuaagcaaugaaaagaagcaaaaacuguauaaacugugucacaggccuuuuuuuugugugugacggauucuuacuuuguugcccaaacuggagugcaguggugccaucucggcucacugcagccuccaccuccuggguucaagcgauucuccugccucagccugcugaguagcugggauuacaggcgcccgccaccacgccuggccgauuuuuguguuuuuaguagagauggggugucaccauguuggucaggcuggucucgaacuccugaccucgugauccaccugcauuggccucccaaagugcugugauuacaggcgugagccaccacaccuggccuuuucuuuuuuucugagacagggucucacugugucacccaggcuggacuccagucacguauucacagcaaccucuaccucccaggcucaaaugauccucccaccucagccuccugaguagcuaggacuacaggcgcacgccaccacacccagcuaauuuuggaauuuuuuucuucguagagaugggucucuccagguugcucaggcuggucacugucuuuuuaaagaaaugcugauaacacuguagauguaagaauugaagaauacaggaguuuauuagguuuuuaguugcaaggaacagaaaaaacacuggcucacuuaagcggugaaagggcuggagauguaggaccaguagcgguauucguuuccuuuuccugcucuaacaaauuacuaccaccauggugggguuaaaacacacaacaguucuggaggucagagguccaaaauggguccuaccaggcuaaagucaaggugccauuccuucuagagugucuaggaggaaaauccuuuuucuugccuuuuccagcuuuucagacugcccacauuccuuagcucauggcccccuuccaucuucaaagccaguagucacauuacucuauauucuacuucccccaccacucuuucucugacucuccugccucucuuucacuuagaaagauccuuguaaucacauuggacacacccagauaauucaauacacucucccuuucucaaaauccuuaacuaaucacaccugaaaaaucccuguuguagauaaaauucaagguucugggauuaggauguggacaucucuaaggagccauuauucugcuuuccacaauagcuauacagccuggaacagugccucaaaucacaucauagaacucagccugugaagacacuuugcagaaccuugauugugucaguuacuuugcaucccugauccuaacaccacucaugcuggcccuauuggaaauuggaugugcuugcugcugcuauccagaauggauuagccacaguccccacuuucucucauuaguucacacuuaaaugugggguugauguguuuguugauggagccugaauuaugugucuguacacuagcugcaaaugaagcugguaaauauauaaugggaagcagguucugcuuuauaaauuguggggauuucucaaaaauaggaagagaaauucagaugcugggcuugaauaccaaccagagagaacauauaaguacaguugagagucauugguauaaggauuccauucguuugacaaacuguaccagagauacacagauggaugagauacauuucuguuucuguuggugcuagccagagcaagaguggaaagccguguucauaugucaguagccuaacauaaaucaguacuauuucucugagacucugauaggaagccagcucuguuaugugaaggcuuuucacuuaguguguuuuucaucuguucaccaaaaauugcuauuggcuguacuuuugccuuucaaauggugacaugagaauaguugauagaggaagguggguagguuuugagguuuuucucuuucacuccagaagguuaucaguuaaagugguauugauguauaacugugcuguccaauaugguacccacuggccacauauggcuauuuaaaugcauuuaaauaaaaugaaauuuaagauccaguuucucagauggugacaugagaauaguugauagaggaaggugggaagguuuuguggcuuuucucuuuucacuccaguagguuaucaguaacagugguauugauauauaacugugcuguccagugugguagccacuggccacauguggccauuuaaauagaaugaaauuuaagaucuaguuucucaguuacacuaagcaugugucaagugcucauguggcuagugacugccauauuggauagcucaguuuuauacccaugguguagcaucuuuacuguacaagagucaauccaggaaaaguaaaauguuuauaaggcuuuuuuuuuuuuuuuuuuuuuuugagacggucucacucuguugcccaggcuggagugcaguggcagucucagcucacugcaaccuccaccucccagguucaagugacucuccugccucagccuccugaguagcugggauuacaggcacccaccaccauguccagcuaauuuuuguguuuuuaguagagacgagguuuugcuguguuggccaggcaggucucgaacuucugaccuuaggugauccacccgccuuggccucccaaagugcugggauuacaggcuugagccaccacgccuggccaaggcuuuuuuucuuuuuaacccuaauuauuuuucuuuuugauauaguucaugaguguucacaauaucuuucacguguguuagauguuuucaccgacagaauccugcacaauaggcuuaauuaacccucacuuuucauacagaaaauugaagcuuaaaaaaaaaaguucaaucaacagaguuagacagggcuugaauuuuauuuaauucuacucaauccaauauaaaauaccuaaggugcuaaguacuguguuaaauaguaagauacuaaaaagcuagcugcucugcccaggucugguccucauucucggguucuugucagaucuuucugcuugggcugggcaagggaggacaaguggaauaacuuugugaagggcaagugugguuucuuugaaauugguuacagagugcucuggcuguuguacaucuaacuccuagguccuacagcuugggcugggaccucaccucccuaaggaugguuagaugugaagaaugagugggagagagauugauucaucgaugauauugauguugaccauagagaaauaguagcgcuuuuaauggaaaugaggaauaaaagggaauauuuaaugaauaucuauggugagaugccagauagacaauuggaauaggaccauggcuggguuagaauuauugccuuuguauugucuucaauaauggugagacuugaaucuacaagcugggaaguaugaauuaaagaaguauaagggcauuagggccagcuucuuagggaacaaguaccagauaguaauaaagaucaacuucuauucucaaugguuuuguuacucuaccuauuuagguggaaggagaaagaagaaacaagaagugaccuaucgaaaacgugagagggacuaggaaagacugagcagaaaaguuuuaaugaagggguugcucuaaugcaauaguuugcaaaaugugguccccagaugagcaucaucagcaucaccugggaacuuacuagaaacacaaauuuuugagccccaucucagaccagcugaaucagaaccucuugggauauggcccagcaaucugggugauccagggcuaguuuuugaaaaaacacugguaaaguaugguauugaguacugagaguuugggaaauacaaggacugagaaaaagcucuuagauuggucagggaaggucauugguaacacuugagcaaauuugcuacaaugauaaaagacccuaacugcaaguuuagagaugacuuagguaaucagaaaguaaagccaguagcuauauauauugucuuuucauaaaguucaaagacagggagaaagauggaugcuugauggcaaaagcaggauggacggaaacuuagguuggaaggacuggaguacauuuuauguuuugggcuucaacagacaauauaaaagggcauuuauuuuguagaaauuguuuuauucuuaccuguggacauuuucuaugcagaaagcauuuuaaguauaaaauauuuuaaaauuggcuuauaggagacugauauuuuaauaacuauuauaaauguauaucugcauugaauaaaauaaaaacguuaagauuaaaaaauuugguaacauuacauugccaccgcuacuguuaauacuuucuagucuuuuuaucaauauagaauaugcauuuuaugcauauacagauaaugcauuuuaaacauauacuguuuuaaucaaauucucuauguaauaaaauauauuuauuuuaaauguauaguuaagaauuuugacaaacauaugccccuauaaccaucacccugaucaagaacauuucaaauccccccaaagugcuuuuauuuauauauuuaauuugagauggagucucacucugucgcccagguuggagugcaguggcacaaucuuggugcacugcaaccucugccucccagguugaagcaauucuccugccucagccuccuaaguagcugggauuacaggcaugcgccaccaugccuggcugauuuuuauauuuuuaguagagcugggguuucgccauguuggccaggcuauucucaaacuccugaccucagccucucagagugcugggauuacaggcgugagcugccaugccuggccucaaagugcuuuuagaccccuugcagucaaucuuaacucugcuuaacccucugugccucaggcaaucauuacucugauuuuuuucaauguuaaguuuguucgcauguccgguaacuucugaagugggaugauguaaugcauuauuuugugccuguauucuguuggcauaaaacaugccaagcaauuaaugcacauuguuguacacauucauaguuccuuccuuuguuuacugcugaauaauauucuuuugugugaauauauaauuuguuuauccauucagcuuuugaugaaccuuuagguuguuucuaauuuuuugcuauuaugaauaaagcuagaacauucugucuaagucuuuuuguguacauguguuuucauuucucuugguuugcauguauguauuuugggauauaaaugugugcaugugcauguauagaauguuacauacaugcacauauauauacacucggguacauacauauguggcuauauacauauauauauaucuccuagucuguggcuugucuuuucgguuuuuaauguaucuuuugaagagcauaaguuuuaaauaaauacugaugaaucuaguuuauuagguuuuuucuuuuauugaaucuuagcuaagaauucuuuaucuaucauggauuggugucuugaucuauuugugcugcuauaauaaaauaccuaagacuagguaauuuauaagcaacagaaauuuauuucucacagauccagaggcugggaaguccaguauuaaggugccggcagguucggugcuggcaagagcccagucucugcuuccaagauggcaccuuguugcugccuucucuacaggggacaaaugcuguguccacauauggcagaagggauggaagggcaaaaaaggccguaccuaauucucuccagcccuuucguauggcacugaucucauccaugaaggcagaguccucauagucugaucaccuccuaaaggcaucaccucuuaauacuguuguguuggggauuaagauuuaacaugaauuuuggaggaggaggcacaagccgucauaccauaccaggcaguaaaaauuuacuccuuaguuuucuucuagaaauagauuaagucugugauccauuuuggguuaauuuuucugugauguauacuauuguuugagguuaauuuuuuucuaguuuuaaaauuuucauccaguuguuccagcaucacuuguugagaaaauuguuuuucccauuaaauuacuuugauaccuuugucaaaaauauauuggcuauacauguaaaaacacacauacacguauacauaaauguagaaauaggugagccuguuucugaccucuguucuguccuauuucucugcaugucuuuccuuugacuacuauacugucuugaugaccacaacucucuaguaaguuuugaaaucagguaaucuaaguucucuauuuuuugggaauuguuuuagcuauucuagguuuuugcauuuccagauaaauuuuaaaauagccugccaguuucuaacgaaaacaaucugcuuggguucugauugcaauuguguuauaacuauaguucaguuuggggagaauuauauaaauccuucugaagaaucagcuuuugucuuucacuuauuuucugugucuuuguuuucugcucuucacuauuuccuuccuucuacuuuauuuggauuuaauaugcuguucuuuuuuuuauagcuucuuagaugcuuagguagaugcuuagaucaaggcuuuuagaccuauuuuaacauaagcauauaaagcuauaaauaccucucuaagcacugcuuuuauugcauccgacacguuauauauguuuccguuuucauuuggcuuaaaauauuuuccaguuucuccugugauuuauucuuugaccugugauuauuuauuauuuauuuuauuuuauuuguuuuuagagacacgaucucgcucuguugccuagguauugugcagugguacaaucauaauucacugcgacuucaaacucuuaggcucaagugauccucccaccucagccuccugaguagcuggaacuacaggaaugcacugccacuguuccuggcuaauuuuuacaaacuuuuuuauaaagauagggucuuauuguauugcccagguuggucucaaacucuuggccucaagcgauccccuggccucagccucccaaaguguugagauuacaggugugagccacuacacccggcaaccuaugauuauuuagaaauguuugauucauuuccaaauauuugaggaauuagagaacuuuauucuuuaacuuagacaacuaauucuaguuguuuauauauauauuuuuaaauuuguacuucuaugacuuuaauucuuuuaaauuucugagauuuguuuugugguucagcauauguucuaucuuggugaaugugccaugugcacuuacaaagaagguguauucuuuuguuggguaaaauguucucuaaaugccagugggaucuguuggguuauaaccuuaguguuggucuaaccucacugguuuguuuuguuuuuguuuuuuauugagacggagucuugcucugucacccaggcuggagugcaguggcgcaaucucggcugauugcaaccucugccgcccauguucaagugauucuugugccuuaaccucccaaguaccugggacuauaggcacacgccaccacaccuggcuaauuuuuguauuuugaguagagacgggguuucgcuguuggccaggcuguucucgaaugccugaccucaggugaucugcccgcccuggccucccagagugcuaggauuacaggcgugagucauagcacccggccacuuuacugguuuucugccuacuuuuuguuaguuauugagagaguuuuggaaucuccaaauaauuauagauuuaucuauuucucuauucccuguuucuguuuuuguauuuucuuuuuugcuuguuugaaacagggucuugcucuguugcccaggcugcagugcagugacaccaucauggcucacugcagucucaaucaccugggcucaagcaauccucccaccucagccuccugagcagcugggacuacaggcauacgccaccaugccugccuaaugucuucuauuguuuuaugaacugucuuacucuuuuuuaaauugcucuaguauuuauauuaugcaccuuuauauuauauaauuuuauguauaauauaaaauguuacaacaauauaguacuuucauuuuccuuuccuuuuguuuguacuacuauugucaaacagcuucuauauuuguuuuaaguuucaaaauuuaggggacuuuuuugguuuuuguuuuuuuuuucuuaaaacaauaaauugacuuuuaaauaaguuuuaaaacaaagagaaaaaaguuauuuuauauuuacucauauauuuacuauuucuggcacucgucaucucuuuguuuaguucaaggcuuccaucugguaucauuuucuuccagcccaaagaguuuccuuuuuaauauuccuuaugguauugaucucuuggcaucaaauuuccucagcucuuauguuucuaaaaaaaaaaacguauuuuuuucaccuuugguuuuaaagaauauuuuugcuggguauaaaauuauagauuggcauuuuuucccuaguauuuuaaagauguuauucuauuaucuucuggcuugucuuuuuucugauaagaacuuagcuagcccuuguucuuuuuuuuuuuuuuuuuuuuuuuuuuuugagauggugucucgcucuguugcccaggcuggagugcaguggugcaaucucggcucaccacaaccuugggugucucgcucuguugcccaggcuggagugcaguggugcaaucucggcucaccacaaccuugccucccggguucaagcgauucuccugccucagccucccgagcagcugggacuacagacacacgccaccaugcccagcuaauuuugguguuuuuaguagagacaggguuucacuauguuggccaggcuggucuccaacuccugaccucaugauccauccaccucggccucucaaagugcugggauuacaggcgugagccaccgugcccagccucuuauuuuaauccuucuuagguaauauauauauauuuuuuucucuccuuuuaucauuguuuuucagcgauuugauuaaaaugccuuugugugguuuucuuuuguguuuaaaugcuuguaguugagcuucuuagauuuauaggcuuauaauuuucaucaaauuuggauccugcaauugccauugaagucuguauguucauuucucauguauaauucaugugagaaaauacgguaaaccuguguuaucugguaauucucauuaauaaaaaauuucuaaaauuaggauuuuuguuuuacauuauguugaggaggaagagagagugaggaaaacaacuagagagaacuccugggaaagaacuuacgcuagaagcuaaaaccaggaggauuucuugaagaguucuuuaucagauucaagggaaguaggaugugggugugucuuaugcuguucaaaaaggcaaacugggccaagcgagguggcucacgccccuaaucccagcacuuugggaggccgagucgggcggaucaugaggucaggaguucgagacuagccuggacaacauggggaaacccaucucuacuaaaaauacaaaaauuagccgagugugguggugcgugccuguaaucccaccuacucgggaggcuaagacaagagaaucgcuugaacccaggaggcagagguugcaaugagcccagauugugccacugugcuccagccuaggugacgagcaagaccuuuucucaauggaaaaaaaaaaaaggcaaacugaauaaaucauaagcaaugagauauuuacacuuuagcuuuuaauauaugaacuguugaaaauugaggccugucaugcauuguaaaauaaugagcaaaaaaaguuuaggcuccagaauucugauacugugccuggauuugaauuccaguccuagcacuuaccaucuuuguggcauugggcaaguuuccuaaaaucucuaggaguuucuuuaaucauaaaauuggaaaaaugguuauaaucucagguugucaugaaaacuaaacccaggauggcuuauguucuucacuugucauuuaguagauccccaauaauuauuaguuaucuuuccuucuuuauauauuaacuuuuuauucuuucauucagggacuuuuuuuccuuuuaaauauaugcaauaguuaaacaagucccuauggcccucaugagacuguauuuacccauuauguuucucuauuggaucuuuucuauguuguuguuuaucccauccuauuaaaaaacauguuauguauuccaucuuaaaaacgcuuuugaccuuuacaucucucuguagcuacugccucuuucuuuucccagacuauugucuaaauucaauuuuaaccucaguuccuauccucuuauaacaagauccucagugacuuccacauuacuaaauccagugauuaguucucaggccucauuuuacuuuauuuuucaggagcauuuauugauucugcccucuuuucuugaagcuuuuucuuuauuuggcuucugggacacuucguuugacaaauuuaccuccuacuucucuggccacuuguucucaaucuguuuacuauuuguuuccuucucagucuagccaggaguguccaguguuuuggcuucccuggguuacauuggaaaaagaagaauugucuugggccacacauaaaauaugcuaacacuaaugauagcugaugagcuuuuaaaaauugcaaaaaaaaucuuagaauguuuuaagaaaguuugugaauuuguguugggccgcaguuaaagccguccugggcugcauguggucugugggccauggauuggacaggcuuagucuagcccuuaaauauuggaguuucucagacuuguuacucuuaacacucccuugguaaugucaucccgucuuaugggcuuuaacgaauaucuguaugcugaugacucccaaaugauaucuguacucccacuuuccucugaccccuuuaacaaaacucuuuaagaaacuaccaguuaauuacauucaugucauaccuuugcuuaaaauguccaaaaauuuugcuuggugguuucucauaucucagacuaucuagaucaaguuaagucugaccugcauaguccagaacaacuucgcucaaaugucugggcccucaacuggaauggcugugauagcuaagaaaacugggucucucuucccaaguggucugucauccucagcuucauaguguuuugaugguguuccaaaagggcaagcccaaaugugccagugcuuacaaagucucagugucacauuuacugaaguccaguuggccaaaguaagucacaugaccaaacccaggauugguaggaguuccaggggugcaaaugccaagaggugugugauucauugggggcaguuaauaauguaucacagguuuuauauaaucugcaucugguuuaauuuguuaaauuauuuuuuauuuuauuuauuuauuuauuuugcgauggagucuuguucuguggcccaggcuggagugcaguggcgcgaucuuggcucacugcaaccucugccuccccgguucaugcgauucuccugccucagccucuggaguagcugggauuauaggcgcccgccaccgugcccggcuaauuuuugucuuuuuaguagagagggagguuucaccaucuuggccaggcuggucuagaacuccugaccucaugaucccaccugccucggccucccaaagugcugggauuacaggcgugagccacugcaccuggccaaaauuauuuuauuauuauacagcacccauuucuuugcucaggaaaauaaucaagaaaaagaacugucuagauaauuaaauugucaucuggaaguaugggcuaaauaauggcucuugugagaauaucaaguuugacuuuugaguaucuuuuguuuuucaguuucagagagcaccuggaaguagagaauguacuauuuguaccacaauaauuuauagaauauuuuauuuaguuaaaucagacaguaucuugaauauuguugcuaguuaauuaacuuguccaucuuucauguuaucuaccuguuccaaguuagaaaguugaacuuuauuucucccuaaucuaaaauuauauggagcuuugcauuuuauaaagcacuguuucagcugagugcaguggcucauaccuguaaucccagcacuuugggaggccgaggcgggaagaucuugagccuaggaguucaagaucagccugggcaacaugacaaaacucugucucuacugcagauacaaaaauuagccaucugugguggcacgugccucuaguugcagcuacuuggguggcuaaagaaggagccuaggagguugaggcugcaguaaggcaugauuguaccacugcacuccagucugggcaauagaguuuaaaacaaaaaacaaaaaacacuguuucuuuuuccaaccuaauuuuuguucaccgucaccugucaaaggaugugguuacacucuuguuuucuuuuuccuuuaaagcagcuuuagguuuacagacaaauugcgagaaagguauagagauuucccauauaccccuugcucacacacaugaauagccuccccuguuaugaacauuccccaccagagugguacauuuguuauaacucgugaacuuacauugacacaucauauucacccaaaguucauuuuacauuauaguucacucuugguguuguacacucuguggguuuggaccaguguguaaugacauguauccaccguuguauaguacagaguauuuucacugcccuaaaaauccucuuugcuccaccuguucauucccccucucuuccccuccaacuccuggcaaccacugaucuuuuuacuaccuccauaguucuugccuuuuccggaaugucauaugguuggaauccuaugguauauagucauuuuagauuguaacaugcauuuaaguuuccuucaugucuuuucaugguuugauaguucauuucuuuuuagugcgaaauaauaaucuguugucuggaugugccauagauuauuuauccuuuccccuacugaaggauaucuugguugcuucaguaggugaauggauaaauuaguuuucagugauuauaaauaaagccgauaugauauucaugugcagguuuuuguguagacaucaguuuucagcucaauugaauaaauaccuagagucauaugguaagauuauguuuagcuuugugaguaacugcuaaacuuccaaagugacuguacuauuuugcauucccaacagcagugaaugagaguucccgaugcuccacauucucauucgcauuugguuuuguaauuguucuggauuucgaccauucuaauaguguagucguagaucauuauuguuuuaacuugcauuucccugagacguuuuauguggagcaucuuuucacaugcuuauuugccaucuguguaucuucuuuggcaaggugucuguuaagguuuuggcucauuuuuuaaucgaguugcuuguuuucuuaauguucaagaguucuuuguauauuucagauaagucauuuaugaaaugcguguuuuaucuucgacuuuguggcuuguuguucucuggacagccuguuuucuccauauuaacuccuuguacuuugucuuguaaugucccuuugucaguuuuuucauauuaccauuuccaaauaaauuuggugugccguuacuuacauuaacacuacuuuuaauucuaguaucuacucauauuuuugcuuucauuuugguauccuucuuguuuggaauucuguuaaccuuuuaucuguaugugcaagcaucugauuacuuuguuaugucuucuaagguggucuuaucugaccauuuauauauugagauacuaauuuuaaucuguuuauuauuucaagaagguacagggguuguugcaaaaaaaggacuauuuuuaaaaaggcauuggguucauugcuuuggaaagcauuguuuuggcauaccuuguuuaauguaaaaauugagaugaggggaaauagcuuuccuguuguuuauggcuuaaccuacuuugcuuguuucauucauuuggguugugagcuuauguucuguuugaaguuauagauuuuauauuuauauuauguucuguuugaaguuuuagaaauauuuaauguucuguauauauuauauagauuccacuacgaugaaaacaaagugugaauuucagagagccaaguaaaugauuauguauuuaucugauugacuguauaaaaugguagguuuucuuaagaaaaaggauguuauuccugguucucagauggaaaaccuuucagauuguuuuuggugaagacuuuuaaaacuauugucagguuuuagaaaccuugaguuuuuaggaucuuuaccuuuuauugagaaacuguuuaguccaaauuaaccugaauuuauuugagcaacuuguaugcugugcacuaugugaggcacuacauaugcguaauugaauaggacaguuucuagugaaggaaauguguacacaaauaacuuuauuguaguccugugaguccaauaauagaugugggcauuaagaugcacugggaguacucagccaaacuaagaccugcuuuuaggaguuacugaguuuaaaauacaagaauggguuaaccaaacaaggagggaagugggagggcauucuaggaugagugaaaaagcaugaauaaggauacugaggggcaaaacaacaagaaauuaaaaguaauucagguuuauuggaucacaaaguguaaagugaaaagcuguggcacuuuauaugcuaugcugaggaacuugaguuuuaucauauuuucucucauucuuuuccacuaaagugcgacuaaagucacaggagauugaauacaugcuuuggaaguauggcagcaaagugcgcauagaccugccacauauuugaaauuucuccuaagacguauuuuauugugaagaauuaugaaaaauguucuauucuagaauugauuagugugaguucuuaaguuccuaauuuauagacugaggauaauaauagcauuuaccuuuuaggauugcugggaggaguaauaacuauaaaaugauaaugacaauaauggccaacauuuuuugagggcuuacuuaccaaggaacaguccuaagugcuuuacuucuguuaccucauuuaauccucaaaacaccucaaugagguagguauuuuacuaucuccaucuuauuucuaacaaaacuggggcauagagaaguaauucaccuaagguuacacagcuaguaaguggcagagcuugguuugaaccuaggcaguuugaauauaagacauucuuacuauauuauacucccauuuuaugauaucaugcauauagaauauuuagcuuuguaucuggcacguacuaauuauaaauguaagcaauuaucaauagcaauaauaauaacuuacuuuguccaaaucuuugaguuaaauugaaguccccaagaaauugugcuguuuuucuugugacuugauuuacaccugacauaccacuggggugcagaaagugugacucccaaagccaugcuuuuaaccacugccgccuccuuccuuguuggucugucucuacauuagauuuuaaauccauggcagggaccauauccauuuuuuucaucaugguacacuuaguccuuaacacuguaucuaugauauaaaaaugaccaaauuuguacaguaaaugagaaucgaaaaacgugacauuuucaacugaucuuagcauuauucauacuaccuauaauuguguuuuaauuguuuuacauauuuuuuacauaauuguuuuguuuuacauauuuuuucuucaguaaggaguccaucugcuucuguguucuacagggcauucucauccuggucuuaaaagagcccugcuugguaaccgguaucuguuuguccuguagugaucacucaguuuucagacagugaggaacauuagaauaacauuuuggucuauaacuagaaucuguuagaaauauaugagacagaauuuuuaaauguuuguucuaagaaacauuaaacaaaaaaagaaaaaggcuuugacauuuuuccuuuaccuuucacaugaagucauuucaaauaaagauaaaauaauuuucuucauagggguucucuguuauuguggguuaacucauauuuuccuccucuccucuaucuagaaugucuuaaaccauucuaccuuaugagaaauuggauguucuugcagauagucauugugggagaaaacguuucauuuaagucccagaugaggaccgaaaacuugaaaucagaggagcaucugaaaucaaguaauauuagguaggaugaaaauuacaagggauuucuacauguuuuuauuccuuuuggagauguguauuauucauacucugugaauacuaauaaaauuagaaacuuccugaaacauuugauuuuggccaagaucgggauggggcaugcuaaaguuuuauuauuuaugugacuucuugagaaccuuggcuuauguuuauacuuugucuugagcauuuuuaucuugugguccaaggaagcuuuugaaaauuuuacugaaguaaauuuuuaaaaauuuuguuuuauaugaggucucugaauauuuaugauaaacguagggacacaugauuuauaccucauccuuuagaaugaaaguuucugugguuuuuuuacauacuuaguaaaucaugugagugcagguaacaucagcuugcaguucuguaugucagcguggaugcaaucaagccucccaagugccuguagaaauagguguaugauaguaugcuagagaagcccucuuguacaugugaauuaguaacuauugcuacagcagcuuauaaugacagaaaaugcaaagaugcuugaucucaaagaugcagcuuuuaacugagagaugauaguugccucugcgagagugauaccucuagccuggccauuucagaaggccuuaaauauguuuaugagcucugggguuuggaacuagauugcaaggguggaacccaagcucugccauuuccuaguuaugugaccuugggcaaguuauuuaaccacucugugcaucuauucccucaucaucaaaaugggcauaauauuguuacuuaccugauagaauuguugugagaaucaaagauuuaguaauauaugaaagcuaagaccuggcaaauaauaagugauuaaacuauauuauuguuugacugcugguuaauucuuaacagaugaguuuagucuguuaucaguuagugugguauuucuauaauuuauaauugucuugauauaucagguccaauuuuaaaaauguauuuguuaaauaacguaaucagaacuaauguuuggagaaaaauaaaaaaaaauaacauccugacucaauuauuuuguaauuuuuauguaucugccucugguuuuauuuucuguuuauacuaagaacauagucuucaugacaucuaaacuguuuuucuuuugucacuuguggugguagaggacauaggguuuuuuacuacaacuuugaaaugucuuuuucaacccaaugugccccuucaaaagggaucucaugaagcagugaggggagggagggacaccugacuagccagucaguaaccagauuagcaaaaguaauuugauggucauugaacuauucaugucacaaucagauuaccccuccuuauucaaaugaucauuuagguucuuuuauauaacuuacuugucuuauuuauuccucauagcaacuuugaaaaguaguuucuauccucauuuuauggaugaggaaacagucuucuuaaaagcuccaagauagcauuacuaauuuguaggaaagcccaaauucagaccugagucuuuuugcuucauauuauuuuccauuacauaaaacugccuccuguaugguucauauuuuaucacucaauaauucaacaaauucaacaauuuuuagugaacagcugccaugggccgaggcauuauucuaguuguuauggcccucaucuuuuccaacacucccaguggcucaucuuuuuaguuguauucuaggcauaugucuauucuugcacugacuuuuauuguauugaaauuauguacaugccuuuguaucugucaccuuaccuagaguuccuuaaaaguagguaucuaccaguguuaucauuuugacuauuuagaguaaaaaaaaauugacuuauuuuaauuuguacuuacugguaguauuuccuuuuuugaauuaucaguuuggucuucuagcgauuuuucuguugauaucuugauuuauuuauuuauuuauuuauuuauuuauuuugagaccgagucucgcucuuguuguccaggcuguaguacaauggugugaucucggcucacugcaaccuccaucucccagguucaagugauucuccugcuucagccucccggguagcugggaugacaggcacccgucaccaugcccggcuaauuuuuauauuuuuaguagagacaguuucaccauguuggccaggcuggucucaaacuccugaccucccgugaucugccugccucggccucccaaaguacugggauuacaggcgugagccacagcaccuggccaauauauuuuuguauuaauuuuucaauuuugucuaguccacauggcucuuaacacuuucucugcauucuuuucuuugucauuuuguaauuaucccaaauauuuaccauucuccucagcuuaucccccucuuacuuucagacacagauuggaucuaccuuaucucugaaauugaggaaauacagcuguaaauucucuugacgucucccuacccccaguauuuccuaguucuaacacauuucuauuuaaccuuaccaaccuccaauuuuauucugacucuuuuucaaggccaguccucuuccugucuuaauaauaccauucuuauuuccuucuaucucuuccagaacagugcugucaguuuuauuuucuccuauuuuuuauuuuuuauauuuuauauuucuccuucuucaaccuauucauuucuuccaccuucuuuccuuuauucuaaacacucucaagugucucccauugggagaagaaaaaaaaaaaagaagaaacuucuguuuagccguggccuccaucucugucucuuuacacaguccagcauccuaagaguugacguaaacuucucccucuuauuuguuccucaaccuccugcauccugauauaaucuuuucucuggcaaggcuaucauugacccuuauuucaccaaaucugacacacuuuucaguccuuauuuaucucauaguacuuuucugcugucugugauauugaugacuacucuuccuuuuuguucucuuauuuucuauacuccacucuucccuugcugucauacuauucaccaauuucuucuugguguccuucauggagugucuuucaucuacucuuuaaaaaugaaaacagagaacuagcuccacccuucugaguuugugggcaguuacauuuacucucaugguuuuaacugccaucaauguacugaucacgucagugcuguaucccuagucucaagucuccccugugcuugauacuuaucucugaaugccugcuuacgcauucauuaauucaacaaauugaacgcauuuuuagugaacagcugcuacggucaaggcauuauuguagcuguuauggguguagcccugaacacuaucuuuuuugcauucuuuaccuucucauauacccagcuggccaaacuaacaaucugggagugacagacucuuuccucugcuuuaucuuccuuucuuuuggcuuaacuuaccagguauuucuugaaucuggguuuuuccguucaucuguauuaccacuuccuuacuucagucuuauaucuguaguaaucuuucuaaaauguaaaucuaacaaugcuaugcucuugcuuuaaauucugcacugguuuucuauugaaggacagaaucugaacuccaaggcaugucaugcaagucaugcaaggccucucacaauuuguucugucuggauucuucagcuucauuaucuguggcuuucugccuugcauuugaugcucacucacuagcuuagcuuugcuuuuuauuguucuguuauuucuucugcuuggaagaauaacuccuucucauccuuugaaauucucagaccaguguugguccuuaauaaaacuagguacacauuuuuaaagaauauaaauuauggagcgaauguugugguauagaguauuguaguguugggagauuugaaaauccuucaugagcccuaaagugcuguaaagagaaagcaaauuaguauuuuuauuaacgugugcaagaaaagcuccuuuaggagcagcaucuucucuagauuuucuuuuccaaaugacauucaacaguagagcaauaugauuuauuuuucucugauuaauauugcgagacuugauguguguguggguguauacgcaugugcacauuaagugcaugcuuacuuuaugucuggccaauuauucagcauaaauaauuaugauuagauuauuguguuuaugguuaugauugagaaaugcuguuauuaucccaaguauuccuuagaacucuaugaaacaagugaacaaauuaacuuguggcuuuugguuaaauuucuuaaaaaaaaaaaaaacacgaaaaaacucccagcguguucucccaaaauaaaagagagugauucacuuuuccuuagcagcugugaguuuagaagauguugaguuauauuccugaauucugcucaaaggggauugggaguucaggcagaaggaaucucccauuuuaugugcccugauuuggaaauaucuuacauuuuuaaaccaugaaucuuagacuauauauucuuuuuuuuuuuuuuuuuuuuggagacggagucucacucugucaccuaggcuggagugcaguggugugaucuuggcucgcugcaaccuacgccccccagguucaagugauucuccugccucagccuccagaguagcugggacuacggguacaugccaccacgccaggcuaauuuuuguauuuuuaguagagacgaggcuucgcuauguuggcuaggcuggucuugaacucaugaccucagguggucugcccaccucagccucccaaaguguugggauuacaggcgugagccagugcccagcuguuaggcuauauauucuuaaaagagauuauccuguauuuguuaccuagcauuguuacauaagugcuauauguauaaucaagauauuuguuaaagaagauaacccaaauuuuaguauuuuccucuaguaacauuauuugaaaaauuaucauaaaaugcuuaaguauugaaagccccaguucuauggguuguuacuaucaaacauuucaauuuuuuuuucuuauacucuuguguaagagaggaacuauuauauaauaucauaaaauaaugguuaggaguuauacucuggagccauauugauuaugcuacuucugcuacuuacuaugaccuuaacuaacgauacuacuuaaccucugucuccuuggguuucuugcacuauaaagugggaacaauaacaguacuuagugugaaguaaauaauuuauguaaagcucuuagaacaauggcaauaguaaacgcuacauauaguguuagcuguaccuauaggcacuauaauaucuauauguauucuaauguaccuaguaccuauacuaccucuucuguaguaccuguaguauaguauauaguacugaguguuuagaaugcauuaaauguauuuauagauguugauuauuccacgaguauuuauuguuucaguuuauuagcuuucaacauaguuggcugucacugaauguuccauauuuuauucagccuuuuaaugacuuuuucuuuuuuuauugcuuaauagaauugcuuaauuuuuccuauuauuuaauaacuaagacaauauauuucgauagcuauguuuaauaguguuauuuuguuauugaaaucauggugauuuuauucuugguucauucauuauuuucauuaauuccuucagcuuaaagaauuaaaaggaauucauguugccauacccucuaccaagagaaaacauuuuaaaguucuugccucucuguaugagcauuggcuguaaacuucaauguuaauucauugaugguuuuuauaacaaaaccauagaacaauugagguauaguauuuuuuucuucuucuucuuuggagacaaagucucacuccauugcccagguuggaaugcaguggcacaaacacgguucacugcagcuucagaacuccuaggcucaagcaguccucccaccucaggcucuugaguagcugggacuacaagugcacaccaccacgccagcuaauuuuuuauuuuuuguagagaugaagucuuccucugguguccaggcuggucuugaacuccuggcuccagugauccuccugccucagccucccaaaguacugugauuacaggugugagccaccaugccuggccuauuuuuuucuuuauaaaguaaaauaaugauauagccaauuuugugcuaaucuauuaaaacauuuauauaagguuacguauccauugauuugauuucucauauauuguacacuguuuuuuaaaaagaaagcuaauaguugcuuaggggugggaagauagagauuccuuuucuugugaggcaguaacucuuagcuuaacccucccaccugucuaaauggauauuuuggggauacagaaaaaaaaguuaguggauaauaguauauaagccaaacuuuguuuuaaagaguuugccacuagauuuuaucaaaaacauagcauggccugcaaguacuguuucuaauuauaugagacuguauuuuuuaagauaguccacuuugugacaagaucaagauauuaacuaauaaaaacagacuuuuacucugcagacacuauuguugaugauuccuuauaaccauaauuugguuugggaacuuaaagaaguuuuacuuuuguucuuuucgucagauauuccuuagagcaggagauggcaaacuuuuucuguuaaaggaucagauaguaaauauuuuaggguuggugggccaugugguuguugucucaacucugccuugguagcugaaaacagccacagacaacauggaaaugaauguguguggcuguguuccaauaaaacugucuucacaaaaauagauccaggaugaaagggaauuucauccacaagccgaccacggcauucgaguauaaaauuuauuucuugugguccuuuugauaaaaauuucagauauaaucuauuuccuuuaugaacagaucuuuuaauuuaggcuaacugacuuaaaugugaauguuccuagauaagccaacauuagcuuuuuaugucauaguaauuuuguuauucuacuuugaaagaaauagaaaugacuuggacuuuguggagucauuuaagaacaaaauuuguaccuaauuguaccugacugcuuugugacuggaagaauuauuuuacaucucggagcuucaguuuuuccauuuauaaaacaggaauaaguauagcuaucccguaggguuguuauauuuuccauuuagcugucuuuaucaauucaauuuagcaagguuacuuuuaaaaagaaagcuaauaauugucauuauuagaaagcuaauaaaaguaauuaacuugugcuucuuucagaaccuaggaaagaacugcccagaaaugagcgccucuacccuuguuauacugaggaaucaaagcuggaauuucaaaauauuuuaacuuuuaugucaguuuuugugacauuuuuauauuucuauuagugcuugacuuuuuaguuuuacgguuuuucuuggacagauuauagcaugguaaaaauaacagaguaaaauuuuagaucuguguuuaucaauggaagccugcuccagagucugcaagaacuauaguucaucaccugacagcuuauaagaaaagcagauuguuuguaaauuacauuacuauuauauaccccauauaaucuuugacuggaaguugguaacaucauuagguggauguuagcauacugaaauguuacuuguucaucuuuacaaaacaaaucauguuuggaaugagaaaacaaccuuuagaugcaguauauauccugaacauacuugaguauaaauuuuuagcuaacauagggaagcauaguaaaguauauccuuuguaacuucgcaacucaaggacaaaaugaaaggucauucauugaaucuaguaaagguacauaauuaacccuagcuuucucacuauaagguuuauaaauuaguacucuccaauaggauuuuucaggggaggagcgacauuugugacauugguaggauaggguacaugguaugcuuuauuaaauuguauaaacuuagguuuuaaaggcauaagccaacagcuuugcaaauauguauuuuuuuuuaauggcaaaaguuaacaccugaagugaagagugaagucaggcuauauggauaauggaauuugauaugauguuacauuuuacgacuaaguguggcuauuuguuuaguauucuucauuuauguugcuaguucuuauagggcuuaugguuaccuccuuagcacuacauugagauucuguuguuugaaagcuuaauuuuuaaaaagauguaaauaucuuuuaaaggcuaagagaaugaaaggauuugcuuuacauuuuaaugaaacaaauuuauuagguuggugcaaaaguaaucaugguuuuugcuauguuaaaaaauggcaaaaaccaugauuacuuuuucauccuaauacaauugacauuaaauacuuaauaaauuauauaaaacaauauuuacaguaaaaauuucaaaaccuuaauauucucuagcuuucaugcuaaaagugcaggcgccuguagucccagcuacuugggaggcugaggcaggagaauggugugaaccugggaggcggagcuugcagugagccgagaucgugcugcugcacuccagccugggcaacagagcgagacuccgucuuaagaaaaaaaaaaauggaaaucucagccuggcauuguggcaugcgccuguaaucccagcuacuuugcaggcugaggcaggaggaucucuugagcccaggaguugaagaccauccugggcaacauagcaaggcccagucucucucucucaaaaaaaaaaaaaaucucucuuaaguuuauauaccuaccuucuuaaauagaguaugagucugauuuauacuuuuccucucauuaaaaauauugagugucuguugugugcaaggugcugugcuaguagacaaggaguugugaugagcauucuuaaaaucuguaauauguaauaugaagaaaaacuagaagugcugugagagcauaaaauaggauuauccuuaaucuagauggaguucagguggggcuuucugaagcaguaauguucugacugagauaaaagaugagugguaauuaagcagacgaagggggaagagguguugcuagcagagucuuuuauaaagaccccuagugugaaagaagcaggguauacuggagaaacuagaaguccaguccagaaguccagaaaugagcccggagaucaaggagugaagaguaguggaaguagaguucagagacugucgaauguuguaggacaguuuagauuuuguucuuuacccucagaguagugggaagucauuaaaguguuuuaaagggacaauugauagaucagauuugcauuuuuaaaagauuccucugacagcuguugggagaacagaaugaaauggggcaagaaugaaguggaggaaacaaagccaagggaugguucuugaaugagaguggcugaagaagaaauaaagagaaaucaacagauucaagauauaguuaguagauaacauuuuuuggaguugauagauguuagggguuugggagaaaguugucauggaggacuuccagguuucuuccuuccacaauuggaaagcuaugaugcauuugcuaagaugaaacaaccuuacaaagagaacuagagauaggggaugggaauggguccugaguucaguuuuggaccucuugaacacaggcaauucuugaugaauuugagaggggaaaaaagaggcagcagcuagaggggaacguggggcagaagguuuuuaaaaugugugagauacuuggacauguuaaaaugcugaagagaaggaaagauccaaaugaagugagggaagucucaaaauuggugcaagggaagggguaaaucaaaggaacaguccuuaagaaggguuagcaagaacauaccuaaguggaauuauuguucuuaaauauuaaauaagaggugcaauaccucuaguguuuuaacaagagaaaguaagaagcaagcuguauaaauguaguacauauuuaguaagugggaauuguuuucccugagguauggaacugucauuuggaggugaggaagggacauaggaaucaguagcuugagaagaggggaaauuugaaauaguuauggugacuagugaauugagaaacauaguagguuuuuuuggcagcauugagagaauuuuuaaaaaguuaauaucauuuaauauuaucuuaaguaaaucacaugugaaggaaaacagcaagaaaguggacucuacuuagcagaagaggucacuuaacuuuuaagugguccuuaaacuuuuaaguauuggcauuaauuugccaagaccuugugcuacccugauguuaaaguagggaugcuguuugcagugccacaaauauagcugcuguauauccuuaucguaguauaugauuucaccuaacuuuuaguguuauuuauauguuaguuaggccucguuuguuucuaacugauacucuuuuuuuuuuuuuuuuuuuucuaucuaggcaggcagaaguccugaaggcugacaugacagguauuggcuggcuuauuucuuuuucacaacauauuuuauauauuaaauuaauggaaggauauccucuuucuuauauuaugcacagcacuaaaucccaucuuaguugccaaaagggaugaucauuuacuaucugcuuuaaauauuuauuguuuauguaguuugaauucuugcuuaaauaacuguugggaauugcauguaauacuaauauaugguauacugaauugaauguuaccuaauuuaguuuauauaaucacuuaauuuuuaugaaacuuuuuauuaaugauuuaagacauacagaaaaaauaacauaccccauauaaaccaaaauaucuuacaguguuaggcuaauaucuuucugggaaauuuuuuuuucuauuaauaauuaaccaaacuuuaguagguaaaccuucagaaaaaauauuuauagaaaaauucuauuggaaguccuugaaauugagugagcuaccuugcugccuuucuuuucucccauaucuuuguuacuuuuuuuuuuuuuuuuuuuugagauggagucucacucugucaccuaggcuagaaugcaguggcgugaucucggcucacuguaaccuccgccucccugguucaagcgauucuccugccucagccuccugaguaggugugauuauaggcacacgccauuacaucugacuaauuuuuguauuuuugguagagauggggauucaccauguuggucaggcuggucucgaacuccugacuucaugauccuccugccucagccucccaaagugcugggauuauaggcgugagccacugcgccuggccaucuuuguugcuuuaaauaauggcugaggucuuuuggaagaauaacugccaggcuuagccauugaaaggaguaaaugaggcauggugcgguggcucacgccuguaaucccagcacuuuuggaagcccaggugaguggaucaccugaggccaagaguucgagaccagucuggccaacauagugaaaccccgucuguauuaaaaauacaaaaauuagcugggcgugguggcaugcaccugcaaucccagcuacucuggaggcugaggcaggagaaucacuuuaacuggggagguggagguugcagugagcagagaucaaaccccugcacuccagccugggcgacagaaaaagacuccgucucaaaaaaaaaaaaaaaaaaaaagaguaaaugauuuaaauacgaaauuaggaaauauguuguaaucaccguauacuggucaguaugcccuccguaacagcauaugccauccuaaaauguaauaagaaggauagguacuagugaaucuuauucuaauuucucaauaauuuaguucugcagugaaauucacaaaaaaaaaaaaaaaaagaauuaaacagcauaccugccaagauuugcaaagaggaaaaggacuauuaaaauaucuuuuugucagcucuagagucacuuaggcuaauguccuaagaguucauggauaaucucgugucaucuuguucaaggaaaaguguguuggggggugaauagcuuguauauuuacucaguaaaagguacuacucaguucuuuccauuauuaacagauuugucaucaucuauauuguguauaucagugucugcucugaguuacuguauuaugcucuugaauuggcauugaaaacauaaucuauugugugaugaaaacagaacauggagcaauaucaggcuaucuguaccauuuaccuuuucuuagacauugaacaaccuuaguaaauagucuuaggguuugaccuuuauaggggaccuuuggcugcccagaaacuuuaacuaagauaaugucugcucauuugaaugauggucuugauagaugagaauuaguaaucuuuuacacuucuuuuucuugccauaagugaauuaaagcaggguugacuaaaucuauuaguuagugauuaacaauuuaacuagggaugaggagcugauaguaaacucuauucuuaacuagccuguaaacucuuaggagcauuaacucaaauccaggagauucucuuugcaaaauaggauugugguggcuauagaugcuaauagcaaaccuaaagaagagugaugauuauuccauuguguaguagcaaaacgaaguagcccagcuaguuaugggaaauauauaauugaaaagcccauuauuaaguucaccuacugagggaguuuacugucaguuauugcaaucauaaucccagugauugcaaagguuaaugugccuugcaugacucuggcagacagcauggccccaauuuuguauuauguguagucauagccugacuuucugauuacauucuacacccagucucucaucugaccucuuuagcaauuuaauccuagucuucuaagucuuuguuuacauuaaaugacuaauguggauugcucacaaaaguaucuuaggaaacagucuaccgcucauuaaaauaauacugucauggcuuauucggucaauauauugagagaggaguaacugcagaauaccaaagcaacugcuagauaaucagcugaugugagaauucuguaaggacauuugugggaguccuuacagagacucccuuacagagacaaaaaagaaagaaaaaguugcuuuggaaaaagagauacaguaugagaguaaacagaccaacuugacagucuguuauuucaaauggguuggcuuacuguaaggcauauaguuuccuguuauaugaaaaggcagaaauacaaacaaaaagcaaagggcaaaccauucuuuuuuuuuuuuuuuuuuagcccuuuucauuucaugauauuauuucaaaacuaaaaacagaagcauuguaaaccagacuuagucauuagucaaaaguugaaagucauuugaaauauaguaguauaaaacuucugcagcauucuauggaauauauuuagagcagguuuugccuuggggauagagcaggaaggagucacuggugugguauaaugguuuuaacugcugggguuuaucuaucuaccguuauguuuuuguuuuuguuacucagauucuaagcuggguccagcugaagucuggacauccaggcaggcucugcaggaccuguaccagaaaaugcuaguuaccgauuuggaauacgcuuuagacaagaaaguagaacaggaucuguaaguauuaccuaucauuugagaagucccuguaagaucaagaauuucaccgagacuuuaaaacaguuugguucguuauuuauuuuucaaccuguugcagaauaaacuuuuucaauggaaaguaauucuaguauuugugauauuuggccauugguauuauuucaaauacagucuuuggaggagguaagaagagaaauguuuagaguugaauucuauuaaggucauuacggcagcucuuuuagggccugucaaaaaaaacaaauauaucuauuucaaauacuaagaguguuuggauugucuguggucagucuuauaauuaagccgcgauuuaaaaaaaaaauacaagaauaggcuuuagaaaaaucuuucuuuguuaaacgugauucuauaauuucccugucaggaaaauguauuugcauuguaaggaaaguuccuucuuuuaauuaaauaaguugguaguauuuccuccccuacccccaauaaaaugaaaaauuuuguguauuuagacuuuuccgcuucuucuuucuauaaggggcaaaauggcagauaaccagauucccaagugaguaauugucuuuuguggaaggcuuugccuuacaaauuggaacagggacauuagccugauagaaauuuaaaaaucaauuaagaguacuuugucuacuaauguccguuacccuaaguuuuggugaagauuaguuuuuucuaucauuuacaucugccuuagauacuuuauauuuuuaggaagucgaguaauacagcuaaauuacgaccaucaaaauccuuauccugugauguuagagucaaggauaagaugucaucagaaaugcugagggaagugauuguccuccuaagucauuaaaaagccuagugcucuagagccucagaagcugauguugauauagaauuagguacuuccaugcuuuccagguaaguuguaaaccucuuaucuguguuugcuuccuuuaaucaggccaguaauaucuucccuuuguucuaguuuuuuauuccccacugugguuuccaggugagagagugacuguauucaucauaacuggacuuaaacugauuccauauauaacuagauuaaagaaaagcauuuuauaacaggauuuugguaugccauauuucagcauuauauuguuucuuauuguaaauagccaaauuugaaauguggcuuauguuucaaucacaagagaaauaaacaaaacuauuaaauagcagugaaacugaaugcucugggaaauaacuuuuggggaaguaagagauauggcuuacuauuuacaaaaucccugcccccauauacaugucacuuguuaggguauaguccaucacauuuggcacuauauguagaaauuuguuaauaccuuauuuuuacuuugaucuugccaccauuguucugaauuucuaccgggauuccuaaauaaacucuaguaguucuaaaagauuaauagcugaagccacaaucugauuauucgaacauuugguaaguguuuacuaaggucaguuggauucuacugcaugucuagucuuguucaaagggaagcauaaaguuauuuaaauaaaugaauaacuuuaaugcagguuuacugucucgugugguauaauuauaacagacaguucuuucuuguucucagggggaccagugucugcccagugagucacugcuauaccaaauagaauuacauuuuguuuucagcuggaaucacgccuuuaagaaucagaucacaacacugcaaggccaggcaaagaaucgagcaaauccgaaucggagugaaguucaggcaaaccuuucucuguuccuagaggcagcuaguggcuucuauacucaggugaguucugcauuguauaccaguuuucuuacuauuagugguaaauauucugcucuuuguacacgucuuaaugcauguaaacaauucuuguaaccacuaugugggccauccagggauugaucaccuauaaucuuuucuuuuuuggcgacagagucugacuuugucaccccaggcuggaguguaguggugccgucauggcuuccugcagccucagccucccugacugaagugauccucucaccucagccuuccccaguagcugggacuaaggugcaugccaacacgccugacuaauuuuuguauuuuuuguagagauggagucucgcuauguugcccaugcuagucuugaauuccugggcucaagugauccgcccaccucagccuaccaaagugcugggauugcauaccugagccacugugcccagccuauaaucucaaugcaaauguccauaagaccuuuaaaaaaaaaaacgcugugcuuuuaaaaggguugauguuuagcuuaaagguuggaaguuuaacuguaugaauauaaaagggauaauugagcacaaagccuuagugaaacaguggaaguagucaguuacaagugguauuagaggaaaugugaauuuauggauauagcuauagucauuaaaauaauagcuauguugcgccagauaagaaauagucaaaauuuguaauaucaagugaguuuucauaguauuauuuauacaauggaauuuaucuggauuuugagauguuauuaaacuaagaaguagaguagcuuuuccucuguuugaauaauaagcuauuauucauuguccccagagauuuucuuuuuccuuagucacguccugauagaacuucuaaaucaggcaagguaagagaauaaauaaaucuuauuuuugaccaugggauuuucuuuaagcagaaucuguuagaaaauuaccaugucauccauuuguaauagcauuuguaauuaacaaaauuuuuguauauaaauuaguaucuuauaaugaauguuaagacaggguuuugagaaucuugcacugaaagaaaucuuuggccaguucuuacuauauaguacugccugacuauugcugccuauauuuuggcuucauucugauuuuaucauuucuuugaaugaagagaaaagaaucucugcugggugcaguggcucaggccuguaaucacaacacuuugggaagccaaggugggaggaucacuugagcccaggaauucaagcagguuguggugcuaccugccuguaaucccagcuacucuggaggcugaggcaggaggaucacuugagcccaggaguuugaggcugcagugaaccgugauugugccacuguacuccagccagagcaacagagcaagaccugucucaaaaaaaagaaucccuguguuggaacaauucagauaacugucauuucugagauuauuuauguuuuacuuagacuaaaacauucaucacaguucauuuuugaaagaacucaaguaugguucuuagucucaaaauuuauuuuaaaauuuaugccaacuuuuagcagcaaccaaaaaguugauacuuuuuggggaaugcuucucgagagagggauugguccuuaaagcagauguuaaagauuaauucauuuuacaaguagcugucaaaaggcuacuauuuguaaggcacgauacuagaugcugaggauauggagguaaauuagacagaaucuuuaccuucaaagaaauaucuagacuaaaugaaaagauggauacauuaguaaguauauuuguuuucuuuucugauuguaaaaauaaugcauaccaauuucaagaaauuugugaauuauacaaagucccaaaaaguucauuaauccucccauucuggauaaauugccacuuuaauauauacucuucuuguguuucuauacuuuuuugcauauuuaagaccacacuauauauccauuuuuguaucuguuuuauaaacauaauguaagcuuuuccuuguuaacaguuuagcauuuuuguguauaaagcauuuucucuaauacuguauuauuuccugaggaccaguuguucaaauugaaaucauuagaaaguuuaaagugaaaguuuaaauacuguugacaccauuuugucguuuucccaaaaguucaucauuuauaacauuuuucacuaguuucuucuguuguccuuucauuuuauuuagaguuguuugaaguacagaaguuaccaggauuuuuuuuuuuuugcaauaccuuuuccuuuguccauagaucagugcauauuuaauaaugagggaaauaaucacauuuaaggaaacaaauagauauuauaauucaaaucuuaacauuuggaaacaacaccaauguucuacaagagaauaauaguuaaauuauggcauaacuguagaauggaaacacaaaaugauuacagguugauauuuaucaagauuuuauaagaugaaaagauuguuuuguuguuguuaagugaaaaucauauaaaauuauauauauauaauuugauucuacauguuaauugaguagucucaguucagugggauauuaaugaaaaugguaacuuuuuuuucaaucacugcuuucaacuaugcucuguuggauucccagauucccaucauuucuuggacagauucuauaacauucugguugcuuuccauuuuugaagcauaauucaguuuuaaaaccuuaguuuuguuucugauucaaaucucauuuccuucccccaugaauagaagcuagaacugggaacaugacuaaaguagggggaguaggaaggagguggugcagcuggcucuguuggggggagggggaaggcaucuaccuucugcaguacauuuuuauaauagccauuauacagauugguuugucaucuugaaaaaugauucuuaaucuuuuuucguuacaugacauacaugugauauauucccaaggguuuaacuagaaauugguaaaccaaaacagaucuguaaggaaguaaagaaagaaucaucauuuuuauugagggaguaugguauuuguaaaaacauuuuauaagcaagggaauaauaaaaucauguaaaugucucaaaaauuguuuuuuaaagggaaaauauggauacucucugaaauuuuuuuaaaacuuuuuauaauaagcauugauucuccccgacugcauuccacaggcagugauugagcaauuaugauaauuguagaauaagcaucaauaaacgucuuuauuuucacauuaugauaucaguuaacaauauuaauagaauuuuucacuugcuuuuuuuuuuuuuuuuuuaagacagagucuugcucuguugcccaggcuggaggcuggagugcaguggcacaaucucugccacuggagugcaguggcgcucacugcaaccuccgccuccuggguucaagcgauucuucugccucagccuccugaauagcugggauuacaggugcgcaccaucacauccagcuaauuuuuguauuuuuaguagagauggacuuucgccauguuggccaggcuggucucaaacuucugaccucaggugauccacccaccucugccuccccuaagugcugggauuacaggcgugagccacugcaccuggccucacuugcauuuuuauauugucuuuaaucaauaauugaaacggauaaugguguuacuaacaauaguguuccacaaaucuuucuugauuacaugcagugcauauuuagcaccagauugagaaaguagacaaauuccagauuguuauauggccuuauaagcuaagaugaguuuugaauuuuaauuuuaaguguaguugcaggccaggcaugguggcucauuccuguaauccugacacuuugggaagcugagaugggaggaucacuugagaccagccuggguaacguggugagacccuauucuacaaagaaucuaaaaaucaaccaggcacgguggcgcacaccuguaguaccagcuacucuaggaagcugaggcaggaggaucacuugagcccaggagguugagguugcagugagccauauuugcgccaccugccugggugacagagugagaccuugucucaaaaaaaaaaaaaaaagaaggaguugcaagucacuggaguuggaaaguaagcaaaggaagaacaugaucagauuugcauuuuuaaacgauaacccuggauaaagggaucagcuauggaagcuagcuauggaaguuaacucuauuaauuccuguuggccauacuuggauuagauggauuggauugaauuucuggaaucagaguaaaggaggagucaaagcaaauacaauuaucagugugagcagcuagucgagugguuguaccauuuacugagaugggaaacacuagggggaaaguagcuuuuucccuauuaaaguagaugccuguuugacaucuaaguagagauuugaaauaagcaauugaauaaacaagguuggagcccaguggaaacaucauaaaaucauaaaaauuuuaugauuauaguaaagaacccugacuuagucagaugguaacagauuuagcacaggaggagccaccauugcaaucaagaaaaugagagagagaaggugccuuggaagccaagagaaaaacaucugaauaaggaagggagucaucagcccuguugagugcugcugagaauuaaaguaagauuuaaagugaccaauuagguuugacaacaugaaagucauuggugaacuuaaugaauaccauauuucuucauuucugaaacuuuuuuuuucauauuuuaacauaucugaaauagagauaaguuuauaacagaugacaagugaccauauaacuugugguuuuuucucaauauuauauaagaugaugguucaucuuauaauuuauggugucuuuguauugaugaaauguaacuucagcaguguuggggauagaaaccugauuagaguggauugagaagagacuaguacuugguuauccacaguaacauuuucugugaagauaguuuuuuaguuuuuuguuuuuuuuuuuuaaagacaggcgcucacucuaucauuuuggcugaguacggugcuuaaucauagcucacugaagccucagacuccuuggcucaagugauccuuccccaccucagccucccaaauaccuaggacuacaggcucauaccagcuaccuuuuuuuauuuuuuguagaauggagucucacuauguuacccaggcugguuuaguuuuaacuucuuagcuaccauuuuguuaaccaguuaaagcauggggcuuaaagcagaaccaaauuccuggucaaaguaaagacauaccauucugcuguagguuguuuuuaaacaucaaagaacagaacgguagccuuuauucuaagaaaauaggaaccaaaaagaaaguauaaucacugaguuucuguauuaguuuaaaagguaauauucuauaccuucauaaucaaucuuucauucuuggcauggaauaaagagcugaggagacaagagauaguguaaaaauugauaaauaggaacccagaaacuguucuaguacugcucuagggcuaauugugacuauuuggacaagucacuaccucuguggugcuuagcuuucugauuguaaaaaagagaguugacaaaugcuuauagguucauuuuccaguuuuauaguuccaugauuauaauuugggaagaacuagaggcauuaauauucagcuacagccuuaggaauaucucccagucaauacuucuguauaaugaaguaacuaaguucuuaucagacugaggaaacuacuacaaaguaauguacaucagggucaaccuauaugaagguaggacauuguuuuguucaauuuaugaaacauccuuuucucuucuuuaguuccaucuuguuacugccucuaaaccaacuagagcucucuuucucagaaucuuugagccaguaggagcuuuucugucugauaucaccacuuaaacucuugggcucaggcagaaauuuuauuacaagacauucuacaugauguuccaaccauaauuuuauuuauuuuuugugaucuuucuuuuuuguuuuugcuagaugugcagccuugccuaguuuuccagucuguuuuuucauuaccuauugaagucaguucuuuaacccucucauguuucuuaguuauccacuuuuguuuuuuguuuuuuucauaauauauauguagguauauauauauuuacauauauauauuuuuuuuguuccugcccugugccuugugcuuuuucuauuucuuaacccaucccguucaggacauuaacuuauuuacccuguuuuuuuauguauucauuuuauuuuauuuuauuuauucauuuuuuaagacggggucucucucugucacccaggcuggagugcaguguauaucauagcucacugcggccuggaacucuggggcuuaagugagccucccgccucacccuuccaaaguacggggacuauagcacugcaugccaccacacguggcuaauuuuuuguuucacuuuauuuucauuuuuauauucauucauuuguuuauuuuguagagacagauucuugcuuugcuguccaggcuggucuugaacuccugaccucaagugauccuuccgccuugaccucccaaaguguugggauuacaggcaugagcuaccaugccuggccuuguuuacccaauuuuauguuagugaauuucuugcccauuacaaauguacaaguaaagauggaguaaauaauuuccaugcccagugagaaagggugcgcagaauuuauauuuaguuauggaggugauuuuuaucuuaggaaaaagguggcaugauucagauccuucugaguugagcccuuagggugucuuauuuuguauuuugaauucuguacaugcuagaaagaguggugauagaaucaaaauauuucuaauucuauaaccuuaguccagucgcuugauuauuucugccuucacauccucaucugaaaaaaauugagcuuuauaucuauguauacuguguugcuacuaguuuaucacaaggauaaagugagacaaauuuaucagauaaccuagggaaauaaguuacguuauaaauguagaauauucuguugguuauauugugugucauguugucuguccuucucuccuuucccuuuucccucucccucccucucuccccucuacuucucuuuuuguaccugacuugcccauuuagcuacaagcucaugaaggaaacauauuuucuuacuugucuuuguaucuuucuuguuuacugggugucugauauacuagcacauacuuggaugaauauaauaauauuugaaugacgauauuuguaaguaaauauuugaauaacugugaaguaaauauucuucacagugugaagaacugugugcggggcaagaaauaagcccuuggcaagcaaagugagaggagaaaagccuuucuaugaaggagacugaaaaggagugauuggagagaugacagagaacuagaacagcucaguaaucaaccauaagaucagauguuuuaagugcagcaaagagguccaauaagaugaugucugaaaaauauccguuguauuuggcuauuagguaaccaauugucugauaguaguuucaguagagugguaauggaugguugggugagaggagggagagggguuguguggaagccagaugauaauggauuaaggaguaaauagaaauugagaaagcagauaugaaaaguguggacuccuuugaaggcauuugguugagaagaaggagagacauuaaaagguugcuauaaagucaagaggagaguguuuuagcucuguuuuguuuuuuguucuuguuuuuuucugugggagacgugguguguaggccauaggaaagaagcaugaaaaguugacaguagaugaaagaauggagaggugggagacagacaggaaccagaaaagaauguagcaauaggcacacauaggcagaagaguuagcucugacuaggaagaagagccccucauacuuuaagaacagagaagagaggagguaggaaugggugauacaguaaagguguacacuacggugagauucguuguauaugcaaagacaugugaauuggcauacagcuuaagaaaauaaauugcaagaaauaccuaaagucugacaaauaccuuggcuuacauuuaagucaaauuuguaaccaauauuuaauaauuuuuggguuucugagaguaguagcuuucuuugcuugcuuaaugugucugaaaaucgugucugaaaauccuauccaguuaaauaaucuuuuuuuaaaaugcugcuguaugcacauccuagauugcuguaauacuugagaauucaaaagguaugauuuauaaugaaugauacuaguuauccugugaaagauuaacguauaauauauauauauauauauauuuuuuuuuuuggagacagucuugcucucucacccaggcuggagugcaguggcgugaucucggcucacugcaaccuccgccuccuggguucaagcgauucuugugccucagccucccuuguagcugagacuacaggugcucaccaccacucccggcugauuuuuuuuuuguauuuuuaguagagacgggguuucaucauguuggccaggcuggucucaaacuccugagcucaagugauccgcccgccuuggccuccuaaagugcugggauuauaggcgugagccccugugccaggcccgaaagauuaccauauaauuuucaugcaguuuuuguucagauuucagcaguaugugguacuagguacacaucuuacaguuuauaaacuuuacuuuuagagcacuugugacuuacuacuaaauuuuguuuguuuuucuuuuaguuauuacaagaacuguguacaguauuuaauguagauuuaccaugccgugugaagucuucccaauugggaauuaucagcaauaaacagacgcauaccagcgccauagugaagccacagucuagcuccuguuccuauaucugccagcacugccucguccaccuuggagacauuggugagccuuugcugugaaggaauugauaauauguuccuccuuuucuuuggaauagucauagaaagaaacuguuuuccuuuaagcggagcauacacacacaauuuagauugucauaagaagaaacuauaaaauguauucuaaggaacuuaaaauuucucaauauuuuugggauuggcagagcaucgugaagaaaguaacuuucauauuaagauuuaaauuuuauuccaacuuuauguaauuuauauaggcaaauaauaaacagcaaaaacauaaucaaagcuuaauuuuucaaaguggugccauaauuucuaaauuaaauguacucuucuggaauaaaugagguuuauaaauuacuccugaagcgaaauugccuucuuucuuucuuaccaauggacuaaaaguugauuuuuaauuuugcuuccuuuuuaaaguuuaauuuguauuucuauuauuugcauuuuaucugggaauauuauauaacuuauuuauucuuguucauuccuuuaaggugaccuagaaagguuguaaaacaaauuaacuauaggauuauguuuugcuuguccucaaauaacaaagaauggagaacauuacugcuuuuaaguuugaaauuuuagauuucuuaauauuguaagucagcgguuccaugaggaggucacaucagaguaagcagugaguuuggcagggagauucauugauacuguguuuagguuguuuugcuuuaaauauaaucuuugcacacacauauuuaauauugcaauaggaaugagacauuuuucaaaaucacuuuauaaaauauugaaaaauacauaauuuucagaucauauuguauaguguauuuuguuuuguuuuguuuuuaagugccauauaacucaccccuucuugugggccggcuccaggucaccagcauaguccauagugggagcuggugaugcaugacacuggaggaccugaaaauggggucuagguaagcuuuaaaauugguuacaugcugaaugucccaaauaaggaaggcugauggacacuucacacauaauccuauaguuaauuuguuuuaaaguauuuugucuuuaauuuuaaauuaacuuuaaugucuuuauuaucuuuagaacuuaaaacuauagcuguuuuggaaauacuacccuacuguuuguuuuuuggguuuuuuaaaacuaauuuucuucuucuuagcucgauacagaaaccagaccagccaggcagaguccuacuauaggcaugcagcucagcuuguccccuccaauggugaguggaccugucaaccugagauugaccgugacacuuuguucuuuauaacaauguggcagauaacucagggcucaccuuugaaguuuuaugaaagcaauaaaugaguuuuguuauugucauguuuuuccauuuaacuguacauuccauguaaacuaaaaugaauuuuuuuuacaaguaagaugacuuuuauuauuuauuuuauuuuauuauuuauuauugucaguaaagcaauauagauagaaucucuuaauguaaucugauauuguuucuacaacucuggcuuccuuaauugcuuauagaauaauuauuucuuuagauaccaccauuccccuccccccagaaaaacaaucuauuaccuaaaagauaaucuuuuaauggccccaaacuaggcauuagcaguaguucuugaguuacagaaauuacagcagauauuuaauuauuuaaaucauucuuacuaagacguugaaauuccuuuagauucuagaaagagucuaaagcagggaugauagucugaccacacuacuuguuucauauuuguuuauggcugcuuucacacuacaguggcagaguugagugguugugauagagacccuuuggccuacaaaacugaaauuauuuauaaucuagcccuugcugaagccgcucucuacccuaauauugacuguuuaaccuguauaugauaguguguacugucgcugaagugugcuguuggaccuuacgcugguuugcaaugaggcagucauauuuaccuuauaaaaauacuccccauuguuugaguauuuaaacacugaucauuuguauucuuauagcaagacuuugucacucuugggguuacuccagaaucuuaacuuucuccuguaggucagccuuauaaucaguuggcuaucuuagcuucuuccaaaggagaccaucugaccacaauuuucuacuacugcagaagcauugcugugaaguucccuuucccagcugccuccacuaaucugcaaaaagcacuuucuaaagcacuggaaagguaggguuguuugguuuuuuuuuucucuuuccaagaggacuuuguaaccuggagccuuaauuccucauaauuugguuuacagaaaauaacggccuaugcuucucuuauuucuaaacauauagauuuuucauaauuuguguauagucacugaauuucauccaaucaauaucugauucagucccaguaaaagaguacacaggcuguuaauacugacucaucuugaguguguugcaguugaaaaaucagucaaauacagcucuuuuguguaucaaguauuuagcaagccagugccuccuuaaacaguuguagccaauuugcugcuuaugauucauggaauuuuuuucuuucauuucagccgagaugaggugaaaaccaagugggguguuucugacuucaucaaggccuuuauuaaauuccacggucauguguaccugaguaagagcuuggaaaaguugagcccucuucgagagaaauuggaagaacaguuuaagguuagauuucagaaauagagaauuuuugucuugucuaaaucaggaagcauaacauuuggaggaaacugacucccaguuuuuguaguuacuuaacugugugaacuauugguaaaaauuauauucgaaguaugugaaaucuuugcauuuaucaucccuucaauuuaaacugagguacagucuguauaaacaaauauaauauagcaguguuuucacuugaguaguugccauuugacaaaaauuaucaaaguggaaaaaaauaaauaacuccucaguuuugaaacuacuacuacuuuugaugguuuguguauucuuagauaugauuauguuaccugcuuuauagauauuggcauucuccaaaccaaguucauuauuuuuauugugcuugcauucaucaggauugugguaguuugaaugaaaggaaugagaguuucauuuaacagggauauauuuuacuaauuugaagagauaacauuaaccuucauucuauuuauauaugugaaaaugaucuuuuauuaguauguuaagauauuagcaguuuaaauguauaaugcauaaaauaaggagaaagucaaaaguauuaacuuuuuuucaguucauguauucaaauaaauauuugacuacucaucggucauuguuuuaggcacuguguuaaacaguaaaugacaauuucaaagaacauuuuauauuucuugguuauuucuagguaucuauauacuuggguaauuguguauaacugcuucauaguauuucuguaaguucuuuauaagucaggcauuuuaagagauuguagaacuuggacaguuaaggugucacuuagccaaaaauagucaaugcgaaauaguuuuuacagguaaucgcuuuuugguugauacuuucuaugugcaagauauuagaauagauaauuauaaauagcaauaguuuguuuuguuuuaaaauauacuuagccugugacauaugauguauaagguugggugugugaaaggaacagcuaacuuugucauguccuaggcuguucagccuggaaaagaacaaacaagucuaaauaguuuucauaguaaguauucagacaugugaaggauuauuugaaaagaacauaccuguaucuuuccugaagucaaaacuaaaaucuuaaauuuuaaguugaaaucuauagggggcugaccgugggauguuguggauucuccauuuuggagagcuuaacagucagauugacagccaucuuucuuggauuauuuaagugcaguccuacuaaauaggggauuggacuagaaaacuucuugagauugcuuccagcucugguucugugaaauacucucuaaauugguggugguggguggucccuaccuuaaugagaucuucacuaacuaaguuauucuagucuaaaaaccuaguaaguuuugcauuugguucaaccucaaacacuaacacucucuucacauauauauuucuguaugugaaguucugguaagugugggugggcaguuucuaaaauauacuuugaaguaucauuccagcacucuaaaguuaaacauaaaacauaguaugaggcagaucuauuugaaagcuuacccaguguugaacuagaacauugcuggagugaaauuuuaacauaguggaguaaaauuuccaaaguauuucuaaagcauauguagauaauuaguaucaucaacauguauacuucaguguuucuaacaaccuuuagcuacuaagcagaaauguuuaccaaguugagguccacuaagggauuuaaggccugggaucugggaauugagauguaauacauuuucuguaaguuaaaugugggcuguuuguuaaugguauuuauuucaguauauuucucaacuguaguugaaaguuugaguagcaaaaaucuuaucaguucuaaucugacuuuauuccuuggaagacucucuacaauauaaucuaaauuuuaggaaauuacaacugaauaacuucaaccuuauuucugaauggauagguuguucauucacuaaguguuuauuaaguacccgcuauguaccaugcacuuuucuaggcuuuuagagauauaggggaaaacaugacaaagucuggaccuucaugaacuuauauuaucauuuguuaguacuaggguguauucauauucauuaauacuucugugcauacgcuagaaaauucuuuaaugggcugugacccucuucaguaggauauugccuucuaaaauuaaugccagcggauuuauagauacaggaaauacauuaccauauugugcuuguaagaaacugcuuuuugagaaauacaacuacauauucucauuuuaugccaguauuauuugaauaaacgccagcugauuuagaagguuaguuguagaaacugaaggagaaauuuugugggaaaauucuagagaagagacaggauuucaggaaauuuugaggaaagauuaaugcuugaugucuuuggaaaagggcuaaucauucuagacauauacaaugaaauagauugcaagaagacugacagugugauagaaagaguucauguagaauggaauuauauucucuaaugauaauguaaaagacuucccucuuagaaucguagagcuuacuauggcuauuucagguucuuuauguaaauaaaaacaaaaaucucagaguagucugggcagagacagcuguaaguuucugacaugguaggaucuccugucacugcugguagaacuguaaguaaggauuaucuguuuuccgccauaaugcuagugauaaugaaucccugcucucugcaaaaauuuccccugggcauagaggaagacuggcuauggcuaaaguguaggaugaaacuaggaacuucuguuagaaaaguauuuuugccugcagguaaucuaaaauaauugcagauauuaaaguagaaggguaauuccauugagacaccaacugagagcaucugggugauuuuuuauagugcugguuaacagaucacugugaacacaguuauuagaagguaaaugaaauuugaugaucacgcauguacuucucuaagaggggaaaauaccaguugauaauuuguagaaguaccuauaauacauccuaauguuguuuuaguaugccauuuacccuguguuccagaauauguacuugcuaugccuuguuuauaaaauaaguuuuaauguaucaagccucugaaagaguaaauuuuaugacaaaucugggaagucaugcuuuauguacugggaguucaaaaaauuauuuuuugagucuguugcuuucuagucauuugucccaacuuaauauuuuaauauguauacaucuuguauaaaacaauuucuaaaggauuaaguuguauaaauuuauggaugaacacucaaagacuuuugucaggucauauuuaaaaauauauaguuuccuaggagaaaaaaguuuguugauaaacaauucaaacaacucuguggugucuagauuaauuccuuucaagacaaaaagucaguuugggaaauaauuagacccagucaaaauacugggauugagggcagaaccauuuacucaucuguaauucuauuacacauggugguucuaaaugcagacuaccaguuuaauuucuugugucaaagaugguuccuguucuugauaauauaugcaguacgucugucuucuuuuacagaggcugcuauuccaaaaagcuuucaacucucagcaguuaguucaugucacugucauuaaccuguuucaacuucaucaccuucgugacuuuagcaaugaaaccgagcagcacacuuauagccaagaugagcagcuauguuggacacaguugcuggcccucuuuagugaguauugaauuacuuaacaugugccaucuuuuuugaaaaacaucaucuuaggcauuucaucgauguagcaaagcacagugacauaaaaaagcauaguguauuucuuacacugaaucaggaguucauaauaacuuucaaccccaaguucuauccuuuuaucugcugauacccccucaucaaguuguaacuauaacauuuuuaauaugggaaagaaagcgucuuuuuagaaagaagcuguaagauacucaaguguuaaacagaauauaguagaaggcacauaauauuuuaauuugaacuggcacaguuucauauuucuuaugcuuuuugaauacauuuuuuuuucaagugucuuuucuuggcauccugugcaaguguccucuacagaaugagucucaggaggaguccuacaaugccuauccucuuccagcagucaaggucuccauggacuggcuaagacucagacccagggucuuucaggaggcagugguggaugaaagacaguaguaaguauuuuuagaauuucauguuaacuugugugcuuuguuuguuugauauccauaaauauguaaaaacugccuucuaaaauacaacauuugaacaauagaauacuguauuuucugccgacucucgggaauugaacugaagaccucuuuguacgcuuuucauuuguuuauuugaauucuucaugugaggcuuagucuuaaggauuugugacuccuuguacacucccuuguucccaguugcuguccuggggaaaaggcauuuuucacauuucaaagugaacuugaaguaaaaccaguuuguuucuuaucuauuacaguauuccuuaauuuuuuguuugaguugaagggaagagauuuuuauuccauuuuuuucuguacaugaacuguuugauguugccuuacaguaacacucaauuugaauaauauuuguuuauuugaagcauaaagauugaaaguuauuuugauucucaccauuuucucugucaucucuacucacaguaauucugacagcucuuaggaaccauugauuuuacaaugacaaaugaaaacuuucaguguaccuuugauuauagaaauaaauacuuccaagguggcuuggcaccaaauaggaaguuccuccccugcauauuuugaugguauauuuaaggagaaucucuuugaaaguuuugcuuuguggcccagcauguauauugaccaaggucacaacuuagaaaaugccuuuuuuaagccacauuuaagacccugugggccaagcacuguggcucaugccuguaaucccagcacuuggggaggcugaggcaggcggaucacuugaggucaggaguuugagaccagccuggccaacauggugaaaccccaucucuuuuacuaaaaauacaaaagauauuagccaggcauuguggcauaugccuguaaucccaccacuucgggaggcugagacaggaaaaucgcuugaacccaggaagcagagguugcggugagcugagaucgcgccauuguacuccagccugucucaaaaaaaaaaaaagaaagaccuuauggucugucugcuucauaauugucuuuucucucauguaguuauaagcucuuuccaugauauauugacauuaucaugaauagaguuuaggaacauagcacagcauacuauauacaucuccuuuuaauguuagcauugguuuuaguaauacggauuuucagacauugcuuccuugcauaaaauuuuuauuucuuaacucaggcuauacaguuuuucuacucuuguguacucuagaacucaaauuuauguuuaauucaauauauuauaucaguaauguuacaaaagaagaacugcauguuuuaccauuugcuuauagaguuuuuauauuuauggguaggaauuguuauuuucauuguguuuuguuuuuucuuauuguuguucuuguacagugauccuuuuggcccauucuguguguucccauuucuucucauggcaaaagauguugaaccagaaggaacagcuuuauuggcaaacauuuuuucccuccauuuuuuucugucauuuacucuuuccacuuccuccuaucagauuuaccaaaaucuuuagaauuaugcccuuguagguguuugauucuguguuaaauuauguuaguacucauuuuaaagacuagcaugggauaucacuuuaaaacugaagauuuuuccuugugugucuaauacacuaaaguuauaauguucauuuauaucuuuuaaguaauggaaaaacaaugacuguuucuuuugugaacucagaauuuuauguauauucaaauaaucuucaguuucuuauaucugggccuucucaauuucuagaauuuacuuucccuuguacuuuuuugagaacauacucucuuaagcuaaugaauacauggaauagugauuuuccuuuguagaaaauaguuauaggguaaagcaguauaucauuagguaauccacucaugcgcuuuuucuacaguguuuucucgagagcuuauguguguugcaugaagacauuguacaguauaguauucucuuuuaguuuacugaccuuuuuuuccaacuaucucuuguaaucuguuacaucuccaaagguuuguagcagacguuuauucuucaauauuuguuuauauauuuuuaauauguguauauauuuguugauauuuuuaaaguagcauauucccauauuucagaguguacaacugucccaaauaguuaacuuacaauuuuccguagugugauuauuuacguccaguuucucuauccugggcacuucaccucaugcuuuucuuuuucuuucuuucuuuuuuaauaaaaauugguugauacauauucagagguaagcuucauauuaaggagaaugugauuagacagaugagucuacuguaggaaaaucaaaguaauuguuuccaggccaaaaccaauuauuuuaagcuaauuacuuuaaccaaauaauuuuaagcaacauggcuacuuccacccaucacaucuauuccucaccccagcaaaugaacacucaaacuacuuggauuugucucacuucaaaaaucuugcccugucauauauaauacaucagauuuauaaauugcucuuauguuugaaagauaacagagauuuugauacaaauguuuauauguaaagugauauuuauaaaucuguauccauaauggaaacuuuaacauaccucacucaggaaccaaggacacaguuaacaaauacauauauaguacguacuucugaauaguggaaagaauauguucuaauauuucauguguaagcuuucacaaaaauuguguauuaagaaacagaguuuagaguuaaggcuuuuguaaaaauguggacuuuuuguaccauaaaaaaagaggcauuaucacuuugaacagggaaugugauuugugugguauaaccauacccugucacagauuaaagaacuaacagcggcuuccacaacucauaauguaugugaaagcucuauaaaaacauaguauguuauuucuuugcucagaauuuucucagccuauuucaguuuuccauguuuaaaacugacaaauuauuuucaccauuuguugaauuaggagcaugggaaaugaucuacagugguaguaggucucugucauggaaauuugucccuuuuguuguaucuuuaucauuaucuaguguaucuuugaaaguacauuuuuaaaaauuauacagccuuugaaaugcugaaauaagggaaaaauacauaaaguccaggaccuauagauaccauuuucauggcuuauuaguguucugguuucucuuacauaaaaauaaagucugaacucuuucuuuaauuuacagcauuuggcccugguugauuucucuucugaauaguuuccauccccaugaagaggaccucucaaguauuagugguaagggcuacccuaaccuuguguuguugaugugguucuccaucauuaaugguggcuuaaugccagagaaaaagagguuuuuggugaugaaugauugauuuuaaauucaguaucucagaagugacugugaacucuacauaaguggguggguggaaguagauaauguucucccaguucuucuggcagcuuauucucauuuagcaucauucaaauaggaguucagagaguguaauaccuucagauucuuucauuccuuccuccucauucuuacuauuuuaaaaaaagcaauuaacaugaacauugcucugucaaaguaauacuuacucaucguagaaaauuugguacaaagaaaaagaacacaaaucucccauacagagauaccuuuuacuagucacgauaguauaucuucuucgggccuuuuucuuacguguguacacacacacaggaaaugauucauaucaaauaaaguuuugugccugauuuugaaauuuaguauuauauuguuagcauuuucuuuugucauuaagcauuuugaaaacaugacuuuuacuggcuucauaauauuccauccuauggaagugcuauaaucuauuuacgcacuuucuguugcuuuaaaauuuuccccauuauaaauaaauaaugcugcacugaacaaccucuggcuuggcuucuuucugacuuuuuuuuuccucuuaaauccaugcuccucaggcauuaauuugcacauaaaucaccugaaucuuuuuaaaauacaguuuaugauucaguagguuugaauuagugcccaagauucugcauuucuuacaagcucucagaugaugucaauguuauucaauacuuucaguaaaaagagacagguaaucuaaacauugggcuuacuggauccaagacuaugaauuuuuaagacugcugauuuuuuaaaaagccauucuccucagcauugaguauuaggugaguguuaggggaaugucugugucccaaagauaacaugcagaguuuugacaggugaguuauuuucaucaggaucaugauaaagaagagcagagaacaauaagcauuauaauuucuuucuguauguuaauuuuuaaaaaaauuuagugaacaguauuccaccaaacaacauuuuaauuaaaauguuugcaaauuuugauuuugacccuuuagcgacaccacuuccagaggaguuugaauuacaaggauuuuuggcauugagaccuucuuucagguaggugauagcugaaguaccuuuaucauugccagugauugcaguauuaaaauuagcagagaauugggcuuggauguagaggaaccuuugaucugucccagcuguguguuauuuuuguaacgucaacuaauacugaaaguuguugugaauuggauuuguguaugucacgccuucaauuccuguguaauaaaaauuaaaauguaaccuuuccaucugugcccuugaucccaucccuucucaccucccuaagaaccuugcuccaucuguuauccucucugcauuguauuuccagugucuugucuuucuuuccuuucuuuuuuaaacaacuaauuaucuuuagccuaguaacauuuaagugugccccauucuuuuaaaaagguaaaaugaauuuacaucccucuauuuuccuacguugccuuaucuuuucaucaucaaacuucuuaaaaagaguaguaugcacuuugggaggcggaggcaggugaaucaugaggucaggagaucgagaccauccuggcuaacccggugaaaccccgucucuacuaaaaauacaaaaaaaaaaauuagccgggcaugguggcgggugccuauagucccagcuacccaggaagcugaggcaggagaaucgcuugaacccaggaggcagaggcugcagugagcugagagaucacgccacugcacuccagccugggugacagagugagacuccgucucaaaaaaaaaagaguagcgugggccaaccugacugacuccacuucaacuccugaucauuuucagccuacugugguuuaaacuaucagugccuucuagauaccaaaauccagugacuauagucuuuauccuauugaauuuucuucagcauugaguccgucgauuuccuuccuucaugaaaccuuuuuccuuagcucugugaugcaauuuuucccacccuuagcacucagucuuuuucacuauuucuuuuaaacuacaugccucugaauguuguuguuuuccaggauucuuuucuugcccuuuccuucucacuuuguacauucacccuguuaaucaaauccaucccuaugucucuugaaugguaugucccaaauuuucagcuuugacuucucuugaaguuuggaugcauauucuaacaaucugaccucccuuacgcauuuuaaacuuuaacgugaccaaaaacugagcuuauauuuuccgauuuggucagccaaaaagcaaucuucuuucucuauuuucugucugugccuguggcauuacccaucuauaugaccaagcuagaaaucugaaaaacccuuguuucuauuugucuuucucaccaagccuuuauaauuaugugucugaaaugcuucuuagguucaaguccuuccguuuauuucccuauacauaguucaggcuuuucucaccaguuuaccugaaguauaaaaaccuuccuacguauaguucuucuccuccuauagucuguuucuacacugccuauaguuuuuaaguauggaaauagugauguugcaugacuaauauuuuuauuuacccauucccaguugcuccacugucucuuuuagcuugaugcucaaguuccagcacuauccagcuccuaguuguucagccuuauuuucuuccauuucccccaguauuuauaaacucuauacacuaugugcuauacuugaauagcucacuauuuuuauuccuccacaccuuuguucauguugugccuagaacauuuccuucuccucuacugcccuuccaucaccagccugguaagcacuuagccauaccugucaagguccagcucagguaucacucuaugaaaccuuucagagcuucucagaaggaacucauccuccuuuuacuauauucacuuaauucuuuacauaguucuuauuaugcuuaucagauugaaucauaauuauuuauucccaaagguagggacucuuauuuaucuuuguguccucagcaucuagccuucugccuggcaauucuuaaaucuucuuaaaaaaaaaaaaaguuuaauaaggagaaaucugaaaaaucuuuauuuuuucagguugguuuacccuucugauaucaaugaguuauucuauaugcuuuacgauauuuauacauuuuucugauuuagaaugguccaccacaaaguggauagauuaauauuauuuauuaaaauaggcaccucagagacucuuagcauugccauggucauuucaagcaaauuacuuggcaugcaagauaaauguuuauaaaacuuuauucuuaaaaugauaaaagaaucuuuccuaauaaaaaguugugguuuauuugagcucccugacuagaaagugaaaugugaguaaaaauauuacauuaauguaaugaauuuguauauuuucuuuucugcuuuguuucauaguuuguaaaaaucucugguaguauaaauucuaauaaaugcaguugauuacaucaaguagcuaaccuaugugggaaguaaucugaagccauuacaguuaaucaggugaacuugguugccuggaaaauaucuuuagcaauuuaauauucucauaacuugcuugugucaauuuuaggaacuuggauuuuuccaaaggucaccaggguauuacaggggacaaagaaggccagcaacgacgaauacgacagcaacgcuugaucucuauaggcaaauggauugcugauaaucagccaagguaagucuggaacuucuggucuaccccuuuuuaaccaccuuuuuagauaaacacaugcgcgcacacgcgcgcgcacacacacacaucucauauguuacguauuuuaggcuuugguauaaauauugucaaucaugaacucuuaaaucgacauguugguagcacaacaucuaauuauaacccuagugaguaaguauacucuuuauuuagaaucucuguucucccuauuguguauuacagaggucuuucuuguuuaucgugaguuucugcucuaauuuauaaauaucucuguaaaucuaacugaacuguacuuucacagucaugguaauuuguauuggccugggcaugguagucaguuucaggcaggacagaccaagaucgugcuaguagccaguuaaguacaaagcagauguggucguuaguguagggaaaagaacgcagguuuuguaauuccauugguuugaguuccguuucgaguuccgcagcuucucaaguggguguccuugggaucuccccaguagauuauaaccuuuccaaagucacuaacuacuuccucauuuuuguauucagguuucugucauacaguagguaguuaaaugcuuccauguuugaaugaacuuaccaccuccaagcuucaauuuucacaucuauagaauaggaauuauauauagcuaccuuauaggacauaucaagggcccuagaccagugucuugcacuugaagcaugcucagaaaauguaaauucuagcaaacguugaaagagccagagggauagguugugacgauguuaagugugauaaugagaaccucaguuucuacauaacuacuuuuuguguuaccugaauccacauuguuauauccugcuguuuucaugguuauuagugcuaggaauauauugacuuggauccacacacaauucaguuguuauuuuuuaaguuaauguuuuuuauauauggauuuauuuuugcuuuuuuaggcugauucagugugaaaaugagguagggaaauuguuguuuaucacagaaaucccagaauuaauacuggaagaccccagugaagccaaagagaaccucauucugcaagaaacaucugugauagagucgcuggcugcagaugggagcccagggcuaaaaucagugcuaucuacaagccgaaauuuaagcaacaacugugacacaggagagaagccagugguuaccuucaaagaaaacauuaagacacgagaagugaacagagaccaaggaagaaguuuuccucccaaagaggugagaagggacuauagcaaaggaauaacuguaacuaagaaugauggaaagaaggacaacaacaagaggaaaacugaaaccaagaaaugcaccuuagaaaaguuacaggaaacaggaaagcagaauguggcagugcagguaagcuguauuugaacuauaaagcagguagaggaaggcucacacaaaaggcaagauuuuucauuuuguucuaaagccaugagaauuggccguccuggaaguuuaaaugcauuauuuaauugcauaguaagguuauauaaagagcugugauagaugguuacuuuuucaauucuugggaauugugagugaaaaaaaaaucucagccugauuugacacuuucgucagucuucaccaauuuaagcaguuugaaaggauuaguugcagaguugucaguuucacacaggauuauauuuuauuuagaagauauaacuaccauuugucaaugcuauaguggagauuuggggucuucuguagauccaguagaaccaagaguauauuaaggcuuaugcaguuuuuuuuuuuagauucacuauaauauauauauauguguguguguguguguguguguguguguguguguguguguguauuuuuuuucuuggaaaaauaugagacuuuuuuauugacaauuauacuugucccggcuauugguauuaauaucacuuuaaucuuauccuggauccugggaauuuauaaaggaagaacccagguuucuugcugggaaaagauaagcacugcucaguuauuugugacuuucuuuuuauuaauauauuuucccaaauagaaaagaugguuucauguaaacagaaaagggccuuuauucugugaugguuuuauuaauacuauuaauguuugaauaaauacuuaagcagccaugugaguuguuaacacauuuuagcaaauguauguguuugcaugagaaacuuuacauuguugaaggcugcuuacaaauaaauaguaccuuugaaguauuucucuaauuuuuuugagaaagagaaauaagaaaauaauaguuccauuuuaacauuauagcaaggagagaaacagaaagacaagguagaaauuaagacauaggggagagagagagaugcuagggaaaggcaagaaaaaaaaaaaugaacuagaaagccaaaggauccgaguuuuagagauaaugaguccagcauuuucuguuuaccuuuccuccauucucuguaacugcucacaauaagguccagacugaaaauacaaucuccuuuuuugguuucucauccaucucaaaucaccuauaaaugauuaaagaaagaaagaguaaacauaucaccacacucuguaccucguccuggguuuucuauaaaugcuacucauguucccucauuuugcucaacuuugagcagugcauaugacaucuacucucuggcuccaucuauaggaucucagggccuguuccuuacugcugaaaguauccuuauuuauucugaagggugguaaaguugcaggguggaagguggaugccugacugcacauauggcuacccagaugaaaucaaacugagggccaaaauaacucaccuauggguuaauagucauuauuaguucauaauucauguaugucguuuaaugaauuagaguauagagaacccugggccccagaacaagcaacuuaaagucauagacaaguuuuuuucaacuuguuagcaucaggcaucucauuuguaaaacaaaugggcucuaagguccuuuacauuuuuggauuuuugugaucaugggaaagcaaaauaauuaguaaaacuaagauaguaaaauuaucuuuuauuggcuauuaaauaauuugcuuugauuuuccauuuuuaacuuaggugaauuuaaauaucuucagcauguacuuuuugaucuaaugagguuuuaaauacuuucuuaggaguagggucuucuuucuagcacauuugaguuucaauuuauuauagauaguuuugcuucuauugguuacagguaaaaucccagacagaacuaagaaagacuccagugucugaagccagaaaaacaccuguaacucaaaccccaacucaagcaaguaacucccaguucauccccauucaucacccuggagccuucccuccucuucccagcaggccagguaaauauguuuuguaauuucuucuacuuaaucuuuucugugcaagaauuucuauucagucacugagaaauguguuuucuguuggaguaauguuacuaagccauaaaaaguucuauuuucccuaauacuuauaaaauuauuuuugaacuguuuguguguaguguacauacaagugcauguuuguuauuaugaaggaaauccuaucacuaaauacagaagcuacucacagaacacugauuacuucaguggauagaggaaaaauaucaagucuauuuuuaguucuucaaaucaaguuaaagauugacaacaugacuaaucucuuuugugauguguuagaagacucccucuaccuaccuguuaaaaaaaaaaugacuuuuuuugcaauuuuuugcuguuuccuuaaaacuaaagcuguguucuucuguuuugaaggguuuccgcccccaacauauguuauccccccgccuguggcauuuucuaugggcucagguuacaccuucccagcugguguuucugucccaggaaccuuucuucagccuacagcucacucuccagcaggaaaccaggugcaagcugggaaacagucccacauuccuuacagccagcaacggcccucuggaccagggccaaugaaccagggaccucaacaaucacagccaccuucccagcaaccccuuacaucuuuaccagcucagccaacagcacagucuacaagccagcugcagguucaagcucuaacucagcaacaacaauccccuacaaaagcugugccggcuuuggggaaaagcccgccucaccacucuggauuccagcagguaaguuacaguuguguguacuauccagcugaaugaaauaaggggaaaugcugaaagauucaauguuagaaaugcucauuaaacuuugacauacuucuugcuuagauuuauagugauuaugggaaaacaaaaguauugucucuacuguuuaugaaaguucaaauguuuuccuuacucuuguaaaggauaaaauacuagaucuuaaguaccauucuuggcugcuacuaaguguccauuuuauugaaaauggauuuucugcaaauaauucuccuauaggaacauaaacuacuagggaaauagaaucacagucuugaugaggugcuaagacagaugugacaccaaucuuaaauguugucguuggaagcacagcacuugaagcagaaaggggaaacaaacacucuuaugcaaauauauucauucauucauuaaaccucuuaaauaguugaauuaaaagaaaauaugaguguggugcccauaaucuguuuccaaaaagcucugaguauugaauagcccaaaagguaaaggaaacugcugccuugccuagaguuuuguugguuggaaaacaccccaaguucauucugugauucuuuagcauucauuauaaguaauauugcauuuuauccucaccuuuaugacaggcgucucuuuuuuaguaucaacaggcagaugccuccaaacagcuguggaaucccccucagguucaaggcccauuagggaaaauuaugccugugaaacagcccuacuaccuucagacccaagaccccauaaaacuguuugagccgucauugcaaccuccuguaaugcagcagcagccucuagaaaaaaaaaugaagccuuuucccauggagccauauaaccauaaucccucagaagucaaggucccagaauucuacugggauucuuccuacagcauggcugauaacagaucuguaauggcacagcaagcaaacauagaccgcaggggcaaacggucaccaggagucuuccguccagagcaggauccuguacccagaaugccguuugagguguguguucuuuccuaucaccaggcaauuuggagauaggucugagguugacugucuuuugaauaucucaaauagaucuuauaaaaaggccacucuuauucguuaguacuauagaaugccacugaguauugguguagcucuugguuuccuccucagaguugcacaguauguuuuaguuuggaagcugaagaauuccguaacugauuuugaacucugauggucuggcaaagaaaccauguacagaaaucucuaaaacagcauguuagagaauucugagacaaagcacuccucucaguugggcugaaucaucuaaguuuaaaaauagguuuacugauauuuaaauaaauugcucucugagaggaacaagguuagccaguuaucuuggacaguggaggucccuuucuuugcccuuuuuauucaugagaaacaggugaauguuaguaacuuuuuaaaagaucuguuucucuguuagcacaagauaugcuaaucauuuugcuccauagcauuguuuuacucacuagccacauuaaccuuuuguguucugcucugucaguauuuuugcuuuucuauugucuugaacuuucuccauuauuguccuugugucgcuuugccuuugcauuucagagcguuuuuucucuuugccuaauaccaucuaucucacuauccccuugacuuuaguugucuucuuccaccuaauuaugcuacuauuccuuuaugcuuuuguuaucccuuauugcuucucacugugaugcuuucugucacuaggaccccaagagcuccccucugcuuccuccggaccuguuaaagagucuggcugccuuggaggaagaggaagagcugauuuuuucuaacccuccugaucuuuacccggcucugcuggggccucucgccucucuuccuggacgaagccuuuuuguauguauuugacauaauucugcuucuuggucuaacccccagcugcuucucugagauacuguaguacacagauuaggugauuucuucucuuccuggggcuguccuuuucagaacuguaaaacauauuuucuaauugccuaaaccaaccuuaaguugguaguaggauauagcaaaacauuucugccuuuauaguucucccaaaucauggagacauaccuugguuuuauguguuauccagaaagcauucugcagagcuggucacacacacgaugugauggugacaaauuaacucacuuugcaggugacacuuccaucuggacccagaaauuuuaaguaucauuuaaucuugcuuaggaacagugagauuuauuucucauauguagccaaaauaugaaaggaaauauguucuugauuuuuuuuuugacugacauuacugaacaguauauggcucuuuuuuguuugguuaacuaaaugcagaaagagcccugaucuaaauucaaaguuggauucauaaacagaaugaguaaaaaugaagaggauucuauuuauaaacauugucagagugucauaaaugaguaaauaugaaaauaacuagaaucacauaaaauaaaaucugagaacucagccugcauuucaaagaacaucauucuauaugcuugucaguguucauauuauauuuuacuguggguggggaguauaaaagauggaaagaaagauguaugcuaugaggcuuuuuccccucucuuuauuacaccuuaauaaaacauaaaaagauaguaaauuuuacuuucuugcuguuucuuucucauaaacacagggcaagaacacauucguaaaauuaaaguacauuaauuuuagugucaagagaaauaaaaccuuaacagcuuucaugacauugcugccaucccuggcacuugaaguucccuuaagaauuugccuggguaguagcaguaggggccccauaccaaguuauuaaauaauagcaauaaaagaucccccuggagacuuaaaugguagcagugccauggcugagcgcacagggauuguggaagcucagcugcuauacuguugccucucuauguuugccuuucuuguggcuuuuaugcuagaguggcuuuaaggacugaggguagugcuucucuguccacuuguuuccuaaucccuuaguuccuguuccuguucccuuagugucccuuucauuggaaauggagcugaugguagaacaagugggaguauuuucaggguuuuuuuuucauguuuaaaagacaacaaugaauaaaaaaaacuucgacuauaacccuuccaauauuuaacauuaaugauacaacguaugucaaagugcuucucuugucguagguauuuaguaauguuuuauuagccagcuauucagugacagcauuagagauucagcuuuguuucuccuaauaacuuugcuagggccaauaaauguaagcuugacuuuuagcaacuguuuuacuauauacugcaaauagagcugcuuaaaaagcauauuaacaaagccauuugucaaauggauuugaaaggcuuuuuaaaagucaccaauguuaauguuuuaaaaauugugggguggagagaaacaguguuggaacaguucagcauuuuguuuugagauuaagugcaacuauugacaaggggauuccugagguccaugccucauaaacacucagagugcuguuuaccagggucucuggucccugccagaauauaaucucugacuagguuugaucuaaaaggaggauucuaugcaccuguggcaacuggcacuuaggcggugucuugguguuaacagauuugaauucacaucuucugagccucaaauuguacucagugggcgaauacaggcaugcuuuugcuuugguuccauaguaugguaagauuaauauuaagaaaauagaagguauaacuuaauuaccuuuuuuucugggacugugaagaaauccuuauuggagaagcccucagagcucaugucacauucauccucuuuccugucccucaccggauucucucucaaucagguaggugaacaaugaagaauccugcugugugcuuuuaguguagacugaucauugucuuucucauacuguuucaguaugucuguuuuuucuuuauuuuccauguauuaguguauuccagauauuugauuuuaucccccuugucucugauuggggcauacuagugacuuguacaucaugaauuaaaacccuuuaacuucucauuaauauugaaacccuuagggcucucuuuuugagccaaauaaauuauucacauuuucaaccuggauaguuuacacagagcaaauuuaagggugagagaaagcaaagaggaaaauuaauuugacuggaaaauugaaacaaaaagaaauaaaagccuucaaaauuucucuuccuaagaaaagcuuaagguguaccaagcauccaugaacaagacauuggauuuucucaaaucucuuuccuuggggugaguuuauaacuucacugucaugucuuucaggaaagauacccaaauaauaguauguucaaugagguauaugggaaaaaccugacauccagcuccaaagcagaacucagucccucaauggccccccaggaaacaucucuguauucccuuuuugaagggacuccguggucuccaucacuuccugccaguucagguauuaacuacucuuuaaauuauagaccuuacauuuccuguacacucagauugauuaagggauagugagauucuguaauuacaaauauaucauuuguuggguuauuuuuauuuuuuguuuguuuguuuuuguaacuucugaaaggaaauagaaaaaaaaaaagaagaagccgguuuauguaauaaaugcuacugacaaaacuuuuuacauccucaguagccagcagagauguaagggagaaaauagagguucuaucuuaugguucucagcugcuuuuuaguuuuauuuguagguguucauucuuugcagaaaaauugcacuuuuuuuuuugagacagugucuugugguguugcccacucuagacucaaacuccugggcucaagcaguccuuccaucucagccucccaaguagcugggacuacaggugcacaccacugugcccagcucugcacuuuuuaaaauugagauuuuuaacuuagagucugacuuaauaguaauucuuaagguuagcaaauucuuucugauacauaagaccaauaaacauguaucugaaauagccgugugagaauagggcauucauucaguugacaaaaauugccuacuauuuuauuuugcuuuuuuaaggcgaagaauaugccuuagauauguguggcagggcaaauuagugcaucuagcagaucucuuuggagccuuuaguuucccuuuccuucaaagcccugugguuauuguuaguagaauuuuagugaucagaucuacaggaaccuguaguucuuuguauguuugugaaacaaugauuuacuauauccuguguugcuauuauuuaauagaucauucaacaccagccagccagucuccucauuccucuaacccaagcagccuacccagcucuccuccaacacacaaccauaauucuguuccauucuccaauuuuggacccauugggacuccagauaacagggauagaaggacugcagaucgguggaaaacugauaagccaggugagaucuacauuucauugccaggcaaaauugaaagaauuuacucuauccuucccuggggucuggcaauuggcagugauagaacaucuucuugaauuuuucuuaucucuuuucaucccuuagccauggguggguuuggcauugauuaucucucagcaacgucauccucugagagcaguuggcaucaggccagcacuccgaguggcaccuggacaggccauggcccuuccauggaggauuccucugcuguccucauggaaagccuaaaggugaguagauuucaggaacaagaaccacaagauuauuacagcaaaggugucucugcuuucauucacauaaauagcuagacuucucaggcccucggaguugacugauacauagcacauauauaacaaaguccuagaaacauggucugccuuacaagauucuugagugauaauuuuuaauuucugaauucacuagugguaaagcaguaucuucaggaggacaaaaacaaagguuuuaguuucauucuaagguuaagaaaauucugauucauuuuggaauguuugauuuaagccuuuucugacaaaauaagaguaucuaauuuuagaaauguuuuauuugccugaaaacuuuauaguaaaugcccugugugguaccacauacagcugaguuucaguaaaaagacuugacauaaaaugugauuucacuucuucugguuuaaaauagucuuaauggaaacuaacuagcuuuaagagucuuauaaugacuuuuucuaauagcuggauuuuuauggggagugggguuggguuuuggggccauauauaugccuuuauauuuggcugggauugaaaaaucccuuucagacaacuuggcauuugaccucugcugacaagaucuggacuguuuuucagucuaucugguccaguuccaugaugcauccuggaccuucugcucuggagcagcuguuaaugcagcagaagcagaaacagcaacggggacaaggcaccaugaacccuccacacugaggccaaaguggcaaccugggaaugaaggcuccauaaaccauggcauguuggguuugcaggacuggcccacacaguccccugcagguggcagcccucuuuucuguuucucgcugucaagaggguguaaguauuccaccagcccgcugagugugcacgaaauguucgcagugcaacaaaaagaaaaauccaucaggaacucuccguccccccggggcccuccggagggagagagagaggaacugcuguuuaucucacucaguuacuugguaucaccgccucucaccuucuccaucgugcauguccccagccacaugggaagugaaagcugagaagggaaggcagaugggagaagccaaugggaacuucucaguccuuuuuuccucuuuggggaauaaaauaggaauccauuaaugauugcuuugcugacugagaauguaguugaaauuauucuuaaacaucuuuuauuauuauuacucucaguaguaaaauaucacacugaauucuuccauacacaggugugcuucuagucaguguguagcaaggaaagccccguucacugcuccugugagagguugguggugacaggauggggaaccgaccucuucagccaguggaaauguuccauaagggagaguucaaggccugucagaaggcucugguaggccuuccucuggccaggagacuccagcagggaaugcccuucacucuguaggugcucgagccccaaucgaggauacagugugggugguggugcugggcuggacuagcagguagacugcuguaggauuucaaauuacguuuuugauuccuguacauuuuacagucgcacagcaagcagucucacagaaggcaggcuaguccauucacagccugacacguucuaauagguagaagcuuucagugugguuauuuuuucuuugguugguuuuugugcccccauucuacuucccacccuccugccccaucuccaucccuucuuuuacccaaugcuguaugcuaguaauuguuuuuauuccuaaugugugcaacaucacaucuccccaagaagcaacagcaugggguccagcaguuggggcccaaaagacagucugaagaggaaggaagcagcaguaucugcguagcccacagagggcccaggccccugcccagcugcagucucccagccuccacuuucagagugaaauucaaggcagcacggacaugugcccaucaggcacagaagaaaacacgacgucguccauuuuggaagagacgaaagaaaggaaaauaaacucuuuguaugauauuuauuaggaggaaagaggacugaaaauguucuuguguagaaacagaaggacagcauuucuguuagucauuuccuggaaaaguaauauuuuaaggggaaauuauggaaacaaucuaauuguucaauugcugugcuagugguaggguuuauuuucugggaggucucuccuuugugugucuguauguuuguguacacacacgugcccaucugcugucccagaggggagggguugugugugcgaguguauggaguuaguguggaacuuaagagcuggaagacagcuguagagcaaagcacauccaggagccccaguugucacugcagucugggcaaccccagcaaugaaaaggggugagauaacgcucauugcucuucagagagagugguuggagccccccccgccccguaugcuuacauuauugcucuuuuaguuugacaugguguuuggguuuuguuuuuuugaaaggucugaaaaggugaagcccccuacccaauggcaauaugaaaccuuuugugcuucucuucagccccuucccuguguccaccuuucucuccucuucccaagccuuuuuccuacuaccuuuacccaguuuguguguuugagcucugcauucaggcagcugcaacauuccaguguuugaacugucacugauucuugcgcccuagacaagcuaaccagguuuaccaucucacucccaguaauacccagcuccuaucuaaagccccauucugcaugagaauuugguguuuggaauguuuucugacucuuggggcgggauuccucgccuuaucauccucacuguggaguaaugagggggaggagaaucuuuaucagaaacugguuuuguguaguaaacuuucuuuugugguuuuuuguuuuguuuucuggguuuuguuuuuuguuuuugucugugcaagaccugcagcugcugaaaaucagcuuugccuuuaauuaaaccauguucucuccaaccag

SEQ ID NO: 12897 - RNA, 122310 nt, Homo sapiens
gggcgcgcacucgggcacgcgcucggaagucgggggucggcgcggagugcaggcugcucccgggguaggugagggaagcgcggaggcggcgcgcgggggcaguggucggcgagcagcgcgguccucgcuaggggcgcccacccgucagucucuccggcgcgagccgccgccaccgcccgcgccggagucaggccccugggcccccaggcucaagcagcgaagcggccuccgggggacgccgcuaggcgagaggaacgcgccggugcccuugccuucgccgugacccagcgugcgggcggcgggaugagagggagccaucgggccgcgccggcccugcggccccgggggcggcucuggcccgugcuggccgugcuggcggcggccgccgcggcgggcugugcccaggcagccauggacgagugcacggacgagggcgggcggccgcagcgcugcaugcccgaguucgucaacgccgccuucaacgugacugugguggccaccaacacgugugggacuccgcccgaggaauacugugugcagaccggggugaccggggucaccaaguccugucaccugugcgacgccgggcagccccaccugcagcacggggcagccuuccugaccgacuacaacaaccaggccgacaccaccugguggcaaagccagaccaugcuggccggggugcaguaccccagcuccaucaaccucacgcugcaccuggguaagcggugacagccccguccccugcuacugcucgccagcagcccagcucccggaccggcuccgucccaguggccggccucacgggcgcagacggccgcguguuugcucucuguuccccggcaugggccacacagaaacuccuuucuccaacuucuuaaauagauacugcuuuuaacaucccgugagggccaggauguuccgcacgagucucucugcuuuccuguucuuucugacuuaacgggauucuggcucucugauuauucugcauuucggcuguuaggauugugauuucccccuuuuuuuucugaagcguuaaucagaaacucccauccccacuuuucucuuugcuagcaaggucaucacagcgcauucuuggaucggaaacaagaagguccgccuuaaacacuuucgccuuuaaaauguuuagauguccuuccagggcugagggugauugcucuguugaguuaagggggaauuugaggggagcaaaugccuucgcugccuauauugccuauguguaauuaaaacauaaauucacuuuugaaguuauuguucuuuauagcugcucagccuuaauuaagaaccacaaagcgauuugacugcuaauccuggugcagaaugaacaaaaggaagugcacucacuguaauugcugggcauagccuugucccuggguaaaaaggcucuccuuuacugucuucccuuuugcuuucauucaaagcaacuguagaaacacguguaagugauguuucagaaaucaggaaagggauguguagaaaacuucauggcagggcaguggauugaggauggacauauguaucuggaagcaccaaaaauaauguucggucuagcuaagguuuucuucaucauugagauacguaaauaggcagaaaguuucauuauuguguuuaacagaggaaucuaugugugagaaacacguuugacuuaacacuucacuccccauugccuuggaaggcuugauuauuaccaguagcugguacuaaugaacuuccagagagaacagacugccucaagccauucuucugucaagggaggguaauuuuguaaggcuaauaucacuuagggguguuggaaaggaacauguuguaggcaaaugguucuuuugaucaugauuuugcugcucuccgguacacuaaacuuuauguaaguaucaggauuccagagaaagaauuggacuuaacaaaaaguacuuugaaaagugggauuaaauuauuguguguggaauaaguguuagaaaagcagaauuauuuaacaucuuauuugcaguugagucauuaaacaaaugaaacauuuugaaaauaauuucauaaaaugauacuaugagguaucuguuuuucagggauugaagaaguaaagugcacugaguucaguuuuuuaaaggugccuuucugaagacauagcuagugaccgaggauuuccuaagaucugugagauugcucuuuauuuucuccuguuauauuuuuuaaguuggccaaaauuauuuuugaaauguguaucuaaguauuucuguuuaacuuuugacuuguuaaaguuucuguguucaaguuugaauacucuugaagucuuauuuuuuucauuuucagauuuuaaaauuuucaaagaaaaggcguugccugaugucugaaaucucagaugccugaaauucaauugacaauuacugaacaacagucucuuauuuacauaaaggugggguugucaaucuuggcucucagaauuuucucuuguaggcacuguguagcuaaagguuauuuaaggugauuucagagguagauagauuacucagugauuacuacccuguugcaaagauaaugcgguagaguaacccaguaucaguuacguuagauugcucccacugggaggcagauauguuaacuuugggucaugguugauuaaaaggucaaaagagaucuuagaguuuaccucuaacaucacuuuuuacuaugaaauguuuuaugcuuggacuugguuuugcugaaauuuuccucaacuuuugguaauauucuugcuaaaugaaauucauaaaacuaugaguuuaaaacuuguaaguuaaaaguuaaaguauuuucuuacaagcauugugauuaacuguaaaaauauguacuuuaaacuucuaguuuaaacuaacuugacuaggauacuugacuuguucuuggaucagaaaugacauccuggaagaaaucaugcauaguggaggaggugggaagggggaaagguuuguguguagugagguugagguuucucuuucuguccucccccccccuuuaaugacaagguuauauguauacauguauguuucgaucaacaauuuaugacaaguaggcaaggugucaugugucacuguguguuuugauguuuagcauauucacuccccaacuccaguuacuccaugggcuguagcuaacuaauuauuucccaugaauuaaaguaccgugacuguuuugugcaucuauuaaaucucccucccaguucaaauuucacauacccuuaaacaagugaugcauauugugcuuugcuauuacagagcaugugaagcuagaaaugaguagugugaaagaacuaggucuagccaccacuuuucuagccuuucuuuugauguugaacuuuaaauacaguaaacuuuaaaauaagcagucaaaucauacauaagaaauguaaguaguuauguaaguguuuuggcacugacuuuuuuaaauuaugaaaaugaaacaugacauuguaaauucaaacaguaaguguaaugacaagugaguuucuuuaucacuagcugcuaagcuccaugcccuagagaccacccuucacaauuucuuacauuaauaugacccucuagaaauuuuucaugcauacacauguguauauaaaauuauaggaucauuuuaacugauacuuuuugggaggcugaggcguauuuuaacagauggcaaauacaaaucugauuauugugccuguaucaucacuugcuguacaaaagccaggaaaaucaguguugauucugaaaacagcgcucucuuaagcaccauacacagucauccagggugcagggugcagugcauccucggauaaaaagaguuaaaguugcuaugggaaccagaauugcacuuucugcuuguuguggggagaaaucuccaccagccacuuuucuaagaagaagucuuuuuuguuucaccuucaacuucuggauggauuauucaguugcuguuaaaaaguuuggguuuuaugucuuauaaguuauaguaaguuuuuaucaguaccagugggguaguaguugauacuaagauuguagcuaaggauuugccuuuuaucaaacagccccauuaauuaauuugauaaucauuguggauggaaacuuggcagacaggauccuaaucuugagaaagguagcuuuuccucuuucuaaaaacaauuagauuaaggaaaagagugcuuauaaaaccaacccaaucaaaguuuaugaaacuccuaaaauuaacacugaaaccagauuaguuuccaagcuccucauaaacuguaggaaccaauagugauuaaaugaagcuuuuaaaucugcaucugcauaucuuuuuuguguguuuaaguuagaauaauugauauauaaggcuauugccuuuuauucucuuugguccucugcugaguguguauguauuuaacauggaacaaauggcaauuuuuccccccaggaaaaccuuugcaagguggguucugacuaugucagggaauagcucacuguggugacuucacugugguauuugugcacccugaggggacacuauuuuaguuugucucacaaaggccugauuuacauuuugcagguuucaacuugagaaguuaaggagcucuuccuuaauggccagcaguuguugaacacaguuuuauaaaguugcuguuggcugcuuuccuguucuacaguucacugcuuuuucuccaaauuccuucuccauucuaagggcauucaaaaaagaauuuacacauuaggggagaaguuggagcuauaaggcauuccuccccccccccaccucuuccauuugucauuggucacauuugugggaggaaucaaguuuugacuauuucaguucuaaauaauuuuagaaaauugggugugccuuuugcuaugcacuccuuccuccugugcauacauucucauguuauugccggauauucugcaaacauuuuaaaaaauacucuugaaauacauaccacuguaccugauagaaagauguagaagauugaggguccuaucuucagaagauuauacuuuguuaggaauuuacacacucauaauggcauuacaauaauaaaucaagggugucuauauaauauuuuacaguuuauaaggccuccaguuuaucacugaugagauuucucacaacgcaaggaaggcaaagaugccuaagguugugauuugccuaaagucaugugggagauaggucuuugacuaccuaguugauugcauucguucuugcagcuugcagcuucucuaacgagucucucgaaagaaagucuacuuuauucuaagccacuuuuaaaauuucauguauacccugguucagagauaccagacuccuuugguuuuccuuguuuuuucuucugcauacuucuuuuuauuuauguuccuagauuccucucuuuucaugcuguucacgcuucguggaugaacucguguuugucucaaggcuuuauuugcaauuucauuuguaaauuuguaaauucuaaaguuguauuucuagucagcucuuuuuccagaucuaaaaucuuguugguuauggucaauuugggauguccagagaccauauucaaaacuaaauucacuccuuguugucucacccaacucaaagcucuuuugguauucccuaucucagugaacuacacugcugucuaacacugaguuucucaaccgauguugcccacgucucuccugaaagaaccaugcuugacaggcuucaugaguaaagacuacucuggugaacagauaggauccacugcuguguggucggucgguucuggguagcuauaacuucacccguuucuuucccaccaaucguuacuauaaucuguccaagacucuacucuuaccuucuauauccagacacuaugugucuugaaugcuuaucuuucucuccguccucuuugucucugccuuacuguaaguuccuuacuguaaguucccauugcauuucaccuggauuguugccacagccuccaaauaaacuggugggcuuucugccuccaguuuugcccuuuauauuugggcagccauccuuuggacugagugaugauucuaaaaugcaaaucugaucauacaauuuugcagcuaaaaauucugcagugguuccucaagguuuuaugauaaaguccaaacuccuuggcgugguguacaggguacuuaggaucuggaccuuuuuguugcuucacguguucacagggcuguucuuugguuuggaacacuucucccagguguuaggacuccuuccccaguuucucucucucuccccuuucugccccacucccuggcuuggauuaagucucccacugacgccacccuguagguauuuaucacagucccuaucacauaggauuaucuguuucuuuacuugucuguuucuaccuuuaaaccaugaaguuuuugaaggacgagucagggguuuaguaaucuuuuaguucaguuaaagaugacuaauauugguuaauugcuuguuauguauuagcaacaaugcaaauuccuggauguguagugauucaugggacauugcccugaccucauucuuagaugagguguagaugcagagacccaugucucucgauuuggggguaggcaaaugauggccuucuuagccaaguccaguccaguccugccuauuuuuguaugggcugugaacuaagaaugguuuguacauuuuuaauugguuagaaaaaaucagaagaauaauauuuugugacaugugaaaauuucaugaaauucaaauuuuaguuacccauaaaguuuuguuggagcacaguuuagcccauguaacaaagcauugucuguggcuguuuuugcacaauaagggcagaguugaguaauagcgacagacuccauaugucccagcccacaaaggcugaaguauuuacuaucuggcucucauagcacagguuuguugaccucuguucuagagcaguacuuucauguuauauaguaaguccuaagugagagaugcaagcacagagaggauucacuucacugacuguuuggguggaggcuggaggcauucugucuccagugacacuugucuggcauaguguucauaaaaauauauguacagugagugaauaaaugaaugccugaauuauaaaacucccagaacauugaacauuaacuuaaauucuucaaagcaaaacuuuugagcuuguguuuauuuuuuaucagugccaucucuccauuuuauaagauauaugucacuguaauagcuaauauuaaauguaguaugugguuuuauuucuguaaauuuuuuaaaaaaguacuaagguauggaacugguauggaauuggaaaggccuaugacuguccuuuuuuggguaaaaauuagacuguuaugugacuugaaggcagccuagauaaaucuuaggcgaaaacucaugaauucucacaugugaauauguauuucugaaauguuaauuuguauuuuuuuccuuuaaaaauggacauaagcaaauuuuauuuaaaguauauauauucuguaguuucagcuacuugggaggcugaggcagagggaucauucgagcuaagaaguuugaggcuguaguacaccauaauugcgccuguugaauacccacuacaccccagccuggacgacguagacccuaucucaaaaauuaaauaaauaaaauguauauauucacauguacauuguugaaauagauucuuaaagggaauuauuaagcagcugaggggaaagguuacaaugaaauauuugcuuguuguauauagcauccuuuuaaguuuagugaagucaucaugaguagauuuagaagauaggcauacuguuucuuuaggauagugaaaggacuguaaauguagaguacgguauagcccaguguauuccacauuaaagugguuaggccgaugagcaguaaccacauauucaucuaaaguuaauaggcagcagcaacaguugcuucuuuuuuuucuuuuuuuuuggagacgaguuucgcucuugucgcccaggcuggagugcaguggcacgaucuuggcucacugcaaccucugccuccuggguucaagcuauucuucugccucagccucccgaguagcugggauuacagacaugugccaccacacccagcuaauuuuguauuuuuaguagagacaggguuuuaccauguuggucaggcugguuuugaacucccgaccucaggugaucugcccgucguggcugcccaaagugcugggauuacaggcaugagccaccacacccggcccugcuucuuuacuuguucauuuuuccuacuggacuuuauugacagcuguaccacuguucuguuuggguuuuagggaaagguguuaaaguuuagagcagagcuguuuguuuauuuuuacugcugaaaauuucugagaagguuuuuaaaaauaugggauuaauguuucuucaaguugucagcuugaaaguguaaaauuucaagaugauuuugugcagauccuauuacuuugccuugguugcuugcuauaagacuuguuuaagauagaacuugcccuguggagaagaauagaguagaauaaaauaauuuaaaaauaagaaaaaaaaagauuaaagaaaaaaaaacacauauguaaaagggcccugcuggaauuugcaagcaucuccuuucuugugauauaaaguuagguguuugcucauuugggucuaaaauugacagcuugcuaaugggguuaccagaaaacccauuuauagaaacauuccugagauuuuagaguacugcaccagacuaggguggcacuaauuaaguaugucugcuuuucuaugugugugcucuucuaggggccagcccgaaauacgugggcccagucagccugguacagcuacauauucaugaaauaaaauaaagcagacuucucucuuucuuagacaauggcacccucagaucucuugugggagaagaaucuuaugguaaggcugggaaaugaauaaggggauuuaccuuauuucuuuugaacuuuaggaguuacauuuccucaguucccuucuuuuacucuuuguuuccaucuguguguggccgcuuccucuuauauugagggcaacauuagauucuuuuauuuuuagauuuuuguuauuuuaucuuuuuguuuugaaaguuggaggagauaguaauucaaaaucagucuucuucacauugcuugcuuuuuuuuuuauuuuuaaagagacaaagucucacucuguugccuaagcuggaagugcagcggugcagucagagcucacugcagccuugaccuccuaggcucaagugauccucuugccuuggccucccacagugcugggauuauaggcaugagucaccaugccuggccucuuuuuuuucuuuuuuugaauuugguacguggccuuauauagaguuaaggacucaguaaauuuuguuucaugaugauaaaucacaguacuguguauauaugaaaguuucugcuaaccagaaugauuguuuguggcagugacuauacagguaccugucuguuuucagagacaugguuaaugaccagucucuuuuuuuucccaucuucuuuagaguucugauuuuguguucuauucuugagcuggguggagcucaagaauaaauuuuacauauguaaaauuucagagcuaugcauuuaauauuuguauacuucauuauauguaaauuauuccuugaauaaaaaaaugaauuaagaaacuuucagccaauuguaguacacuauaauauaguugauuuuguuuguuuuucauaugauuuuuggcuuaggagagaacacaaugugaggcuucaucaucuaaaauauauuucucuuagugucuuucuccucuguaccagaaguugcuggcauuaauagacauuaacagauauuuguugagugaucaaaucagugaacuggcugguuuuaauugaguuaugagcccauuuucauugaaguaccugcagagcccucucauacaaucaagcuugguagacgccucaggcaguggagcaugggaaaccuggggaagagcuguccucuguucucaccucacuuuaagcagguagugguuuugguugaugcuucaucguuugaugugguaaaaugguaagucuguggguuuugcugcagguuuagagaauucuuuaagaaugucuuuguguggcauaugcuuuggucacaauaucuggugcuuagguaacuugcuauuuaauuuccauggugaaauguaaauguuccacauaucacuuaaauaaugggaagaccccaucuucauucauuuaaacauggucuagguaauggcuuucucuuauugagccuuuuagaaauaaaaagucugaaguuugaaucauguggcuuucuuggagaaacuuuuauuuuuuuuugagacagagucucacucuguugcccaggcuagagugcaguggcgugaucuuggcucacugcaaccuccaccucccagguucaagcgauucuccugucucagccucccgaguagcugggauuacaggcacacacaccaccaugcccugcuagguuuuuuguauuuuuuuuaguagagaucggguuucaccauguuggccaggcuggucucgaacuccugaccucaggugaugcacccuccuuggccucccaaagugcugggauuacagucgugagccacugugccuggcuggagaaacuuauaaagcuaugaaauauuuccagugaucugaaaagaucuacccacuuaaaaugagaugagcuuauugcauuuugauucuaauuaguggacaaaggacuuauguaaauaagacugcuggggagaaaaugguucacucagacauuauaguaugggaugugugaguuaugauagauguugaagauacuuuuuauauccuaaagauagauuuauucguaauguauuugagaucagacaaaaacauugaccuguaggcaaaauaauucaguugaaacuuuuuucugagauggagucucacucuguugcccaggcuggagugcaguggcaugaucuaagcucacugcaaccuccgccucccggguucaagugauucuccugccucagccuccugaguagcugggacucuacaggugcaugacaccaugcccagcuaauuuuuguauuuuuaguagagucgggguuuuaccauguugaucaggcuugucucgaacuccugaccucgugaucugcccgccucggccucccaaagugcugggauuacaggcgugagccaccgcgcccagcccaguugaaacuuuuuaaauuguuaggagaauaccuacagagcauuuugaagaguagggauugaagucagcccggaaaagcuucccggaucuugaagaaaaguaauagacaugaguguaggguguuuccaggaagguugaguuguuugaauaaagaucuaaaaguaguuagauaauggugaagguauuauuugccauucauggagcaaugaggacgugccagauggauucugaggagaacuugaaagcugggugacaaaagaaacuaaauuaccuuuugucaagugccuccugguuaccucuuugaauucuucagucuugagaacuauuguuagccccggggaagaauaauaugacuagugacuuuucugagguugcguagguugaaauccagaccugcugugguacauagauuauguuuuugccacucugccauuuuaggucagaccugcuguaagugauagugaauucuagaaagaccucaaauugaggaguaaaaugagagugcuaaggaacuaagcauuguuucucugauagaccacugcuuuaggaucucuggauuucgacugcuucuguuaaaagggcuuuacacuuaagaacagaggauuuuuuuuuuaauuaaaaaaauauauauguuuuagacagggucuugcucugucauccagguuggggugcaguggcacgauccuauuucauugcagccucaaacaccugggcucaaacaaaccucccaccucagccuccugaguagcuaggacuacaggcauaugccaccaugccuagcuaauuuaauuuuuuuguagagauggggucucucuguguuguccagacuggacccgaacuccuggccucgagcaauccuccugccuuggccucccaaagugcugggguuacagguguaagccaccaugcccagcugaggauuguuuucaguggaagaauuuuagguuuugggcauauguacuaguuguaugauauuuagcuguuaaugcuucuagaaauuucuaaggaauuuauugaauuugagaaugagguccuggauuuugucagugucuguugauagaaaaaauaugcucuaccugugaaaagaaaauuucuacacguucugaauuuauuaugccaagcggaaaaguuaggcccuggagacugagucacauaacauggcuguuuuucuucucuggugugugacuguugcuuagggaccuuuguguugagauguuaccuguaaccagauacccuauucuuuauucaaaccuagacuaaaugcagcuggagguagagaccccugugauuguuacugcuuuacaauggaguguuaagcaacccccuuagaguauaauaguaaccaaucaaaucuuguaucucuauguuagccuuaugcagaaaauguuguaauccuguuccacuccccuauuuuuccuauauaaaugauucucaccuuucccaaugcuggggagugcugaccaccauucuucaguguccauguuuccuggaaaacuacccucacacuuugugcuugaaugaauucuuuuuuuuuuuuuuuuuuuuaagacagcgucuugcucuaucucccaggcuggaguacaauggcgcaaucuuggcucacugcaacuuccgccucccggcuucaagugauucuucugccucagccucccgaguagcugggauuacaggcacuugccacugugcccagcugauuuuuggauuuuuuaguagagaugggguuucgccauguuagccaggcugggcucaaacuccugacuaggugagccaucugccuuggccucccaaagugcugggauuacuggcgugagccaccacgccagucuuuuuuuuuuuuuuuuuuuuuuugagacaagaguuucgcucugucacccaggcuggagugcaauggcgugaucucggcacacugcuaccucugccuccuggguucaagcgauucuccugccucagccucccaaguagcugcgauuacaggcaugugccaccacacccagcuaauuuuuguauuuuuaguagagaugggaguucaccauguuggccaggcuccgaccucaagugauccgcccgccucggcuucccaaagugcugagauuacagacgugagccacugcgcacagcugaaugaauucuuuuaacuggauccucuguaaaaaacacauuacgcuuauuugugaagaacaaaggauuguuuucuuuuuuuguuuuguuuuguuuuguuuuuuagaugguguuucacucuugucgcccaggcuggagugcaguggcacgaucuuggcucacugcaaccucuaccuccuggguucaagcaauucuucugucucagccuccugaguagcuggaauuacaggcacccaccaccacgcccggcuaauuuuuguauuuuuaguagagaugggguuuugccauguuggucaggcuggccucgaacuccugaccucaggugauccaucugccuuggccucccaaagugcugggauuacaggcgugagccaccgcaccuggccccaaaggauuguuuucaguggaagacuuguagguuuuggguacuugaacuaguugcaugauauucaguuguuaaugguucuaggaauuucuaaggaauuuauugaauuucaggaugagguccuggauuuugucagugucugacaggaaaaguguacccuaccucauuuccugagggaugaucaguggcuucauuuauacagggaaugccaccaucuuaucuccuuucugccuuauccaugacuucuuucugguuguugagaauugcugaguuaguucacuugcuuacuuuaucugacauuauuaaagauaaggcugccuggucugucuucacauucuaguucuuuccuucucugcuccaaguaaauucuaacccuuacaugguauguuuuguuguuaaaguuugcuaacugaauaggucuaacccaccuuuuguuaauugaugaauagcuagcuacuguagucccaggagcuuucuuugucaguauuaacauuauucagguucagaagugauacuauucacuuugaugucuguguaugugaauuugcaaaucuguaagucucucuuuaccucuuccucucucucuuucugccucccuccuuuucucuuuaguuuccccagaguguugccgagcuaagguucaaucagaggacucuuagauaccuuaauuuuuuuuggcuuuauuuuugaagaaagggaucaucguucccauuaggacauguauuuacaauguguuuucuuuugcuugcccaccacacucuaccacuacuucuagaacuuaaaauucuaggauuguuuuuuucucccucaugcccuauccccuuuuuaaaaaaagucaaaacucuuauuauaguagaacuucacagguuugaaguuggcugauuaaauauacuaaguauuacugaaucacugcccugccuuuucugcuuucuuuacagaccuguuuaguauacauuguauguauuuuuuuuuuuuuuuugagacagagucuugcucuguugcccaggcuggagugcaguggugugaucucagcucacugcaaccuccgccucccagguucaagcaauuguccugccuuagccuccugaguagcugggacuacacgcgugggccaccaugccuggcuaauuuuuguauuuuuaauaaagaugggguucuaccauguuggccaggcuggucucgaacuccugaccucaggugagucacccaccuaaaguccugggguuacaggcgugagccacugcuccuggcccacagaugauuuuuaaaugcccuugcucaguuuccuuucuuacagggagaguggguggcacccugugcuacaccggagggcugaguguugggcuuaaaauguccucaguguccucccuucucucugcuguuuuuuguuuuguuuuguuuuuggucaguugguaaacuauaaaugcauaaauguuuucucaggacuuuuccaucaacuuucuucagagagaaugaagggauaaugauuuccaagaaaagaguuuugcaguuuuuagaaagaggguagugacagcaugaugaaaugagcugaacagcuuuuuuugaguuuucacuggcagggacugggaagugauauuuuccugcccuggcaucacgaaucccaauuagaggcaggaaucugcugcccacauguucucaaaauccucgaccauuuuauuaucaaaaacuguaaggaauaaauaauuugacaguguaaaaugguuagaucaagauuuggaguuuaauagacucuuaguuuucuggaauguccacagagacauccguggacucugaaaaauauuuggcuaacuagaauaauaaaaucauaaaauuuuggaguugaaaauuuaagcuauaaaaaaaaaagaaaaaaaguuuuagggauagguccugguuuaauuuauuuaaucucuuaccaaauaauuuaagguaggcguaguugccuugggugagcaguuuuaccuguagacucgugcaucugugcuaccauucuucagugguucccauccaucauaccccuauuaugauggugcuggugacaucaucuguuuugaugccacuaaguuuaaagaauuuuuucuaaaaaaauucuggaucaugaucugauagagcugagcaugccggaauuuucauugaaauuguguucuuuuggaggugggaauaaacaagggacuaaggauaaagauugugguggggucgggggaggguuagaaaccaaaagagcaauuguguacuugaauugcuuuggucaugugauugccccuucuuggguaaagggucgugaucaguggccuucagugucuuggauuaacuuucggagcaguccauacauaguuuugaauuugugguauuuuagauaaguucaugggauagaaagucuauuggagacuauaaauucuuagaauucuacaaauuaugagcauuugugggaacaucuguaaugcagcuguaauaaaauuuguuuauuaucaggauugcuuuagaggcucuugcuggguuguuuauuauuguuuucagcauuuuugccauacgcccugaaauagcaucaacuccuggguagacuucaggaucauucaguuuuguaggcauucuaaucagguuuggguuuuaaacauauguccacuuuagagcuuuuauguccuggcacagacgucaauggugaauccagaccauuucaagauggacacugauucuggaauuaacauacuucccagauguuuguaguacagauuuguuuucugugcugucuuucauguguucugcugugucugucucuaucugugcuuuccucuguuuuuacuuuuagaaccccuggggaaagguagguaucugcuuuuuggauugggaaauagaauagguauuaaauuuuugguaaaaaccuuugaguggguauugacauuucugugagaggagaggcugcuuuguucccucgagggagacuguuggugagggugguguuggaggugagacucugaauguaacuagauucggacuucuucacaucucuagugguuuucaauuaugaaaugggcaacugaugcucugagucagcagccuuuuaaccaugccugacugaagagaacuuguguuugaaauucacagcauugccuggaucccugcugucuuuuugugccucccgcuaacacacagcuguuuuuguucauacaucauuuuguguucaacugccugguuacuuccucaggucccuuuuauggugaauaauggacacaugggaguuugaacacccaagugugugguuauucaaacaggaagucucaaggaagcacaguaacuuugucagaggaacaaaagaugggacaggaaaggcuauugaugauucuaggcuucaaacaucugcugggaaaucugacaauuucugaaauacagauauuccauagcuuacaaacaaguugguuuguuuauuuggaacuuguuccauuuuuuaaaaaucaggguauuaaaucuucguaaaauagaaguggagggaaaaaaaaggauauaauguggcaucauuaguguuaaaaagaggagagaggcucugccuguggcuugacuggguuucaggagaaaggcuggagcagcucaucuugacugaagguaacccugaggcuguaacccggggugagcacauaggugggacuugacagaggcugcuagagcugacagaauuggauuaaaagaugauuuuaugcagagcuuuugaugauugagcacuggaggaauaugagauaaagaagaauguagguugcacuuaaagagcaugcaguccagugggagaguaagaauguguguaucaacaaauuuucucugagacaaaacaugaagugccgugagagaaggauagaaauuccaugugauugcaaaggagauaugacuauagaagaucaaaauaaaugcuucccagaauguugaucuggugaccgugaagauuccuuaugaccuugggauuccuuguuuaugugauaaaugacuuaccagaaauagucaaauaaauccugauuuuagauuuaaaaaugaaaauuaaaucuggaagucaaagaagggggagcucugguuucauagcaauuuauauuaagcaaguggggugaugcaaaugcuacagaaaagaguacugugucaggcuuaauuaauggaagugauaguauucaaaggaguacaaguucugugcaucuuauuccccugccuuuaauuucagucaugguaaacuguucauaguaaacaugcucccaccguguggguacuacuacauuuuuuucuugacucuuuacuuuucuguuuuuuccuuuggcuacuuccuaaucaucuuuaaaacuccugacaaauuucaacuccuccaagaagauuuugcuaauuucuaauuccucuguucccuccagagcacuugccuuuaugucauuugauguuuauacguccacucacuucuaaaauccaguaagcauauugcauaccuaggaugugaggggugcuauauuguauuguuuucucucuuucccccauuagcugaguucaucaaagacaagacgaauccauagauuucuuaauucauucauuuacaaagauuuauuaagcaccuguuacacaaaagguacugcauaguaccggagacagggcagagaagaccuagagcuuaaguucuggguaaaaaagcaugcaguacaaaggaccugaccuagggaggauuucauuggcuuccccuccaccaccccacugacuuuuaugccccuaguguacggcauaauaccuuuuauaugguaguagggguucaaaaaaguuugcugaaugagugaauuucuauuucuuugaggcuauggacacagaaugcagaugagugcaagaaacagcaauuuuguuuagguuuucccaugauggaauuugccuuguagauaggguuuuuaaaauugaucaggcagaauaggauggcuaguacaugguauaguuuccucaccagcauuguuagaugaagaguaagucacuguaucaaagagccccaguauaaaguaauaaaguaaauaaaaacccaguuuuaaaucauugaaguuuguuucuccuucaggugguaauucugaggucagugguucaggacagcaggguaguucuccacgcugacauucagggacucaugaguguuuccuggaaauaaucugggauccuuuaggguaucauucuuaugugccugguugaggcugggugauaggccccugugcuuuccaauugggaagauauugaggagugugugccuaaaucuuaacacuugaaaaucuuaccuccccaaagugccauaacaccugaaaguguauuaucugccaccagagagagcuuagucacuuggccaccucauaaacacaguagaggcuggaaaauggggucuagcuggguggucuugugccuggccacagaucuauuacagugauggauggguugguggggagagaacagauuuuuggcagacagcucugccaugccaacuccugugcugaagagucugguuucucccaaguucuggucuuucuggagagucuucagagguucccauucuguggcuggcaguuguagggaguggauauagaaaaauagggaccacgcucacuguggauccucacaacuuuagcuuuucaguaaaagagccucugaagaaaggguguguacucauucugcucuuagugcacagccuucacucccugacuuuacagaauugguuuauucuuugaccuuuuccauuuucacacccccagcccucuccuggcacugagaucccacuguaccuucuugguguuguguacuuacacugaugggcucuaugucuaucugccucggaggagcacaucccacaugggcauugucugaauucacuugacgaugcugaugguguuuaccuucagcugugacagaccaaucagagcuguuuuaaaauccagaugucuuuuaggaaugagaguuccagaagugauaaaucagugcuuuuuguggcuugaacauauacaguuuuguuguggaaucuucuuaaauguauauuuaucuuuuucuucauugcgaguucauugaaggcagcugugaaucauguuuuaaccauuaauuagguguccaacuuagaguggggugcuuaugaucuaguagauuuaggaagauggguguauguuacauaacacccucagcaggacccccaucuccaagcaauugaauauaucugcaguaaaauguauucguacgaaacagacugaugaaaggcuaucauagccucacacuaggucauguauuguugucacacauuaugaaaaucuccugcuguuuagggcuuuuugaauugagaaucacagaugaaggauuauggacuuauaucacauuugauuacguaaguuauaucacuuuuacagauagugauaaaacuacugaagacuauauaaaaaugugaacaauaggcaucugguaaauugguuaucuaaauaagcagauaaaguuuaauaggaaauuucauuucauugaaagggugaauuuugacauguucuaacaauuugagugaauggauuaugaaauuaugguaacaauauuuagaacuacagauagggcauuacauaaauguuuaaaagaagaaaagaaauaggguugaauucugauaaaaagugaccuauuagaaaaguauuucuauuccucuagggacauccguucaauuuuuguuguugcuucauugauuuuuguaaaaagguguugccuuuuaaaaaucauuuuagaaaggcaaugucauuuuuaaugacauuacuaccaugcauaguuuugugagaaaccuggcuauguuaaagccauuucauuugagauacauuuugaauugaaaguuauucuguuguucuuguuuucagaagcagauaauuuuggcgaugucuguguccuucuugucugcucuuuaucuguuuaccuaccugcuuaucacaacuaacuuucuguccaguuuuuuuuaauccuuaguaaaucagugucuaggaaucuuuagucacucaguuuugaggaugacuguguaaaugguuauaaaugauugcuuuugccuguuguguucugucagcuugguuuuugcuuucuaaaagauuacagucuccuugaauugacaucuuucuuuuuuauuuuuuuaaagucaaacucauucucuuuauuugugcagaguccuuugcccaaaauacaucauguuguccucugggcuuuacuguccuaguuucuuuuggaagaaaaaugccuucucuauaaauucuuccccacaucuuagaagugugacacagcagugcuuacuguaucacucauuggucacuugagcauaccaucuucuuugggaaucuuuuuuauguuuauuuauuuucauaugcacccagcgugggaaccguguuuuaaaccauuaggucaguaacuuagagcuggguacuugacucguaaaacgauaggcauuuaaauauucuuuggcucuuuugaugaaucagaagauucaauucuaaacugacagagaaaccuaggacuaaauuaaaaaaauauauccaggccauggcuuuggaaggguguuuggaagagcuguguucacuaaucauuggagaaaggccacggagcuauuuccucaagauuuaagacaucccccuuuuguggacaguaguaauagaagaccugucuguucuguugaacuuuccuuuaagaacuggaaaauaacugaaaccaaccacaaaauuguuucuuuuuaagaagcguugucuuccuuuccaggauccacaaugccaaguuaaauaccuuucuuuuuuuaggguagcagauuuucucacacugagacuuuuaaacguuucuguuauauuaauuguaaagugucaugaaguuggugucucaaugcuuaaaaaaaaaaaaagauccacuaaagccuucuucuugucauuugaagguuauuaaaauguaauacuucccuuguacauucuuaauacugauuuccagugaacccagggauuauuucucagagaggaaauucuguugucaccuaggcuaauaauuaccaagugcucaccaguaacaacuagaaucuucucaguagguuuuuuuuuuuuggcuuuuuuuguuuuaaauguauauggccaguugauuaguaugaauuauuguuuuguacuugcaagucaauacaagguaaaauagauaauuguuuaugcagccaaguauucuguuuuagugcacauaaauauggaguagaaauaaaaguuuccauaugaaguagauuaguaacucuagggacauuucuuccaauuuuccucaccccagguaucuacuaccauggauuuuauguuuuagucuuuugcuuuuaaaagaaaauaguuuuguaauuccuaaacaauguauuguuuguuuuugagcuuuguaaaaaugguauucuauaugugguaauuggcaacuugccaauugaaaaaaaaguucaguauauuuuugaaguguagcuguaguucauucauuugcauuccugucuaguuaagauuauacuacaccuaagcuuuugauuauccugcugauggauuuuuuguuguuguuguuguuuuacgaauagaacgcuucuaugggcauucucacacaugucuccugaugccuaugugugagauucucucuaccuggguugcugggucauaauacaugaguuuuucaauguuauaaaauaaugcaaauuguuucccagagugaucgugcuaguuuagaugcucaacuagcaguguuaauaggccuguugauccacauuggguauugugagaauucucaaauuuugaucauuuggugguauaaaauuguaucuuagugguuuuauuuauaaaggagaguaucuuuucauguguuuauuggucuuucauauuuccucuccgcaaaaugucucaucauguuuucuuucccuuauugauuuguagaauucuucauauauucuuuauacuaauccuuugucaguuauguguuuuccuuaucuuccaguguguccaguguauaauuugucuuuuacauuuuuucugugauaucuuuugaacaaaaugucuuaauuuuaaugcgaucacauuuguggguacuuuuucuguuagcccuuuugagucuuauguaagaagucuuuccuuauauuuucuuuuaaggaucuucugaaguuuugccuuucuacauuuaaguuuaucuggagucgauucaugugcauugucuuuaucugcuaggacaauuuccuuuccaacuuauucuucuauuuuagaaauaucuuagcuauguuuaggccugugcuuauccauguaaaauuuagaaucagguugucaaguuccucaguaagcuguuugcaucucgauugaaguugcauugaguuuguguauccauuuggauugaauugacaucuuuauuauugauuuuuuucuccaugaacaugguauaauuuauaucuucucuguuuaacuccaauaauauuuaauaguuuucuccucaugagccuugcucuuuuccugauggauuuauuccuagauacauuuuauuuuuuauugcuauuauaauuuuuucugaauuacacuuucuaacucuuuugucacugguauauaaaaauaaaacuuuuuuuguguguguugaccuuauaaccacuugcuuaauuguuuuauucuaauaauuugucuuuagcuucuauuggguuuauauguagguagucaucaucuguaauaaugacaguuuuguuucuccuuaccaagccuuaacucuuuuacuuuuuucucuguugauuagaacaauauacagaauacauuuaaaaaaauuccccuuaaauauuaugccuuuauaaagcucugcuaauuugauaggugagauauguuuuaaaguuuaucucuuuuauaauuaugaaggccauucuuaauucuguugcauaauauuuauuucuguaagcuaccucacuuuuuuuguaaagagguaugauacuaacaguuucuuucagcuuaguuuucaacuucuuuugcuguaaggccauuuuaagaaauguuuuggguacagguuucaguuaauuaaaauagcucuaaaauaucaaauuagguaguauacagauauuauucaccuuuuugguaaaauuagcuaccaaauuaguugcuguucauacuguuugaugcaauaagugguaaucuggaaaauggaaacauuucuauucauaaaauucacuggagauuugauuaauacauguauuucccuaaaaaacaaagcaaacugaaccagugguaacucaaggaagcauugauagagggacuuggguuuuguuuuguucuucauaacuaaaucacucaauuacagagugugauaaauuucucaagcuucugagauauuuuaggucagucuuuauauuuuuauaucaauucuguggaucaugcauuuuaagcucuuuugucucuuucucuucaaaacugucuaacgcccucugaaaccuuauuuaucaucugagaaaggauugcauuuaaaagacuuggaacaaagaguguugaauguaugggaccuuguuaaaauguugucuuguaaaaugugauagauaugagucuuuuaaguuuuggggauagauagacccauguguaauuugucuguaaacacuacagaaguaguucucaaaugagugugguacuguccccguagggguauuuaguggacaggaggggauuguggggaauuggaggggaugggagacagucccauacaacaaagaauugcccaaauccugccuaacuuuuggauuucucacgggacauuugugcuauuaaaaaaccugauuauaaauaccugagccuagaacauaacuuugucuuuacacauaaacaguuuuuuucauaacuuuauuauauguaauuucccaugaauacaaccaccauguauauaaauauuuuuuuagcuuaccgagaguuaguucaccaauucggaaggccccaucucugccaacgcugccucucaugauauucaaguugcccauacaacacauauguaaaucagucugcuuuucuagcaaucagagugaaucuguguaccaauuuguauauucuuagccucuuuuuuucuaaaauaucaaauguaaauaaaaguguugauaguagcugaaauuuugaaauuugcuuucaaccaucuuuuccuaaaugugaauagcuauuacugugucuaccuuguuucuucuuacggaacaaugaaaucacuaagaguaagugaacauuuuacaaggaaacaugcugauaaaguuggcagagauacgucauugucccucaguguaauuuguucugaccuguuauaccuacuuaguuaaaauguccucuuuaucuuaaaacauacagguaaaucugcuggugcuacguuucccaacaaugauuuuuauugcaguguccaccuauagcucuauccuuucauuuccuguaugccuuguacagaaugacauccaauucuguuuuuaaaaguauaaacuuguuauaaauaaguacaaaugucugauagcuuuguuauacauucuaguauaguaaucccugagcuauuaccuauuaaaaggcguguauuuccuuuuaacuucugcuuuauguuauaguuagagcuacacacauguacaccacccaccccacuuguaaguuauauauguuguagauuauauaauuuaugaguuuuauuuugggaugguaaaggagaagcauuuuaaaauauuuguuauaguauuggggacaugagugucuguugggcuugaaaaucuucacuuuacagcaccucauccucacacgugucuuuuaaauagucuucugccccuauauucucucucccuuccgcucuguuguacacaggaagccaaagcccucucgaaaauaccagguaucacuuccuccuauucagauucuuagccaaguuguuaccuaguauuaacauugugguauauauauugucucaccaacuggagauaugauggcagggacuacaucuugaauuucuuccugucuuuauuauuaauauaguucuuugcaucuaauguguacuccagaaauguuugcugauauuucuagucuacuuucccacucuuauagaagaaacuaaauuuggagcaaauucuccaaguuuucuuacuaaaucuucauauuuguuguauacaacugcucuuuaaauaguucucagcagaaucaucuuaauauuuuucuugguaaaaugccaucuauagcauccccagguguagagaagacauacagaaauggaaagacuuuaauacuggucugauuguaauuacaguauuagaauaaguuguggcagaagucuuuuuaaaaaauuguauaauugugguaaaagaaaucuaauuuuuuaaguuuaucuacagagguugugucaauaccauauucuugauuuauuuucuuguaacuauuuucuccaauuuugaauuuaagguuuuuuuguuuuuuuuuuuuguuuuugagacggaguuuagcucugucgcccaggcugaagugcaguggugugaucucagcucacugcaaccuccgcuucccggguucaagcaauucuccugccucagccucccguguagcugggauuacaggcaugugccaccaugcccagcucauuuuuguaauuuuaguagagacgggguuucaccauguuggccaggcuggucugaaacuccugaccccaagugauccaccugccuuggccucugagagugcugggaugacaggcgugagccaccaugccaagccaaaagugucuguuuucuuaucuccuuaaauaccauacucucccauucucaccaaacuaaaacaaaaaaaaaaaaucauucuggauuuucuuccuuugugucaauuguguucuuuauuuuuuaaacugggcauaauaggaauaguuugggcagcaucaauaguaaaucaaaucuguaguagauaccauuucacauguguuuccgugcauuauuuuuuucaaauucagucuccuugcauaauacacuuagaaucuuaugugcuaaagaugucguucccacucaagguaguguuaucugccaguugaccuuuaucaaucagauuucaaaguugguguugguuauauuguguacucuccaugugagcuuuuauuauguuguuuagucaucuuuugaaagauaguguugucucuauuuaacccuaucucuuauuagaaauuacuucuacauugugacuguuguaauaguucuuugauauauuuaccucacuuuaucaauguuucugcuuguuuucucagauucuuuuuuuuuuuuuuuuuuuugagacagagucucacucucgcccaggcuggaaugcaguggcgugaucucggcucacugcaagcgccaccucccagguucacgccauucuccugccucagccucccaaguagcugggacuacaggcacccgcuaccaugccuggcuaauuuuuuuguauuuuuaguagagaagggguuucaccacguuagccaggauggucucgaucuccugaccucgugaucugcccgccucggccucccaaagugcugggauuacaggcgugagccaccgugccuggccucucagauucuuaaagauagaaucacugggccaggcucgguggcucacgccuguaaucccagcacuuugggaggcugaggcugguggaucacaugaggucaggaguucgagaccagccugaccaacauggugaaaccccgucucuacuaaaaauacaaaauuagcugagucugguggugcaugccuguuaucucagguaccugggaggcugaggcaggagaaucgcuugaaccugggagguggagguugcaaugagccaagaucgugcuguugcauuccagccugggcaacaggagugaaacuccaucucaaaaaaaaaaaaaaaaaaaagaauuacugaauuaaaagacguggauauuuuuaaggccuuuagauguuacaguccuaaauucugaguuagcagguuaugagaauaucuguuccucugagaauuaccuuuccucuucuccuuucaaauuauuuuuuuaucugagguguuuacuuuucaauauucaauaguuaauaagucacagcugucuaggaugcaacucugauuuugauuguuaugauggauuaaagaugaccacagaugcuuugacacuccuccuuuuguguguggacugggcugugacugcuuuaaccaauaugggacaguaugugugaugauauggcaguucuaggcuuagccuuugagaggaugggcagcuuccaccugccuuuuggauccugaacugccuucuagaaguucaacuauccugagaccaccauauuugacaggacaugagcaggcauuucuggugagcauuccuagcucuguccagccuuuccuccauccccaucaaggcaccaggcagaugagcccaccuggcagcugaguaccacugugugacuucagucaauaccguguggaguacacgaaucauccagcugaacccuucccaaauucuugacucucaaaaucaugagauaaaaauggugguuguuuuaagccacugagcuuuggaguagcuuguugugcagcaguagauaacuggaacacuuacugagucucugggauuauugaguuggagugccuaugcugcucuucccaaggggaaucagccuuuuuuccuuccuggaaugguugcuuagaagaaccuguagacacccagaggaaguuacacuuuucuuuggcuuuaacuagagagccaugggagaggagccagaaauaucccgaggcuaugcauuucugaguucuaacugaagccuggcagaaauuucaaaccaaguuaucacagggaucuugugucugagagagcagacugucuucuggucaguauccuugugugucuaaugaagggaagacaggugcagggauccaucuucaggguguucuccaggagagccauaaauguaacaguaggaaaacaagcuauguucauauucuugguuucugcuuauuucucugauaaaaaaucauuccuuucauugguuucugcuuguucaucugauaaaaaaaucauuccuuuuguuaccugucaaaacauacagcccccugauugcaacucaaggugcucugcacugcguauccaagaguaaccaucacuucugcuuccccuguuuuguugcauguguuggcuagcuaccuauccauuuuuguguucucaucccuuuuucuuucuguucugucuuucacaauuacccuacuuuccauuccucuucccaucucucccaaacucugcuaauugauauucuggucauacuaaaaggcuaaucuaucuaucuuucuuuuguucuuucuuuucuuuuuuuuuugacacagucucacucugucgcccaggcugagugcaguggcaugaucucggcucaaugcaaccucugccuccuggguucaagcaguucucaugcuucagccucccgaguagcugggauuacaggcaugcgccaccacgcccagcuaauuuuuauauuuuuaguagagguggaguuucaccauguuggccaggcuggucucuuaacuccugaccucagguaauccgccugccucagccuuccaaagugcugggauuacaggugugagccaccaugcucagccacuuaacuuucuuuuucuuacauuuucaucucuuuaucccuccugcucaugucccuuccucucccucaccuuaagcacagccugcuuggguuuuugggugugugucuuauaauaauauaucacuuaguaaauuauaagcaacuugagaauaaagaagguucuauucagucauaaugcuuaagaguguucaucaaauuauuuggguuaaauaaaacccuuuauuuccauuuucuucucccuuacugaaaaaagcuacacuaauguucucuaggauugaugugcauagagaaugggaacuuaaagaauuauugucuuaaggguauguggguuuccuuauccaaacacagguaaaugagggaagagauguaaacaacgauuacucuguucuuccuaguguugguuggaguucucuguacuucuguuuccuguccaaggagggagagauccgucauucugaauuuauuuguuugaauuuaugggacaaaaaugcuauaaaucaaaucccuuguuaggguuuuccagugcguuaaauguaaaaacuugaaaaguuugcugaaaaacuugguuuccguguccauauuuaauagaucauauuuuccccagauauuuucgacuauagccauuauaagaaauauauuuuguauugccaccuagucaguacauauagcugaaacagguuuaucaaagcaagucuaaccauuauuuccuguaucauacucugauauuuucuauucacuucuaauucuuuuuuaaaaaugcucaucuggaucuguuuuuuguguguguuuuuuuuuuucauuucaaacuaauggguuguuugaaaaguauugaguuacauaauaguugcuugaaugguaagggucugauucugagucucaucagcucuccugagagaauugguguucuuagacugcauugguggcugaaucugaucagaacauuuacauuuugugaagaucuuguauaauccaaaacauucauaaugaaagauaguuuugguuuuuuuuuuuugacagagucuugcucuguugcccaggcuggagugcaguggcacgaacuuggcucacugcaaccuccaucuccugggcucaaacgauucuugugcuucagccucuugaguagcugggauuacaggcgcacaccaucaugccuggcuaauuuuuuguauuuuaguagagacgggguuuuaccauguugcccaggcuggucucaaacuccugagcucaggcaauccacccgccucggccucccaaagugcuaggauuacaggugugagccacugcuccuggccaaagauagguuuuauuauugggaaaaaguguuaagauaggugaaaucuauagucuuugcucaaauguugcuuuuuauuuucuaagugucaucacuaguguuuugcagaauguucucucaacaagcaguacugccuauugagguggguugauuuguuguucugaauaguucugccaccuccaauuucauuuuaaagucauugauuuucaggugcauuuguaaggcuagcaucauuaauaucagcacuuaauagcuaacauuuauuaacuacuaugugcuaugcaugguguugagugcuuuucuuagauuaauuuaauccucagcacaacccagugcggauggagcacucucccaguuuacggaggaggaagccgaggcauagaagccacacagcuauuugugaggauucaggcugugcacucuagggucugguuauagaggcuguucucugaaucacacugugcucugccucagaauaaaaugccuucuauacaacguggcuguaaccuuaacuucuggggacugguaucacuuguuacucuuuccuaaauuuuggggucauuuccaguauucuaauggcaacgauacuauaacacagccccuaggauacugauauucuguuauauugagaagaaagcagggguaaauaaggucuuuugacauuuuaaugaacugauugcuuaggguuucaagauuaacccaccccguauauugcaaggucgcuucucagccugaaguuuacuuaggugaaaaacaggacauuuuauuucuuuagugucuacuuuaugcuagacacaguuccuggcuuggagacuacaaaacucaauguggagcauuuggcuuugauuaagagggaagccauugauuauucauagacuucuaggaccacagccaccuuagagccuuaggggcuuuucccacuugaccccuucuucuacugaagaggagcaggccaggaagccagugguuccucaugguaucaggauuccuuguucuuggugcucuauuguguugccuuuucuucugccaucuuauuccuuugauuagugagaacuuugugcaucuuuuuuuuuuuuuuuuugagauggaguuucgcucuuguugccuaggcuggagugcagugacgcaaucucggcucacugcaaccuccaccucccggguucaagcgauucuccugccucagccucccgaguagcugggauuacaggugccugccaccgcgccuggcuaauuuuuuguauuuuuagcagagacgggguuucaccauguuggccaggcuggucucgaacuccugaccucaggugauccaccugccuuggccuccggaagugcugggauuacagguaugagccaccgcgcccggacacauccuuucuuuaucauuucucuuccuagugugugaaauguggcgauagauguuuauaaccacuuacuagggauugacucagcuaugaacuugauaccugcuuagggugacuaauuuagccucuugaagccucaguuuucucauuuguaaaaaaaguuaggguaaaaauauacccuauuguguaaaaaaaaaaaccuacuuuauaggauugaugugaggauuaaaugaaauaaaggcauuaggccgggugcaguggcucaugccuguaaucccagcaucuugagaggccaaggcgggcagaucacaaggucaagagauugagaccauccuggccaacauggugaaaccccaucuguacuaaaaauacaaaaaugagaugggcauggugucgugcaccuguaguugcagcuacucgggaggcugaggcaggauaaucgcuugaaccugggaggcagagauugcagugaacugagaucacaccacugcacuucagccugggcaacagagggagacuccgucucaaaaaaaagaaaaaaaaaagaaauaaaggcauuaauaguguuuaugugguguuuggugcaaagcaagcauacaauugaugauuauuuuucaugagcuuaauaaaauugaggguguagcuggggacaccuuuuggaagagagagauuauagaguuacuguuggauuaaaaagugucuuguguauggaauaagaaucaaguggcauuuuuauauuuuuauauuucaguccucuuucuuuaguaaagauggaguagaacuggcccaguccccucugcugcugcccagugcugcugaaagggcaguguggugcagugguuagagcaugggcuguggaggcagauggaucucaggccagccaugcuucagcugccugcugccaugugucaggccuccuuggauauaaaguuccauaauuuccucagguauuaaaagugagccauaguguuucccuuaugggauuguaagguuuaaauagaauggugaacauagagcagccagugcagcacccaccccauggucgauccacccucugcuuccuuuucauuuucucugauacuugacgcuugccauauaugggcuccucuugcucccaguuucuguuucuucccuguaugaccuuaccaaaucugguguguuuauuauccaccagucacgucccacugucuuucaaggccugaccugagccaucuucauccuugaagaguucuuccacccuccuccccccauccccccguucaccaauucauugaucuguccugaauuucuccaguaauaccuguuuggcacuuaacuaguccaugagggggcauaaagggaccucguagaccuuggaagucauuuagucgaccacgcucauuauacaggugaggaagcugagguccagggagauagcaauugcuuaagaucagguuucccauuucuagacuagagcuuucuccaccacccuauguaccguuucuguuuuuaagccuguaaaacaacaaacaccacaauaaacaccaaaaccuggaaauaggagauuauguaugcagacuuguacuucaugggacagagagcugcuucuggguuuguacucugcucagaagguguaugcuuuauuuuacuuuaguugguagguauacuauaugaguaauucucuuuucuuuaaaauuguaacacaugaauuaauaaacauacauuuacuaagcaucuccugugugcaaagcuuugaggacugugagcuucauaaaagagucugcgcuuucagggccuacuugggcuguuaaaaagcuguaaggauaaggaaaaugcaauccguauugagauucuugagcuuucuaaaguguuguuuccccacaagaacuaaaaggaaacagauucagagaaacacagauugguguucuuaccuuguucucuccuguacccucuccaagaaaagguauuuaguaguggaagguauauucguuuauauuucaaaggcacaaugaugucuguuucacagcuuucuggauguggugagggacuuuauuuggucagcccucauuccuuaccacucccuuugcuaucuuugauggguaagcagauuucaugaggcaggccagucucucguuucacuagguugccugacucucugaaaacuuccugacuaucccaaaccauauagaaauuuauuuuaaaaguuugacagcuggccgggugccguggcuuacgccuguaaucuccgcauuuugggagcccgagguggguggauuaccuggggucaggaguuugagaccagguuggccagcauggugaaaccccgucuccacuaaaaauacaaaaauuagccgggcaugauggugggcgccuguaaucccagcuacucaggaggcugaggcaggagaauugcuugagcccggggagguuacagugagccaagaucacaccacuccacuccagccugggugacagagcaagacucugucauacuuuuuuuuuugacagcugucaaacuguagccuaagccugaaggguugggaaguugaaaauauaugucauauauaucaugcucauuuaaucucuauugagauguucuuuuuuuccuucuuacauaaauauuaugugcucuaacuaaacauauuauauauuuuuaugugcaguucaaugcauaaggaauugaaucacaauuggaaguccucuuuagaaggauuugcucuuguuugacagauaauagcagacuucaucucuuuuuaaaaauaaaccaucaguuuaugucauugaguauauuugauccuucuaaaaagagguucucuuucauauuuauuuuuugucuaugauguaguuuucuaaaaguucgucucuauuggcuacuucauuucuguucuaaauguaguaaguucuuggaaguguacuuagaggcaauuuaaggauuuuaucuuaagccugcugacuuguguaguugaguggaugcuaguuuuuggucaguuguucuauuucauaccuguaacauaaggauauugagggugacugaauuuuacaaugcuuugcauuuuguacaucuuuauaugugucugcuucuugaaaucauugcuuuuugugauaaagacccaucuaugguuauuucaauuugcuuggcagguguauauuuaagucugguuuuguuucuucuagacaguuauuugauaauagagauucauauuguuuucugucuccagcaaauacucacugaaaugaagaaugauggauuuggugauuugggagucuggugugugaaaacacaucuuaaaggauucagguuuaaguuuuuuaguucuuauacacgguucccauuuuucuguaaugucuucuuaugucucaauauguaaauauuuugucuuuacuuauacuaauguuucuuguuacccaaauuaucuccuaagacuguuuauguagacuugaaauauuucuucugucugugggugugggugugaguaccuucccaaaaacauccaggaauuuuugcccaccuacuugguuucccuggagcaugaaagaaggugauuaaugggguagaaaaaaauucacaaaaagccaccaacaaaaagcuaccuacauguuuacauguauuuuaaaggaaaagccugucagcugcaaucaaagcagcaagggcucuucaaggaagguaauaucuauauguuguucuguuuuauaacauguaaaauuuucuccccuugggaaaaaacgucucacagaagauuuucuugcaagaugacuaugauaugacaggcucuguuuuuguuaugcauaggcaguugcuucuauuguguucccugcagccuagugcguguguauuuucuuagacucaucugguagugaaguggccucuagcucaggucuucacaggcagaacauccaugcuuugaggaggcuguauuagcaaaauaagaaaccuacucagagauaagggagaagcuucauuguugaugcuguuauuaacucaggcucagcuuccugguuugagagauguucugaauacauauugauggauggguuauuaauacauuacaucaugguggaacuuggcaucccagacuggauaagcccacuugcccuguuauauaccagcauuugugguuuguauuaauaacucuguaaucccagcuacauggaaggcugaggcaggagaauugcuugaacccaggagguggagguugcaguaagccaagaucaugccauucuacuccaguaugggcaacaggagcaaaacucuggcccaauaauaaaaauaacuaacccagauugugugacaggagauaauggaaaugaucugaguggccaccuaauuucagugaaggaacuagccaagguaagugacuugcucaguguaaguccacaacuaauuuguggccacucaggacauugaacugggucucggagcaaauuauaagauagguaaaacagaggggacacaaacguggaauagugagagggugaggagagugcaguucaggcugggaucguguguggcauauucguaggaaaccacagaaucugaaguuaguuagguuuggauuucauuuaccacuuacaaacuacgugcaucagaguaagaaauuuaauuucucugacuguagguuccuugauuauagagauguuguaaagauuaaaugagaugacacguuggaaguuucuggcacuguguaggggacaucacauguuccaugauggcagcuguuauuguucugguaccugaagugggaaggggagcaaggaaggaaacgugaggauugugauaguagggagggcucuguugauuuugaaaggagaguccuuucaaagcaagccuuuagaaaccucacaucugaucaugccacucacugucugcuuagaaaucacccuuggccccucaucauguagcuagacuuuuaaguccuugugaaugugccuuucccacuugcuccuugcaauccauuugugcuguaucucuggcaguuccuggaacaugacaugcauuuucauuuucaucuuaaguaguauggcaugcaccaauaguuccagcuacucaggaggcugaggcaggaggauugcuugagcccaggaguucaaggccagccugggcuacauagcaagaccccaucucaaaaaagaaaaaaaaaaaaaaagcaauuaccccuuuacccugucccucuguccugcauuugccauccuuuaagacucaauucaaacuuuauuucuacugugcagucucuuggaccaggcucuccucaugucuuacuuucucuugcagugacucacuacgccuauuguguuuccauaguacccuguacacaauauuacagugcuuacuacacuguguccuaacgauuuguuuacaugucugacucauaauuaucauuacauucccuggggacaagagcuagaucuuaaucauguuuguauucuuagcacuaaguugaugccagacacacaguaggcacuuauuagaugcuuauaugaccgaaugaaugggugaaaagcagaaguagagaaguuaucuuaaguugauauaacaguaugagcaaaauauggaugcaaaaucagugcuauugugauggcaagaaugagacaguuugagaaaauaucguguugagaaguagguuuguguaaaauagagauaggaagauaugaucacuucaugaaaggcuuugaauaugaagcugaccaauugagauguguuaggaaggguagccauuuuaguuuuuuugucagaagugacaugguuagauagcagaguugcaggaaaauuaguauaaugguaguagguuaaguuauuguagcaauccagaugugaguuaaugagggauaggacuagggugaugucgaucagaaaggcaaaaggagagacacugaaaacagcaaaccacaaaaacucuggcaaaccaguucacuuuuagauaucucacauuuuggugugccaagguucccagcccccauacucccuucaaaaauaaaguccuuuccauuuuagucuuugguuauuagugugugaaaacucugccuaaauccugaacuuucuacucugauuugucagaggaacaguucuuucaguuuuaauuuuugucuuuagauuuuuugguugguguuuuuuuuuucuuccccuaggcucaucuguauaggacugugagcccagaaggaaaguugggaaauaauuugucaguauucuuuggcauuuacaagauguuccuauagucucauuauaacaugguuuccugacauuuuguuaugguuguuguugauagugcuuuuuggaaaacaacaucuauaucuuuuuuucuuuuuuaaaaagugcuuauaucuuuuaaguuuuauguuacuuugagauauuacuguaaguucuuuuguucauagauuaugaaaaaugucaaaaggaauucuaaucagaaaucaguuuugcucugugaauuuguacauugaaauuuaaaugauucuaguuaauacauucugucucuuauuuucauuuaauguugaggugaauacacacauguaaggccauauaagaagagaauaacuaaugagugccuauucuguccagucuugggcuucacagacaucauuuauauugaaugcucauaauaccugauaaaguaaauauuaauaaucuaguaaggcaauuaagacuuugggcaauuaaauucucacuguacgucauugggacauggcagagaaggaagccuaugucuuuuucugacuauagugccaguugacucugcacguuugcauacagcaguucucagaucuucuuaguaacagaauccuuuaucccaugaaaucagacucccaauauauaaaacagguaagaauaguguucaguuauauacguuuauuguauuugguacguuaaauuuaagguggaaaucuauguuucaaucuucacuugguuucaucuuaaaacuuauuucuauauauuuuguuugcaaaauuaaaaaaguucaaaguuucaaagauacgaagauucuaauagcuuuuuugcugcaucaauacuauuuucuugucagaacaugauaaaaauuacaauguggaacuuuaauagcuuuuuaaauaguuugucuuguaguuucagggcagcauuugauuauaugggugcagaaaacuugagaaauaggaggaaauuuuguuuuaaaguuguauuaggugaggugcauggaucaccuaaggucaggaguucgagaccaccuggccaacauggcaaaaccccuucucuacuaaaaauauaaaaauuaucugggcgugguggggcgugccuguagucucagcuacucgggaggcuguggcaugaggaucacuugaacccaggagguggagugagccagaauugcaccacuacgcuccagccugggugacagagcgagacucugucuaaaaaaauaaaaaacuuuuauuuacuggccgggugcaguggcucacgccuguaauccuagcacuuugggaggcugaggugggcagaucauuugaggccaggaguuugagaccugccugggcaauauggcgaaaccccaucucuacuaaaaacacaaaaaaauuagcugugcuugguggugcaugccuguaaucccagcuacuuggguggaugaggcucaagaauuguuugaacccaggaggcagaguugcagugagucagcaucacaccacugcacuccagccugggcagauagagcaagacucaguaucaaaaaauaauaauaaaaaaaaguaguauuacuaaucauauuuagugacauccacaguaguuaucaguuaaguacauuuugagggcaggaagggaguuagugaaugccuccacauccaauauuaaauucauuguuuggcagaaaaacaguuuuugaauguaccuuguaauauuuuaagauguuacuuugaacagucaaaaaaggcugucagcuuuuuacucaaaguuccagaauagucaaauuucuuuuguuuuacauguugagucuaaaugaacacuuuucugcaguccuuaguguaguaagaugggagcuuguucagcaagauaggcaaguucaugcauaugaguuuuauuucagagcuaauugacauaauuuaucaaccaaagugauuuauuuuuaaaacaccucauuagaaauacucagaucugcacauugccacaaagcaaaugaaaauaaguuagaaguuggaguuguaauguauuggguauacauacccugguagugagaacuuccaagguaccuuagugaaaaugacagccuaaauggcguugucuguuacuauuuggaagaugcugacaucugauguuucuaacugaccacuagaacaugugucagcaguugcuuuuguaggggccaugcuauucuccugcucucuccuaucauugcuuuaaacaguacacuguaaugucuuauaaaucuuccauguauuuuuucugcagaaacaaaaacaaacacaggaagacagagacacaucugucucaucaauuccauuugaaucauuauaaagaguuuagucaaauucauacaucggaugaacuuaucaaauacagagggugcuuuugcuugaaaucuuccccaggugguuuugugaggauaaugcucuuaauuuuauuaauuuuauuuuuguaauaccuugcucauccaucguaauugauacggaucccuccauugccuuuggauaauguuuaccucgcacguaguucauucuguguuaugauaauuuacuuugaaugacaaauuacuuaaauuuuuauugacaggcuuuaaguauaaaaaagaccugaaauuugaaaucuguauuagguauugugaagcaaaguggguaaacuuuauuauuguagaauugacucuuaaacuaugaccaaguacaggcaccagccaggcagauguguuuaggcuuucucuggcauuggagcaugguacagggcaguaaugauguaagugcuucuauauauauguauauauagucaugcauuacuuaacaauggaguacguucugagaaaugcucguuaggugauuuugucauugugugaaugucauagggugaacuuagacaaacuucgaugguaugggccuacuacauaccuaggccauacgggauggccuauugguccuaggcuauaaaccuguauagcaugugacuguauugaauacuggaggccauuguaacacauugguaaguauaguaaguccuuacuuacuggcuucaauaugcuucuggucacaaaaacauaaccaaacauaaacacuucuaaaacuaaacuuugaaauaagcaugaguuauauguauauuuuuaaaagauuaauaaaaacaaguaagacaauuuuuacccaauuuuuggugaaucaaugaguaacaguggccguagugguguuggguuaaaucaaggaaugaaguuuguaaagcaaaaauuguaaggggcaccuccuguuaccauauaauuaaaaaacaaaccaaaaaaccaaaacaaaauaacaaauauggcaggucaccacauacuuuuguacuguaucguucauuaugauacauuuauaugauuacuguuuauucaaugaauuuguaguugacaauaauuuguauucauuuucugacuuauucuaguuuagggucauauguggcuggagccuaucccagcagcucaggaaccaacuuugcuaggaugccauuccacugcagggugcacucacacacacccacgcucacucagacuggaaccaucuagacaugccaguuaaccuaaagugcacauauuugggaugugcacauggggaaaaugugcaaacuccacaaagacaguggcccuggcugggaacugauuuuuuuuuuucuuaucagcauuauaacugaacaguguugaaugaaacaauguugaacaaaaugacacuacuuaaggaccugcuguauuuguguaucuaaacaugccaaaagauaggaaaagguacgguaaaaauacgguacuauaauuuauaggaacaccaucuuauaugugguucgucuuugacugaaacauuguuaugcagugcaugacuguauguauagcgagggagacagagacuguauauauauagaaagagauuuaaguaauugacuuaugugauuguaggggcuggcaaguccaaaaucuguggggcaggccagcaggcugcaaauuuggauaagaauugauguugcaaucuugaguccaaaagcuggaaacucaaccagaauuucuagguugcaguuuggaagcagaauuccuucuucuggaacuuaagucugcuauuaaggccuaugacacauuggaugaggcccacccauauuauggauuuguuuuacucagagccuacugauuuaaauagguuaaucacaucuaaaaaugcuuuaaaagcaauggcuagacugguguuugaucaagcagcuggauaccguagccuagccaagaugacacaugagauuaauugucacguguauauuuuugauuauaauuuuugaaacauuaauauuuuaaaauuaaguuugauucagugugaauaugucuuuggaagucuggagcucugagaagaaugacaaguaguuguuuacuuugagaggcaaaugguauugaaagagccagugauuugcagcugggugauuuggguucaaauaaauuccagcuaugccauuuacaguuugugugacuuuggucagguuucuugaacuugagucucaauuuccauguuaauaaaauaagguauuacuuuaucaagcuacuuuaauaagcgagagaaugcuuguaaaacucccacugaagugacuggcauauaguggcauuuaauacaugauaacgcauuauugucauagugauuaucauuauaagcuuagguuuauauuacaaaguuuuuuauuucccuuuauaucuuuuaaacuauauccuuuuaccaaguguacuguacuuucuguaguuugugggaaaaauugaaucaaaaucuagcauucucaacuuuagaguucuuuuuucuaagaauguuguaauugaacaacuaaaagagacaauugacauuaugccaucagaggguuggacgaagguuaacugagguauccugaaaagcaucugccaugcuggagaggauguggggaaauaggaaugcuuuuacacuguugaugggaguguaaauuaguucaaccauuguggaagacaguguggugauuccucaaggaucuagaaccagaaauaccauuugacucagcaaucccauuacuggguauauacccaaaggauuauaaaucauucuacuauaaagacacaugcacacauacguuuauugcagcacuguucacaauagcaaggacuuggaaccaacccaaauguccgucagugauagacuggauaaaggaaauguggcacauaaacaccauggaauacuaugcagccauaaaaaaggaugaguucaugucauuugcagggacauggaugaagcuggaaagcaucauucucagcaaacuaacacaggaacagaaaaccaaacacugcauguucucacucauaagugggaguugaacaaugagaacacauggacacagggaggggaacaucacauacuggggccuuucaggggguugggggcuagggaagggauagcauuaggagaaauaccuaauguagaugacagguugauggguuaaugggugcagcaaaccaccaugcacauguuguguaccuauguaacaaaccugcacauucugcacauguaucugagaacuuaaaguauaauuuaaaaaaaaauguaaagaaaagcaucugccacagagcuugggccaauaaguuugguuuauuguguuuuagucauugguauauagcuuuucugaaguuaugcauuacaguuaauuacauucuaagagugcauuauaagguuaauuucuuguuuugauaccaggguuuguuaaaaaggaacaauauuuucuagaaaagcuuuaaaguagucauauucuuacagauuuuaaaucuaggacuuugucuaacuauugaugauuuauugaguagcucugggauuuuuuucagaaauuaaaaaaaaucuuucaucuguacaauuuuucaguuuuguuuagaauucuuuuuuugucauugcauuuuuaaagcacucauuuuaauuuaauaaaacgaugagugugucuccuaaaguugaccacacaacugcaaauuguauuuuuugcauuucuuuguuggcaguaguaguuuccuauuggcuguucuguacuuauauauauagauauacauauauauuuuuguuguuguuguuguuguuguuguuuuugagagacggagucucgcucugucacccaggcuggagugcaguggcaggaucuuggcucacugcaaccucugccucccagguucaaguaauucuccugccucagccuccugaguagcugggacuacaagcgcacgccaccacauccagcuauuuuuuuuuguaguuuuaguagagauaggguuuuacuguauuggccaggcuggugucaaacuccugaccucguuauccaccugccuuggccucccaaaguacugggauuacagaugugagccaccacgccuggccacuugucaauauauuuaaaaauuuuuuuauuuuuggcuugucaguauugaccuuaauauuuguaguauugggaguaucaugauagcagaaaggacuuuggaaaaucuauuauuagagggcuucacaugggugcuucuguaauaaaaugaauggugaaaagagacuuaaccauuuauaguuguuggcuucggauaaaucucccagaaaauaaguggauuggaguccauuaacccaagcuucccaaagcauaaugggaguugagcuuagggccuguuuccuagugagugaccuacugaggcuuaggggcuagaucaaaaggaucugguaguacugaguuucuuaguaccaaauugaaaauggauuucuuuuuuuuaaaaaaggccuuuguuacaaucuuauugccugagaugauguaacauguuaauggguuauccauuuuguauuguuuuuuuuuguguguguauguguguguguaaagaauacacacaaucucaaugcugaaaugaauuugaaauguaaacuaauuauuuucaagugcauaggauauuacagucuaagguaagaaacaguaagcuaguacucauuuguugugcuaagcaaauuacuaauuauuuaggugagcaugaagaagaaaaccaaaccagaaagguuuagggauauuaauguucuucaaauuaguuaagaaaguuagcagcagccacugaaugaggaccuacuauguguaagcauauuuuaugcucauuuuccucacaagaacucuaugaaguagauaucaaauuauugcaggucucuaauugcauauccagcacucaaggcaagagguguuucacaauucaugacuuuuuuagguuuuuagaaaagugacacaugggcugggcacgguagcucaugccuguaaucccagcacuuuggaaggcugagguggguggauccaugaggucaggagauugagaccauccuggcuaacauggugaaaccccauugcuacuaaaaacacaaaaaauuagccgggcaugguggcgggcgccuguagucccagcuacuugggaggcugaggcaggagaaucgcuugaacccaggaggcgaagguugcagugagccgagaucgcgccacugcacuccagccuggcaacagagcgagacuccaucucaaaaaaaaaagaaagaaaagugacacagguauauacuuuauaucagugguccccaaccuuuuuggcaccagggacuuguuuugugggagacaguuuuccacuguugaauucugccuggaguauauguuuuaaaauucaauauguaacuucauauuacagacucucuacuguaccugcuauauuguguauuacaacaacaucugaacucagugaaugguuuuagguucauugucaggacucuggguccauuuauauggcauauaagcauuuuaacuuguuucuugccauauuuucaaaacagccuuguguaugucugggaacaauaaauagggaguuucauuaucacuguugugcuaaugcauguuuaaaguuagacagaugaguagcuguucaucaauauauguaaaaccuagagaaaugauuagcuauucaucaauauauguaaaacuuaauuauuaaaaaaauguaauguccuaugucugugcacugggagauccaggaaagguaaaaguuaagucauuauccucaaggagauuacagucuaguuggagguguauauuauacuauuuauucuguuguuucagugggauuuguugugggagagaaagguaaguuaaacagaaagccugaagagaggucuggguguccagugugucagggaaugccuccuucuuguagcauccaaccagauuguuuugggaguuagaaauguaaugcagucagucccccaacuuaaagaaauacagcccagaccaucugguaugucacaguugugugguaacagcaguaaggagcaucggcugagucugaggggagagcugggugcuccuugcaccucccuggcccuggcaggucucuuugcugaucuugugcugcuuucugaggagccuguuuuuagaaugcuucuccagguagccagcaccaguggaccaucauugaaguaggaguggguguugaaagagauagggagggcauuccagguagauaguguggacaaaggcaccaagccugaaaaaagaauggcccgguugaauaauuuuaaguaguuugagauggcacagugcccggcacacagucucuucauaaaugauuacucaaagauugagugaguggacagaugaaugaaugggcuagauuguggcaugugcguggaauuagguaagagauucuuagacuugaucauaauugccuaguaaaucauucuuccauagcccuuuuauaagguaaauaccuagucauaaaguucaaucugugauucacuaguuauauuugcaaauuauuuagucucugggccuguuuccucaccuauaaacaagguaguuaggcuugagaacuccucuauuccuuccaucuuuagaauagcuaugauuuuaaguaaagggacagggaccaacuagugcuucuguuggggguucagagcugaaccucuucugcuguccuggcucuuuaggcaucucucuggccugucacagagguuggaugacugggaugccuuguggaugcccagauguuccugggauacuuccaguuuugugggugaugguaaugucuguguguucuuccuuugucaucugggccgugauuugaaggauauacuaccauuuguauuuaaugucuaggguggugagauaagagcuccuauuagauuuuuuaacuagaaauggaauaaaugcuguaucuaguuaauaauuaggaaaacuuuacucauauuuuuuauuuggggcuuaaggagaaaauaaacuuuaauuuagggauuuuuuuuuuccugcuugaauucaguagggucuuccucaaaaucuuaaaugggaguucucaguuccccuuguaaugucaaccucggcaaauuucuucuguugauauggaaagaauuguuggacaggugguaaggguaacugagcaguggguagggaugaguucaaagaagagaaauccuacagacgaugguugguuggaugauaaauaugaaggauugugugcugauguauucccugugguggucugcaagagugugugggagacauuuguucucauuuccuguuucaucacagccugccaccugcugugucgcuauacaaaguaacaucacuuuuaaagauugcuguuuaggaaaucauguuuuauaugucaggaagcuggguuuuuuuuguuuuuguuuuuuuuuuuuugagucccauuaaagacugauccaggaagcaucucucuauaugaaacuugguguguauguguguguuuguguguguguugacaacuuaggaaauuggugauugaugcagaaaggaagacaaugaguaacuugggauugugccuguauggauguuuugucuacacguggguggaggaaaauacuugaugcuguguucuguagcuauuacccuguggaguuucucacuugaaaauugaagcuguguccagauacagcuguaauucagaauaauagcaagcauaguacugucuuuguuuuucugggcccugggaagacaagucuacagcucuuugagguucaugugugacucuacauuccggccucauuauuuggagguuugauauuugcauguuugccugcuugcuaagcuuugaaaccacagaaaucaaucuuuaugguaguuuguggucauuugggacaucugcagagcagugaaaaauuugagucccugaaacacacacagcucagcugaaguaaaaggaggugauguucugccuucuuguuucagcugcacugcuguaaauaaauaucacuuucuuagccuauuuaaugccguauuuuccccauuucuguccuuuuuauuggugauuucacugccuaacaugacccucaagcauagugcugaagugccgucuuaaguucccaaacacaagaaggugugugccuuagggagaaggugcaugugauggguaagcuuuguucaggcaaaacacauggaaaacaagguuauauucuguccaguugacgaaaauguugagaccagagguuugcagaugucaacuucugaaacaaugauucuguauucucuaaugcaguguuauguuauagaaauacaaguaccaugagcaguaaaaauuguauuuagaguagaagcuaauugguccuagucaugguucacauaucugggugaacauggggaauuuuuaugccuugugaaacauauuuuaaaaguuaccuuuugaaaauuaaaggaacuguuugauuuggagcuaagaacaaauaauagcacauagguaguuugacuuucugaauucuuuuaagucugcuauuuggaggcacuguuugucauaaugugaccauagugagcuucugaguauggaugaaaucuuguuacaacacauuccaaagacgaugaggcauggggacauuuaauucaaguguucguugcagggucugcagacagcucuuugaauaucuuaaacuccaaggguccugucugacuuauguaucugucugcuuccuuagaggccagcuucauagagagcccucuuuccucagauuuucaacauuguauuccguuugcaaagacccuucuuuauggguguggucacuucuagaacgaaugccucaauugaagcugggaaaugguggaagagacuuuuuccaaguugcuguuacugggagcugugagagacuauugaggugugauuaaugaaugucuuuuggguauugcagguuaaaacagggguccccaaccccugggccacgaaccgguaccagucuguggccuguuaggaacugggcugcacagcaggaggggagcagcaggcaagcgagcgaagcuuuauuuguauuuauagccacuccccguugcuugccuuauggccugagcucugccuucugucaggucagcugcagcauuagauucucauaggagcaugaacccuguugugaaaugugcaugugagggaucuagguugcgugcucuuuaugagaaucuaaugccugaugaucugucacugucucccauugcccccagauggggccgucuaguugcaggaaaacaagcucagggcucccacugauucuacuuuaugguuaguugcauaauuauuucauuauauauuacaaauguaauaauaauagaaauaaagugcacaauaaauguaaugugcuugaaucauccugaaaccgguuccuggugccaaaaagguuggggacugcuggauuaaaggacagagucagcuggacaucauuguaacaucauugcuugguguuuuaguagcauuaagacuuaaguuuugcuuuuuaaauuuacuucuauauguugcuggagaggauuuacuucugucucuggugauauucagcuagguuuuuuagaauggucugucugugggacaagaaaaaaaucucagcuaacaaaauagguagggauuucuggauguaaaccuaggagaaguuaggaaccacagaaguaagccuuaaaugccuuuuccaaucugaaagaaauagcuauaaaaacaaagguuuuggcaggcuuauggggagacagagucagaguucagggccuuucaaagauauguggucugauaaccucccaaaccuuugagcuuguucucuaaaaagcuuuuaucaucuguguaaagggaaaacagaaauacaccauucugugaguagaguuggagccagcuuugcaucaccuagguaacccagugggcacucaagccuugaacuuguguuaaggucaagccaguuugguguuacucccaggugucugguauaagcaagugaacauuguuuuggagcaagauacuaggccucaaaguacucauauauauguguaugucuguuuuaaaauacaguguccagcacauagucaaagaugguuaggcacauuaaaaaauagggcuauaaaugaaagaaaaccuagcaaaauaauagacaagagaagcagauacccaaauuucagguauagaaauuacagcuguguuuaguaugcuuaacagaaaaaaggacaaguuugaagaucaggccacuggaaacaacaaaaaaguggcauagauuacauagauuagaaaacaaccuuguaauucuggaacuaaaaaaauccauugcuggguuuaauuugcaggauuuacacauguugaccuauaauuuuucuuacuccuuuuucccuuaucugauuugguaucaaaguuauacuagcuucauaaagugaaauggaaaauauucuuuauuuuucuguucuaaaaaaaugaaauuaugcaauuauucaaauggaauacauaguaacauuagucauauguaucuuuuacagacugacagguuagugccaccaaguauucacaaguuucuguucauagaguauuuuuauacaaaaaaacagugaauuuaauagcacuuuuuauucucuugaguuuuagggacguacaacucaggaaaugcugaguauuuggaaucuaagagugacaugugcauguguaaaauaagugcuguuaucuaaaaaauacaucauaaaaguuuaccguacagugugugcacccuuggacaugaauagaagacaaaagcaauaaagccacuuaguagugguuuacuaaguguucugccacucuugacaggguccuggucuaaagcuggcacugucagcaugugaaaggcugcagucuguaaggaccuggggaagagaagacauuuucuguaugaacauaauuguacaguaauauugagccugaguugcagguuuuauaaaggaagaggaggcuaaguacuuacugaaggaagagcuagaccuuuucucuuuauucuauuaugggagauuuuugacauuuuaugaguuagaaaaaguuaucuuuuucauucugaucuguuaguuuuauaccuuuaauccccaaucuuacugugaauuacuggagucuauuuuuaaaaucuuggaaauuuuuuauuuagugcugcaaaaaagaaaaaugaaacuuuaccugaauacuagguaacugaauagacauaacggaaaccucuuccauuuaucuaccuuggguauauauauuggccuucaucucauuuaguuuuuacuuccucccaaauucagacacaaccucaaucccacuuaagacuaaaagaauuauacugaaacaagauuugcccacugcuuauauuuuucuugucuaacggaaaguauuuuccaagauagauuauuaaaauuauagauacauuugagcaagaaugaaaaagaaaaggguuaccucagaguucugucugaugugggcuuuuuuuuuuuuuuucgagacaggguguuacuccuguugcccaggcuggaguguaguagugugaucacagcccacugcagccucgaccucuccaggcucacaugauucucccaccucaaccccaaguagcugagacugcuggugugcgccaccacacuuggcuaauuuuuacaaggacaggguuucgccauguugcccaggcuggucucaaaguccuggacucaagcaauccacccaucuuggccucccaaaguguuggggauacaggaaugagccaccgcgcccagcguaucugauguuuuuaaucucuuuacaagcauggguuccaaguggcuaucaguccuguggucucuaaacuuugauuaagcaugcuaguaguaaaauauuucuuggcauacuccuguaaugccuguaaauugauuuauacuuacaaauaauacacauauaugguauaguaauauauguauuacaaggauaggaaauagcucagaaggauguggcaaaacuaaauauaguguuuuuaauauuuucuccacaucucaagggaccucuuguuuacucauuuuggauacugaugauccagacuccccacuccuucucucagaaacagggaauuuacacuuucuagaguuagcccauuucaaguguuguguuaguuuguauaguagagugauuggaaugaguagccacaagcauuugauggagcaaaacucucauauucugggagaguuuuuaaaacuuaauuuccuuucaaacagauccuugaguucuggguauuugaaauguuugguuugugacuuucagccaccuccuuuguggagaggaagaauaagagcuauuaaaauaacaguuucuuaauuucuuggcacucugggacauaugaaaucaguagauuugacauuauguugucuggucaauuucucuaaauguuucugcagcugucauaagcaauggcucauaaaaccucauucugucauuuugccagaucuuauagcaauggguacagagagaacuuuuuuuucuuuagcaauuccuuuccaacaguaaaccuguaacuaugccuccacaguaaagaaggauggauaugaagaaucccaucacccuuuggaaguuugcgugcuuuccaagcuuuuuuuguuauuguugggcacacuuuauauucaugcuuucagcuuccuuucguuuuccuuuaucccugaguagggaagaaggacauuuugucuaauugagauuugucauuuuuaauuguuagcaguaaggaacaaaagagugcugcagugggauuuuugaugaaaaaugagaaacuugagggaaagcaccucaguaguuguacuuugcuccuucgauguuuuccaugaccguuuguucauccuucuuuaccaucuuuguccaucagcccaggggagcaguggaaccaagcugggugagaaggcaggaggggcuagccuccauuuucucuucccuaguucuucccccucacaccagcauauccuaccuuuguagcccuuuaggaagagacaguguacccagaccauauuucaucaaaucccccaucaagacaaaguccgucugccacuugcuuuccuucuuuucugccauuuguugccaguccaucauguggauauacugucuaauguuguagguuugaccauugguuauugaagcuuggauauacauuuguguagaaaaucacuggcacucaaaacauuuguacacaugcagaagaaaaaucucuuagagaccccacugugucuccccuuaccaucuaauaccuuguccuaaauacuuaaacacagaaaaauaguguaacuuuauacccagguacuuaaagaaggaccucuugauuuuaguuguuaccuagugacuuuucacugcggucucuugaaguagccaagauugcguuucaugaguucauuuugguaacugauguaauuaagagauacuuuggagaacaguguggguugcuuuugucuaauuuagagaaaacagaagaaaggaccuaaaaggaaaacaaucucaaacccaacuugccccugcauuucuccuuuuuuuuugaaaagcauggaugcuuggugaaagucuuagggaagugauuccuuugaaguaccuaggagaauaauuauauagcauuuucauuuuacauugugauccuguuagucguuuuggagagggaagacuaaugauagcagacaaugcuggcuauuugcaggaaugccuuucccuguauccucuucccuguugcuuguucucagugcuguucugaugacuagcucuuuuuccaaacaaauuuuuaauuuuuccauagguuauugggguacaggugguguuugguuacaugaauaaguucuuuaguggugauuugucagauuuuggugcacgcgagcacuauacaccacacccuauuuguaaucuuuugucccuugccccccucccauccuucccaucaaguccucaaagucuauuguaucuuucuuaggcuuuugcauccucauagcuuagcucccacauaucagugagaacauaggauguuugguuuuccauuccugaguuacuucacuuagaauaagagucuucagucucauucaggucacugcaaaugccguuaauucauuccuuuuuauggcugaauaguauuuuuauggccauuguguauauauauauauauauauacaguagcacaguuuuuuuauucacucauugauugauggacauuuggguugguuccacgauuuugcgauugugaauugugcuguuauaaaacugaugacuagcucuuaccaguuuucucucucauguguuuggggcaauaaguugucucuuaaauuuauucaacccugacauuauauuuuucuuaucccuuaaaaguuguguuuugcuuuuuguuugcuuguguguguuuguguguuugcauuuuaguguacuuauaaaagcuuuugguucagaaagauuacucccaacaagaauuuuauuauauuugauauucuugacuaguuauguauccuguuguuuucugcaucuggagauaagauguuaacuggaaagauauuuaucacauuggaauguuaguugcuuuuuuaaaugugcuuaaggcccaaagcucaguuaauaagauaggauccucauaucccaaaaucuugagccaagggagggaacuaaaccuuuaacagaugagcuggucaggcgcgguggcucaugccuguaaucccagcacuuugggaggccgaggcgguggaucacgaggucaggaaaucgagaccauccuggcuaacacggugaaaccucgucucuacuaaaaauacaaaaaaauuagccgggugugguggugggcgccuguagucccagcuacucaggaggcugagguaggagaauggcaugaaccugggagguggagcuugcagugagccaagaucaugccacugcacuccauccugggugacagagugagacuccgucucaaaaaaaaaaaaaauagauggaguaauuuuaacucauucuuauguuguuguuuaaaggcaacacugugagaugaaggggaucgugacauguaauucauguaagaaauuguaauaauagaagcuuuaauaacauauaaagaauauugagucugggcacgguggcucaccucuguaaucccagcaauuugggaggccgaggcaggcggaucaccugaggucagaaguucgagaccagccugaccaacauggagaaaucccaucucuacuaaaaauacaaaaaaauuagcugggcgugguggugcaugccuguaauccaggcaggagaaucgcuugaacccaggaggcagaguuuguggugagccaagauugcaccuuugcacuccagccugggcaacaagagcaaaacucugucuuaaaaaacaaaagaauauuggaaauaaggaggagugaagagugaaaauuuuaaucucuguccugcucucugggagagagagugcucuaauuuuagacaacuagacauuauuuuuagacagaaccauugcuacagaagggcaguuugccauaauuugauagaacuguugccuaagaauguucaacuuucauuuguuccaauucucugcuuaucaagcaacuuucugaucucuaaucugguuuuuuuuuuuuuuuuuuuuuuuuuuuuuuuuuuuuuuuugagauggagucucacucugucacccaggcuggagugcaguggugugaucucagcucacugcaaccuccacuugccagguucaagcgauucuccugccucagccucccaaguagcugggacugcaggcacaugccacuacacccagcuaauuuuuguauuuuuugguagagacgggguuucacuauguuggcuaggcuggucuugaucuccugaccucaagugaucugccugccuuggccucccaaagugcugggaggcaauucaccuuccucagccucccaaguagcugggauuacaggugugagccacugcacgugcccagcccucuaaucuggucuucuuugaggacuuguccugugcagauaucuauucccauuguuuuaacaaaaauagcuuucauugaaauuuuacauaugauuguuuaugguauuuaaauuaguuugauuaucacaagucaguucccuagaaccuaaucagcauuuaauggacugauaaaaauucugaauuugaagagcgguagaucaggugauuuuacuugaaauaacuaacaagcauuauuagauuacacagaauucugccaaaaagaaacauaaauguuuuuauuacuguagucguuuuacaguguuacucaugaucucauugaguaaugauaaugccauccaugacaaugucaaaaacguguuuuuuuuggaugggugugguggcucaugccuguaaucccagcacuuugaggagccgagauggguggaucaccugaggucaggaguucgagacuaggcuggcaacauggugaaaccccaucucuacuaaaaauacaaaaaauuagccgggugugguggugcacauguguaaucccagcuacucuggaggcugaggcaggugaauugcuugaaccugggaagcggagguugcagugagccgagauuaugccauugcacuuuagccuggguaacacagacucugucuuaaaagaaaaaaaaauuuuuuuugcuuuuuaaaaauuguacuagcuauuuuuuccacagugcuguuuaaguuaucacaguuucuaggcuguguccuucaucauugauuaucuacauccagauagcugaucacugaugaaauauacaugugcaaaacuuggagauguggacacuaguuuuagcugcagcuucugaaguggcaggaugggguggggcagggugagguaguggguauaacuggagucuucagcggaucagccccacuuuugucaccucccuuucucuggaagcuaaggauucccucagcugcagccuuggggcuuaggaugauugauaauaaccccagcuccacuuauuggucacugaguugagucagaccugcuggggaucagagguuuuguuucuuccuguuuuuuuuuuccauacucaguagcuaguuaaaucucaaccauuauaguuugaugccaguguuuuaaauccuguguuaaacaagaaacuuacguuguuagacugugugguaagguuuuaguuuuuaguuaguuuuuuuuuuuuucaacacaguccuuggcuuugcugauuuggaccuaacagcuggccuuaggacaacuguuuggcaguacuaauguucucagauauuuuuuaaauguauuuuauuuauuuauuuuuuugagacggaguuuugcucuuguugcccaggguggagugcgcuggcgcgaucuuggcucacugcaacccccaucuucugguuucaaacgguucuucugccucagccucccaaguagcugggacuacaggugccugccaccacgcccggcuaauuuuuauauucuuaguagagaugggauuucacuaucuuggccaggcuggucuugaaccccugaccacgugauccgccugcaucggccucccaaaagugcugggauuauaggcgucagccaccgcgcccggccuguucucagguuuuaauacuuuugaauguaaacugccuuugaaagccuauaacacaguucaguuggcuucuaaaacaaguguuuuaaaugaaauuuaguaauacuguuuaaaaaaugaauaacuuuauggccaggcaugguggcucacaccuguaaucccagcacuuugggaggcugaggcagacggaucacuugaggucaggaauuugagaccagcuuggccaacguggugaaaccccaucucuacugaaaaugcaaaaauuagcugggcaugguggcacacaccuauggucccagcuacagugaggugagauugugccacuacacuccagccugggcaacagagcgagacuccgccucaaaaauaaauaaauaaauaaauaaauaaauaaauaaauaaauaaauaaauaaauaaaucuuuagaguguuuuuagguucacagaaaaauuaagucaaaagugcagaagucccacauauuuccuuccuggaucaccacacacauagccucugcaauugucaacauuuccuaucagaauggcauaguuguuauaaucaauaaaacauuaacaugucauaauccccuaaagucuauaguuuaggcucucucuugguguugugcauucuaaggauuuggacaaauguuucaugauaugugcuguuacaguaucauucaaaauaguuucacugcccuaacaauccucugcuuugucuuucauccuucucuccucccccaccuccaggcaaucacagacccuuuuacugucuccuuucccagaaugucauauaguuggaguaauauauuauguagccuuuucagauuggcuucuuucaucuacuuauaugcauuuaaguuuccucuguaucuuuuuguagcgugauagcucauucuuuuuaucacuggauaauauuccauuguaugcauguaccacaauuuauccauucaauuacugaaggacauacugguugcuuccaaguuuugucaauugugaauaaaauuucuauaaacacaucuguauacauauuuuuguguggacauacauuuucaacucaguugagcaaauucaagggauggauuaccauacauuuaucauaccauucagcaauuguaugcuaagaguauguuuagaagaaacugccaaacugucuuccaaaguagcuguaccauuuugcauucccacaagcaaugaaugagaguaguaaugcuuucgaauacuaaagagauugcaauguuaaauguauuuuugaugauuuccuuguggagauaucauuauggcaaaggaccaugaagcacgguaaagcaaaggaccaugaagggucaugguaaaggagguuacuggugauagguguguguguacgcaggaguugaagggcaagggcuucccaauguuuucccaucuccaaauuaccacagcccacccagauacugugucuuacauuuuagaaucacugcuggaaauggaguuauauuguuaaugugauuaugcacugaugugcuuucauuauauuaguauuggugaugaaaguaucuuugucauuuuaggcauguaacuaggccuguaaagaugucuuaauuggggguuuauuaggauuagugucaaccguauggcaaccauaucccagugcugggagucaaaguuagaacugugacuuuggacauugcucuuuaaggucaggguaguguccugugagguucugccagccucagccuugauguggauaauaccaucauuuguaauguugugauaugguggagcaggaguucucuggccucagaaaacauagcuugugugaaguuagugaaaugcucaugcuucugcugucugugauacugaaucuuucaauauuuuuggccuuaacugugacuuguucuggugggagaacuuggaagaagugaaaaaagaucaauaacuuuuugaauuggugcaagacagguaaagaagagaaguguugggcuuucuuuuacauuauucuguuaccaucaaagguagauucccuacuauugccauauacaaauauucuuucauuccacaggauuagaguugaugauggucuaucugucuuuaaagguagaucucaacuuuaaacuuuaaaguugaguuuucuuuuguaaaguaagaguaaaauggcaagcagauggaagcaucucaagcaaggcauccuuccaucugggugaauuguagcuaauguccagaaacaguaagaaucacaccggaacgaguugccagccagcugcccauauacuaccugauguaugcugguauguccugagacugaaacuuugguauagguacugcucaguuaaauguaggucauucucacacagaaucccauuugggcuaccaucuuguuucuuuugaaucauaacaugaaauuuacuauauaaguauguguaaaacauuaggcuauuuaucauuuuuccuuuuagaaguuuuuuaaaaagguuuuugccaacuugaagguguaaaaauuuuaauauaggugaaauaaucagauguauauuuaaaauauuuauucauuuacauguuuuaaaucacauauauacagaauugggauuguuuuccacauucuuaacauuuuacgggacaauuuuauuccaguuuuuuuacauacaucuuugauaucaguaguuauugaagucacuuuuaaaucaucagcauaauuucccauauauuauauuaauuuucaugaauaaauugugauacagugcuuuuuuaaauuugcguaagauugcugucacuggaagucacuggaaguuuuaucucaagccaugcauacugaucuacauaacauuaggauaguuuuucuuacugguuuauaugugggaucuuuacaauauaacuacucacucuccugccucaaaguauucuuuaaaaagcauauuauuggcugggcgcuguggcucaugccuguaaucccagcauuaugggaggcugaggugggcggaucacaaggucaggagaucgagaccaagugaaacccugucucuaguaaaaaauacaaaaaauuagcugggcgcaguggcgggccgcccguagucccagcuacucaggaggcugaggcaggagaauggcgugaacccgggaggcggagcuugcagugagccaagaucgcgccgccgcacuccagccugggcgucagagcaagacuccgucucaagaaaaaaaaaaaaaaagcauauuauuuacaacaucagcacuuuuaauuuuaaagccauaccuacuaagaaugacuacauaaaccuggguuaauuuauuuuucucuuaagaaaagcaaaagaaaacgaaacaaaacacuuuagauuacauaucccaaauaaguuucugaaacuuguauuaucugaagucauauuaagcuaauuugauuuccccacaguaauugguggucuaaaaugaaguacuugggaagcucuguaagaacuagaagauaagacaguucucccuuuucugaaaggacaacuuagaggagaaauucuuucauuauauuaggcauauauuguauuuagaacuagacucugucccuaucuguacauguauucauuuaaauucuccgugguuuccuuacgacgcauccuuuuuuuauugugucauuaagagagacaaugcuaggcauuuuacucaaugugaauauucuuaaaauucauuuaugaaaacgucaggagaagcccugaaagaaaauguaguugaggguguauauuuuauugguccauugugucaaaaccauccauucauauuuuauuacuuauucagaggaagaaauguaaauuuggccgggcaugguggcucacgccuguaaucccagcauuuugggaucacgaggucagaaguucgagaccagccuggccaacauggugaaaccccaucucuacuaaaacuacaaaaauuagccgggugugguggugugugccuguaaucccagcuacucaggaggcugaggcaugggaauugcuugaaccuaggaggugggaggcuacagugagcugagaucacgccagugcccuccagccugggcaacagagugagacucugucucaaaaaaaaaaaaaaaaguuuaugaaaucauccauuugggcucaguuuuugcuguuuguaccuuuccuaaggcuuaguacacccugcucuguguugcuccuugacuggugguuucacugaauuguccccauuuuuuguuuguuuucuuguuuguuuuguuuuuugagucaggaucuugcuauaucacccaggcuggagugcaguagugugaauaugacucacugcagccucgaccucccaggcucaagggauccucccaccuuagccaccugaggagcucggaccacaggugcaagccaccaugcuuggcuaauuuuuguguuuuuuuuuucuguagagaugggguuuuaccauuguugcccaggcuugucuugaacacuuggggucaggugaucugccugccuuggccucccaaaaugcuaggauugcaggcauaagccagcauucccggcuguauacuuuucaaggggcggggagaaugcauuuguccuuauaggcuccguuacuguaggcauuuaguacugcuugaaaauuaaauuagaaaguaagugccacuuaaaaaguuuauaaauaugcuuuauaaauucuaaagguguggaaaauuggugauaauugguuuagccucauaccauucuuuugcucuuguuuucuaccacuuagcucuuuuucuccuucucauauaccuuuuauuuuucacacuaauauuguucuuuuucacuuaucacuggacauuuaagaacuuggagugcuugauccuuagcauacauuuguguccacuuaggucuuuuaggggagcccuugaagggcacuaaguauaagcagacaauaaaaacaggaaugccuauauccauaaauaaauaaauauauguauauacaggccucauuuaugcuaaauuacacaauuauacuauauaguagacuugaaauuauauuuuuguggaaagaaggaaaguaaggagacaaaucuagugaaggcugccuugacuuaacagugcagaaucacugugcagcaaugugcuuauauggccgcguugcgauuauaauccuccuacaugcauaagucaauggggucuuugcuccaaacuuguggaagaaugaaugagccaaguaguggugggaguucaguuuaguuccacuguuuuguaaauugggcuaauuuucaaagguauucagacauuuaccuuuucaagugauagaagcaagagcagagaauucauccuuucuugcuacuaaagaauuuauucuaaaacauuacaugucacuugucccucguggcuagauguggauagagaugcuggauuguuuguuuggagcaugcagauugcacuguuucaucuuuuguagacacagaaaucaagaguuaucuuuuuucuuccaaagauggaaacaacuauuugagaacccuaucauuagaaaauuguaagccuuuaaaauagaaccuuaccuucuauuauucauugcaaauuauuuuaacacaaacuuaccugcagcugggcauauaggacucgacugaguacagaauauuggcaaaagcauuguagagggucagaaaauuacuuaagucugaacuugauuggaaaucagcugauauuucaugucucugauguccuucaucuuugcaaaaucaguuccuguggcauuuuagcauuucucuagaacauuacuaugagaaaggaaaguauugaaaagaucuaguaauagagauauuuucagaaaucuaacagauaagaugguagagucaagcucuuuggagcuagauguauacauuaaaguucaucuuguauaaacucuuuauuuuacacuuaagaaaauugagguauggcugcuccuuacucccuaguacaauacuucucucacuguguaucuuaauuauuuguaucuuaucucaucugucauauggaauuccuuuagggcagggacucacccuuauuuuaucuauguaucuucaguacucagccuauugccuggcacugaguaaauuucaggguauguuuguaaauugaaugaaucauugacugaauuaaccaaacagcaagucagacucaccuggguucacucucguucuucuauuggguugcugcuuauuuuacaagucagacaguucucucccuauaaaaggcaacaacaaaaacauaccucaaaauaaagagauagcuggggaugaguccgggcccucaaaaucuuacguucuuauguguguaugugugugacaugugaauaaaacaugcagaaaauaaaggggauaauuccagguacugauaauaccaugaaaaaagugucaugagcaucagacaguaauuaucuaaaugucuucuuuuuaguagaaaucuaaccccacacacugggccucaguccaucuaucucacagaaaggaaauccuugcuacuaccaugaaagcuuaucacaugcucauggcugaaggaguucuucuggaaagccagagcugcuaaaaggaacuuaggggaucuguuccuaaguuccucuaagaucccaauagaggacuagaggcuucuuucccucuugggggaugccauguugauuaaugaaauuuuugcuacuuagcuuuaggaaaaaggcauuuauuuauuuucuuuucuuuccuuuuuuuuuuuuugagacggaguuuugcucuuguugcccaggcuggagugcaauggugcgaugucggcucaccacaaccuccaccucccagguucaagcgauucuccugccucagccucccaaguagcugggauuacaggcaugccucaccaugcccagcuaauuuuguauuuuuaguagagaugggguuucucuauguuggucaggcuggucuggaacuccugaccucaggugauccgccucccaaagugcugggauuacaggcaugagccaccacacccaaccagaaaggucuauuuucuuugaucuuauuaaaggcugccauauacaaagguuuucuuuuaauguugaucuguuuuuaaaauauggaagaaagccuugaaaggcaucaucauaagcucuacgucaauauccagaaaauaucgucuuguuuuagaauucuagccuguuuuguuugguagaugagucagucuacuguaaauaaauauuuauugagcacuuguuuugugccaagcacagugcccuagggauuguaguguuuuucaaauugugggucacagcucccuaaugucauaaaaucaauuuagugagcuauaaccggcauauucaaucaaauggaaugaaaaauagaauaucagauugcaucauggauaguauuguauuauuuuaucaaacuugaguuucaauuguguauguaugugugcaagguugcaauauaaagugucuuuuuuacuugugucaugguuagaaaagcuugaaaagcacuauuauagagcauacccaaaaguauauauuccuugcuuuugaauaaguuaaacucuuguuggagcaagaaacacaaaagaauaaauacucaaguagugaauuacaauaagugcuauguguucggaaaaguaagaugauaauacaaguugaaaguggcauggauggauaugguggaacuugaaccaaaucuggaaagauggauagggcuuggaaggggugaagacuagagaauggcuuaaaggugagacguggcauauggauaauagggauggcaagacuggaacagagguuucaguuuacauuagagaacuguaggauauaguuuggagauagaaaaugaagcacaauuguccagacuuauggaugccuugugauaacaugccugaggaguguguauuagaucagguaagcugcacagauucuuaagcuggggagugauaaugauauaggguggguuuauagaauacuuuccaucuucuuccuaacuccucuuuagucauggggagcuccuaagggaauuucuucuagguagguguuggauaccaagucucuggcaucagaucaaagagagccagaaaggacuuuggcuguucuccagaauguaaauagaaagguagaacaagucccauugugggugcaugugaaauacucccauggaggagaacugcagugcugucuguuugaaauacggcaaagaauggauugaagaacauuucuucugauaucacuguuuaauguuugcucucaauguaaagggaaaagcagauuaaagggcccauguuuuugaaguacugggaaccugacugaccuaccugaaauaugcuauguaaauaauuugucaugugaucuccuuacccucaagacaccuucacugaauaugcuauauacauaauuuauaaaacaguuucaagcgugauugcaaaaaguuucuccucauuggaaagggacauuugauauuuaucugccaaacucuuuacuacuuuccaauuaaagauaaauuuaaagaaguuucugaaaugauaaugugcuuuacggggaaggugauuuaacuagaaagaagcuuuuaaaaaaaugacuauuuaaucuauaacacuaaauacaccaauaauuuagaucgacuucugauugaaaguuaugauucuuugucguggcagauuaucaaauguucuaaauugaggcuguucuaggacauaguuuuuaaucuaagucauauuaaauaaaguuuaugggggcccauuguuuuagacuagccucuuggacuaggccccagcagaccagacuaaacuagaauggaguugcucaugcuagguaccacauaauuaaacugaauucugaaacaggccugguuuguuuaaguaacaaaccagaagauucacaacaaccagucaaaaggggcccaguuuaccugggcaugauaagaagucuccucuguuuuaacccuaaaaggaaaguaacuuuugaaacagucaaucugcuuuuuguucuguuucugcuuuucucagaacuuuuuugucuauaaaaccaauuccucugcucagcucauuggaacacuuauucuauuuuauagaguaagauguugcucaauucuggaaucacaaauaaaagccaauuaagaccuuuaaauuuguuguaauuuuauuucuuaacagucauuagaaaaaaaaaagcagaugcaucuaggauugcaagauuauuuacauguaguccagggggauuacauacauuuuagcuauuuuguagaagguauaauuuaaucaggaacacaaguucaagcacagcccaugagagaugaagggauaugaagaacacuaacuuugguuucuaaaggaaaguguguagaguguacauucuuacucgucugcaaagaggguggaugaaugaaaaaugaagaaggggguguauucguuuauacuuaugaaggcaucugcucacaaucagucacuuguagagagagugccagcuggcaggguacuugcgugauguaaauuguccauccgcucagaagagcagaaguacaaggaggccuugugcaaaggacugaauuccuacccagaggacaagggagggagguucuuguagauaucuaaaugagaucuacuuccauuuuccacuuuauuugcaguuuucaacaugucauuuuuccugcugucccagcuacgauuacuguuugacuugaguaaucaguuuccccccuucacugcaacugcugcuuauuaagccucugccugguggggggaggguggguauaggaggggacacugcuggaaaaauggugucacuuuuuccaagaguguuguuuuccuugucuuucugcuucacugguucauuuuugugagcuguauaagagcuaaagguuauuauuacagauuucauuuuuugaaaugcaucaaaaucuccauccccuccccuaccugcuaaucuuuuugcuuguuaagaaagaaagugcuucuuucugugaaaucauagauaauucuagggguaucaaauguaauggaauuaaaucuuauaaaauuucugaauggacuuccuucugcuuuuuuuucacgauaguagagaaaaaauucaaacuuccuuggacaaaauuuuaaaacaguaugcccugcagaagaagagguuuuaguagaaaucuuuguuuuuguauucuuugauuucuuagaucuggauuggagugggucaccaaacuuuuucugugagaggccacuaaguuaauauuuuaggcuuugcuggccaugcagggucuccacaauugcccaacccugcccuuguagccagaaaagcagcgauaaacaguguaaagcauuguuuacaaaaauagguggugggcuagauuugaucuuccagcugugguuugccagucucugucuuggauucuaagcuacuuaaaguguguccuaccucccucccucugcccuuccucuuccuccuuccccucccucucuaauuacuauaugaacaucuggcacuucguacuuaagccccccuuuuaauguauauuuuuuaaauaccuaaaauuucuucucugaaaaauaaauauuucuaugcuagucuguagccaacagaauguaacacccucccugaaaaugccaacauuacccgacacagacugggauuaaacaagucuaggcuucuagacaaagaagaaacaguguuuucuuaucuuuuugaguguacugaagcagaaguuaacucuuugcuuucagaugugucccuuaucaucgagaauugcuggugguccuguaucauuuuauuauaggaaggaaggauggacaccagagaggguggggaauuugguuuacagggaaucuugaccagugccugccuauaaaggguaccacugugaaauccccagcaguaaguagguuuucuaaaaaucaaguguguauuucuacuugccuagguuuuagggccuugugaaugcaagucgaaugauagaggaaauuggcuuggaggaaaauguuggggaguuuggguuuagcugggugcagucaccccuagacuuggauguggagugaguaccccuguugacuuuaacaucugugugugucuuaaagaagacugcuacuuuucugguuuauugucuaugccuacagaugacacguggaauaaauugcacauuaaaaugucugacaugaaaaucagaagagcuuaaguucauuccacagaagccuuuuguuagaaucuucaaaggaugagaaccaggaugaagaagaguuuacaguagggaaguauuucucaacuguaauuguacauaaaaauugccuauggugcuuuaaaaaaauacagagucuggggacacauguucucgggaucuccuaagggcugucacagaccauaaaguuuaagaagaaaaaaaaaaaauacagaguuugggaccucacccaaaaccuaccaaaaugaaacuuguggagaugaggcucaacaauuugcauuuucaaaagcucugugggugauucuaauagccagucugggaccuuauugugggccagauuaugagaacuacuauaacaggaagacauagaccugggcuggcucuaauggaaaggggccuucuagagcgccuggggguuuugaacuguuuggguacagauaacucuuuuuagucuggauacuuacagugauccugaaaauguauauuaugccuuuucucuuuaggaaaucuuugggaaggcuuuuuuagagaacgucuuuguggaugaaaggggcucucuuucuccacaucucuuagacccacuccaauccacuccaaaccaccagagaaaguccucauuguucaguagaaauccagcugccacacuggaucauucccaucagcacaacacaugaugucuucccaucuuaaaaagcaauuuguucuugaacaccccuuucccccuucagcuaccaccucauuucuuuauagaaaaauuacuuagugggcugggugcagugguucacgccuauaauccuagcaccuugggaggcccaggugggaggauugcuugaggccaggaguucaguguugcagugagcuaugauaguaccauugcacuccauccugggcgauuuagggcucuccccugucucuaacagaaaauaagaaaaauuacuuggaaaauuguuuuuauuaccugucuccaaugcccccuucccuugugcccagcauucucuauggcuuucauuccugucaguucuaacaaagcacuucaaggucacaccuccagguugccaaauccaguagccaaugcucagucuuuaucuuucuuagcauuucaggaguauaugacaaaguucaguuggucacucucuucuuuuuaaaagaagcuuuuuaaaauuuggcuucuggaauucuacucuuuugguauucuuucuacuucaguggcuuuucucuccagucuccuuuucuggguccuccccauuucccccauugcuaaaaguugguaugucccgagacccagucuguguaccucuuaucuaucuauguccauucccuaguuguuuuccucuaaucccauggcuuugaauacuaacuguaugcugacgacuuccagauuucucucucuugcugcagccuuuuccugaacuccagacuuuuauauccuaccugcugaauugauauuuucacuuagagguuucguggguaucuucaacuuaguauaucugaaacugaacucccaguuucuuacucuccauccccccauggcugcuucaucauuccaguuguauaagccaaagcuugcaucccacauccaguucaucaguaaaagugguuuguuccacccucaaaauauguccaaaauaccauuaucuguuagcuggauuguugcaaaacucaucuaacucaucuucuuguuucucugucaucccuucuguagucuuuggucaguacagcaaccagucauccuuuugaaaugcuaguuagagccuguuacuccuuuguauaaaacucuccaguggguucucaucuuauucagaguacaaaccaagucuuacagugaucuacagagcccuccauguuggcauucccuccuccucucagcuucucucaccucaucuccuaauaccuuuccaccuuacucacugcugcuucagccgcacuggccuccucaccacucccuggaacuugccagcaugugccugccucaggguauugcacuugccauuccuggaaugcucuucccauuccuggaaugcucuucccccagauguugcacuguuuuacuucuucaggacucugcucagauuucaccuuauccaugucaugagaccaucucugauaaugcugaauuaaauaggcuccccacaaacuuucuauucccacuucguuuuucaccgucaucugacacacagaauuuucauuuuuauuuuaaaaucuguuccuuacccaagcaugcucccuacuuuuacuguaaguucuacaagguugagaccuugucuuauucucugcugauccccagugccuagaacagggacugacacauaguagguuuucaguaaauguuuguugaaugaauggaagaauuuggacuugagcaauuaucaaggccagucauagcuguuaaccuugaccuaauggguggcugugguaagaaauuaauaagcaauugugaaaacugagaaagccauuuuaguauguaagauaucuuaugguauuuguaauuuguaauuauuuccucuuuuaaggacagauguaaacaguacaugaucaggggaauuagggaccaaguuuauuaggaaugaaacuaaagaauaaaaggcacuguagcaaaaugaaggauuggagggguuuuuuuguuuuucguuuuugagauggagccuugcucugucacccaagcuggaguacaguaacacgaucucagcucacugcaaccucugccucccgauucaagugauucuccugccucagccuccugagaagcuaggauuacaggcaccugccaccacacccagcuaauuuuuauauuuuuacuagagacgggguuucaccauguugaucaggcuggucuccaacucccaaacuaaggugaucucccgccuuggccucccaaagugcugggacuacaggugugagccaccgcgcccgguggauuagaguauuuuaaauagcacaucacaguggacuuuuaaguucacuuagcaaauaguuguugaauagaaaaaguaaacuauuggucaacuuuuugugacuuugugggauuauuggaguugaccuuagucuauuacuauaccaccgugacuagguauuagaaucuuguuuuucuaauuagauuuucucuuuuuaaaaaaacuauuuuucacucuucuguuauagauaaaagccaaacuauagccagcuuucaauaguauaugaauaucacagaacaagaaauagcuucccacacaauuauggugucuuuuucauaucuuaacaauuacacauuucugaaauaugggcuuauguagcuuauauuuaauugccuuuuuauuucuuuaguguuauaauuaacuuaguugccuucuuugugacuccguuaaaucucaugucagucaaaucccuguagugggaucuuuguucagcagagcgaguggauuuuuugccucagcuuacacgagugggggugaauauuggccuuguuccuuuagcccagcucaaggacuuauucaugccuguagucuaccaccaugaauuaggucugguauugagucuuggaagcaugggguuuggguuaauaaggcauauuccccaguucuuggcuuaaaauuucacuugggaaucuuuuuuggugaguauaucaaauaaaauggcaaagaugugcagauuaggaugaauuuaucguauguuuugauaauggaaauuguuuguacccucuaacagugauuugcacuuauuugaaauuacucuccaaggguguuugacauucuaguguucaguuaagaauucucucuguaugcauauaauggcuguuuuaugaucacauuuuaauuccuaugauaagucaauuuuggcccuccaguuuacugaaguguauauggcauuuuggggcauugcaauuaggcaaugcaagcagaaagcuuuuauuuuuuagaacuucugcauuagguuagugcugugaucuuauuuaaccauagcaccaaguaguauuuugagggugauagggaaagagaauugucuuuuuggcuuaaacuuuauuuugauacuucaucgaaaaaucuaauuuccauagagauuacggauuuaucuucuccaaaaucauacugucuauuucagaacuuuuguuuuccucuuagcuccauagugauaaucauaccauuauuuuuauaauagcuuuugauacagaauucuguuagcuuuaaaaaauucuaaaaugauaucuucuauuuuaccuaccugcuuuguuauauuucacuguggcaacauagaauugagacuuuccauauuccaucucuguucaucuuaguuagcgugucuuuccguuauuaacaauggcccaagugugauaggaagugcuuauugccuguacucagaaaacaugacuguugaagcccuuuguucauucauuugaaagggauacuuucucaaauuguaaguuccauugcauuuguugucauaaauuuaguuaggaauuacuauuuuauacaaaacuguaaagguuauuugucugcauuuuuaaguugugcugaucuaaauauacuuucuaagggauuguccucuugcacuguuggcauuugaccgauugacaagggggaggccaugaaaagggaguacagaaauuuaggggaaaggaacaggauaauaaguuuuuaaaaacaaacaauuuugaagauaaguuuuagccaauagaaacuagcccuucaacaggcaauaaugaggacugaguuuuucagcaucuggagugacugcacuguaccagaccaucuugguauauuccuuaugugcuuaguuguucuguagugcuuccgaucaucugccugugucugcuugaggaucccacagucaguauuaaguuggccuugggucgucuuaaucagugaggcucuauuugugcaauccauccgcugagguggaacaauaacagcugguuugcagcuggauauguuguccugggaacucuuguuucagccagcaguuaugcuaacaaaauugaaaacauuuucaaauaguugcuuucugugacuacuguuuguguuaacuguuuggagaucccauuuaguagccuaaacacaccccaucucuaauugacuuugugcuacaacuuuauuaaaguuuuauaugccuaaaaucaagucuggcuucaaggagagcauuccuuuucugacuuccaaagaguuaacacauaagagccaguagugaaccagugacuccuaauuugauacuuuagaaugaacuaguuuucuuuuucuaauucaagcuguggaagggcauuuugcaauuuuguaaaauucuauauggcuauugucauucauuacuaaacucuaaaggagguuguuucacaagauccuuauggaauuuuucugaguagcacauaacagaggagcauuuauguuccccagcagucagugcuugaauccaauucuaagacaagaagaguuucucccuuauucagagagaugagaaauacuuuaccauguaggaggcuuaagcagaauuccuuggcuuggucccacaugaacaaaggcuggauucucauugucgaugcggccuguuccccuccucucauucccucaaccagcaugaacuguaggaucuagagcaggaaguauugguuaauuuugugugcuucauucuaaacaucugcccuugaguuuuuuguuuauggaagggauauggcagggggaggaagaggggcaguagaacacucagaagcuaaacauuuuuuuggugguguguauauccaugguuagucuucgugugugugaacauggggugaggaguggaagauguucugguugaauaguugcuggaauacauccagaaaugcacuuacuguuuuccuuaaucauuuggcuuggcuacuuuaccuuaaagccauacugucuacuuucacuugcucccgcagcauguugauaaucuaguagugucaucagacuggaaauuagaagaccugguccaguuuucuauucaucuaccuguuaacuggaucuucuuacuuugucaauugugaaaugaguaggauggacagaguagggaaguauagugagagagaggacaugguaacccucagguagagcuauuuaacagaauaaaaagcuccuuaguguuccaguucugguuguaguuaauuccagauaacacacauaccucgcacuuugaccccucuauuccauuuucuguauuugccuucuuauuuauccagacuggauuccaaauuccuugaagcaacuuuauuccccuugucuuguugucuuucuuuuacauuggcagaggggaugcugaaugcugcagcagaaaucacaccuccacagagauguuuguacaaaggcauggccuccugcucuccucucagccaccuggucuuugcccaguaagccuucuuuuuucuagucagcuaccuuugcuggacuuuacauuggcuauuauaaaguuucuacacucuguucaaauauuccccacccaacauuacucccugucuuugccgccagucuugagcagguauccuugauuuucacuacacagaaaaaaagucaucaguagaacucgaauuuuaacuucugccccuuaaaaccuacaaugucacuuugcauaugcacccagacagagagcaaagaggcagguuuccuucuguagagaaccagucucccaacaaacauggaaucccauucuuguuuuccagcuucuauuuuucaccuuucccucucugcugacucaaauacaacagcauuuaauacacguucaucucuaucagaaaacaaaaaagaaaagaaaagucuuuccuuggcccuguaacccuuccaaauaucaucuuccccuccuucuccucuucuuuaggcagacuacaugguagauuaacuacacucacugugucugccugcugucuauucucaauuccuuuguuuuuguuguuuuuuuuugaaagggagucucgcuguguugccuaggcuggagugcaaugucgcgaucucggcucacugcaaccuccgccuccugaguuccagcaauucucccaccucauccuccugaguagcugggauuacaggcgcguaccaccacgccuggcuaauuuuuugaauuuuuaggagagacaggguuucaccauguuggccaggcuagucucgaacuccugaccucaagugaucugccugccucggccucccaaaguacugggauuacaggccuuagcuacugagcccggcccauucucaauuccaaccacugccaucuugucccuggcacugcuuuuggugcagcugugaccucuguggcuugaagcugauggauacuucuuagucauuaucuuacuugacucuccuagcagauuugaaccccauugauuccucccuccucaaaaccaucuuuccuuggcuucuguggcauuuuuauucuuuuacuugccuuccucccucuggcugcccccucauagccuccucugucaucuuccucugugugugcugugaauguuugugcaccucaggguggucucagaagucagcugucacggaacacacuugcuccauaugcuucaacuguacucaagucuccaguguccaucugcauacuagugagucccaagucucugucucuaacucagacaucucucuuggcccgucaaacugcucacauccagcucccuacagacauuuccucaucuacugaccugcaggcaucccagaacuaguguaucggaaacugaauucaucuucccauccugccccugcgccugccuccaguccugcccacgcuucucuguucucuauuucagugaguaguacuacccuccacuugguucauuugaaacuagaaaacugaauguuauucuuaauccuuccaccucauggaaugggaaaaagcagcuuugacaaugaaacaggguacuaacagcgacaaguugaggagccuuucaaaagcagcucccuaucgccuuuguaguacaucaguuacuaaguuacuauugaaaacggcuuccuacaccucacugagguccauucauuucucuccauuccucuguucccauucuuaguucaaccucugucaucucuccuggauuacugccacaucuugaccuccccaucuucguuccugucccuuccaaccuaaucuccacacugaucuuucuaaaaaaucaaaccugaucauguauuuucugguuuaaugccuucaguggcuggccauugccuuuaagcugaaguugcuccuuaaacaugaccguagccuggugugcucugcuucuuguuugccucaucuccagccacuucuguaguucuagcuacccuagacaacucuaauuccuauggugaucacuccucuguguucucugggcuuucauacaugccauuucaugugccuggaugaugggucccuguuugcuuagcucauucuaagcauuccucaugucuuggauuuagaugccacuuccucuaggaagcauuucuugaacucauaaaucuggguuagaugaucuucuccaugcuuuccaaacaugauguacuuccccugucauggagucaucucaugaugaguuguaaauugcaguugucuguaugcgccguuggguugacugcaacucugaggguggugcacgugacucucuugucauggaggugugugagccuccauacagacugccacagagcucccucauuuccagcuguggcuguagauuggcauaagaaagguagcccugcaaaugaagcucagugccagcaaggccaggccagcaccugcaaguagacugcaucagaguuuaaugcuagcauaauugcuuucuggacauuuugcuacuuguggcucugugucuguggcugcagcaagagacauaugccugguucuuucagaggguggcuuuguaguacagauguugauuggaacacaggaugccuugauugauuuuaccuucucuccuuuggcccagucugcugccguuggguugcuaaagaacaaugagauaucagaaggauagagagaaaauagagaaagaaggauaaucuauaaucuacagacuagugagcaagccuuugaacagucgaggccaccuacucaugaguaaaauuacauuguuuaaccauucuguaaugucuuagauagugagucucuggaaugccacagauacuguacuauaaccucgcccucauucaaaggugaugucuugacauuuuugacgcaacaaagagauacagguaaaacuugcauucuuuuaacagaaaguguguaaacuguauuugugugacuugugucuaggcaaaaugcacugcauccuagauagaauauucauguuuguauaguauccuuuaguaacuguaccaggaacagucagguccuuuuaugugaacguauucagaaucccaguucagggauuuucuuuauaaacccuauugugguaaugccuuauauuuguauagaauuuuacaauuagucaaguauguguagaucuuaguuugaccuuccaacaacucuugaagucgguggggcagggauugucuucauuuuuacaaagagaaaauggcagagcagaaaucauaugguuaguaaaggagggagucaggaccugaacucaggucucaaaaugccccauccuguguucuuucuguuaugccacauggcuuuauguugaagcuaaugugugugcaaguauguuucauguaugugggggacaguuaauccaaccuccucuaagaucugggccaguugagaaauagucggauauugcucauccugucaguuuuauuauagagaacgcucaguugaagaauguggccuggacacauagcucgcaugggcuuucugcucuuuuccucccugaauugaccucacccacuuacucccagauccagcagcaggacagcggcaggccccaccccacacagaggcagagccccacuguguugcacugagugcaggagaggagagagggggacuccagccggcagccagagagagacaaagcgggguccaggccacacaugaggaaucgcuccuugucucucagggacuaguggguacgaggaagugaaaguggcagaagucucuccucaacacuucugagagcacagaaguugcuguucuguggguuuuguaggagaggguugggaugguucuugaauuaauuggcuuagggagaaaaaacuguaagcuccuugaauacagggaucucugugucuucacacauucuguccccugauguauauagcauagagcugagcauagauuugugcccaacaaauucuuguugaccaaacugggaucuucacuauaacauagaaguagcaaaguauagauauuguuagaguuagcaagacccaaugugugaaugaauggugauuuuauauuuuacccaugugaagacacacuggcuggcaaccaagccauccugaccauaagaccacacucuggcuuuugcagggaacugucugccccagugacugcugucuuuuccucucugcucagagcucauuucucauauauucucuuuugaacauauugaaacaaccuuuuuaaaccuccuuucucccuuugucuuuuuucccccauuucauuguucauccacugaaggaauuuuuuuuccucuuucuuauucuacucccugcuacaucucucaaacacuguccucccuucuucaaaugucuguaucuuaacuugguagauaaguagaagaauagagcugaugauauucuuucugcgucaagaguaacguuacaguuaauagagaaugagguuuuuuuaaagucuuaaagggccuggagacccauuuagaaaguuagcauauauuugcuuuuguaucuuuuaauuaagcuuuugcugaaguaccagcauuaagaauaaacguacuuuuuauucaacuuuaguuuuaauuaauaguauaaguacaguacuaacauacgccgccaguuuucauugcacacaacauuuccacaaugcacaucacgacaggccuuuaugagccaacuuauggacccaacugcaguuugucauuuugggggaaaauacguaguuuucuguuuuagaauagccugucuucuugguuugauguguacaaggagauuuauauccuuugucaaguuccaaacuaagcugggaauagagggcauuuguuugcuucauacguaugauuuaugaccuuugauguguuugucccacaggaaaagcuuuugacaucaccuaugugcgucucaaguuccacaccagccgcccggagagcuuugccauuuacaagcgcacacgggaagacgggcccuggauuccuuaccaguacuacagugguuccugugagaacaccuacuccaaggcaaaccgcggcuucaucaggacaggaggggacgagcagcaggccuuguguacugaugaauucagugacauuucuccccucacugggggcaacguggccuuuucuacccuggaaggaaggcccagcgccuauaacuuugacaauagcccugugcugcagguaaauucucacagguuggccugaagccagcuaguucuacaacaugcgaggugugggaagauuauuguaguggggcuuguggucccacuucugagguacggggucagaguagaauacuugagcaacacagacagagagcuugauucugcucucuguguacuauuaauaagugaaggaaaguaguuuuguuccugcugccugguugauguuuguucuuaugcacuugcagaucuauucugggauguaaacuuuacacauuuuuuaaaaagucaaacaauuuuaacguuagucucuguaccugagguggaaacauuuuccuucugaccuuuugaagagaacauuugaccuaauuacccagauuucuuggaucuuuucuugccuauuuuuugauuugacaaaauaaaauguauuuuuuaaaauuagcaaaggggaaccguugaagcaagauauuuaagaaugccaucuucuuucauuuuuacacaagaaaauuuugauuagauuugucuggcacgauugcugaucauuaaagaaacuccucaucaccuaaaauggaugauguuaguaacaggauauggauguuaguaacaggauauuaauuuagguacccauagcacuguacuuaaacauugugauagaaaccuuucccuguuugagaaggauuucuuuuuucuccugaauucuacaugcauauuccuuauacaccauaauacggaauucuucuauguugcucauauuucugugaacuuuucauauguccuggcuauuugauuauggaaaagcuggugagccucaugcuguacucagcacuuuaacacagaauuggagaugcugcugcauguggcugaagucaacaaccacauggggauagccuuugucaguugacugaaacaagaaagucugauaauggguuuucaaaugcuguguacauuauaugaaaagcuauugugauuucuaaauaggaaauaccccauuuuucuaggguuucuaauuuggaucuucuuauucuuucucaccguuauuauguucagggacucucuuucuaauuguaugguuuuggacagugacaaaagauaagaauauauuuuucuguggguucaguugccccccuuccauuguauuucuguaaguugcugggaaagcaugaaugugaaagcuguugguaaacucugagguuauggugagcaaugagugugcuugccaacaccuugcaaaaaaguguuucuugcaauggagauaaguuguguucaaaauaaauggccgagagaauagcugauuuugauagaugaaaaagcagggccaggcgcaguggcucauggcuguaauaccagcacuuugggaggcggaggcagguggaucacuugaggucaggcauucaaaacccaccuggccaacauggugaaacccugucucuacuaaaaauacaaaaaaaaaaaaaaaguuaguuaagcaugguggcaggugccuguaaucccagcuacccuggcugggaggcugaggcgggagaaucacuugaacccgggagguggagguugcagugagcaaagaucaugccacugcacuccagccugggcaacagagugagacuccaucucaaaaaaaaaaaaaaaaaaaaaagaaagaaagaaaagaaaagaaaaagcagaagaccgaaugcccaguggagaggugaccuacaaauacucuuuaaguugaucagcuagcaaacauuugccagacuucuuucuuuccuacagcaaauuauugcauuuuccuguccugaugaggcaacaauagaaagaacagagaaagaacaguguagucaguagaaaaugcagugauacaaaguuguaacugugguuuucuggcaccuuugcuaacuguacacccagucagccugucuugagccauuuccccaacuguaagaauugugauguuuguugcucuuuaugccguagaaacuagugagacuauaugagguaaugagacugugugguaaaaaugcuauggguuaugaccuugcauuuaaaaaaaaaaaugcugugggcaucugcauagacguggucagucaguuucauuaugcaguaacaugaguuacgugucucuggauguaagagcucugucucugauacccaguugccaaggagguugagcuaauuugacuuuuagcugaucugacaaugagagagaacucuugccucucuuccucucuucauugcucccuaaaccucccugcagaagcuguaaucucccagauggggaaggagacccuuuuugguuucaccauauuauaaguauuacuaagcauguguugauuuaugguaauaauuuacauuuauuaaagcacuuacuauagcauacuauaaugugacaagcacuguucuaagcccuuugauuuucuaccucaguuaacccucacaguaacccuguaagguagauacuuuuauugucuccauuuuacagaugaggaaucagaggcccagaaaggacauaacuugccccaaaucacacaguuuaaguggcagaacuggaauucaaaaccugcagggucuagcuccggggucuguucuuuaaagaugcccauuaggaaaaaaaaauggcuuagcuuuuugagaagcucuuauucaaagagagcugugauaaggucgaagccuuguagaagauauaauaagcauuaaacacagaaauauguuuagcuauuuacauuacagaugacuaaaagauuccuacuguuguggccaugaguaggaguuguuauuggaguuccaaguuuggauauggugaaaucgucgucucuuuuccuuucuaauuauacuugaaggcuuuguggagauuagcuuuuaugagcucuccauguuguucuauaugccagguauuugguguggcuuaaggcagugguuccaaaucagagcugugccucccagacucaccuggagccuucugaaaacauagaugucugcaccucugcacuugcuuguuacgucuccaaaggugauuuuguugugcagucccuaggaaagacuuaaaauggaaaugcugucuuugagugguuauauguaauacaccaccccaaaaccuaaugguuuuagauaacugugauuuaugauuucucaugauucuguguuagccugggucacucaccugacaggucagcuggggccugggucucugucucccuguggucuuuuaucaucaggaagcuugaccaggauuuacaccacagcggaagugaucugggagggugagucccugugcacaaguacuugucaagccucugcuuaugucacauuuguugauguacccucggcugaaaccagucacacacccaagccuagagucagcagagaaagagacugcacugguugugggcccuagcagacaugauucacugggaucauuaguauagcauucuaccacacauguaaacaucugccuaaaauuagcucaguguaagggcuuagaucucauaaaaccuagggaaaaacucuacagcccccaugcuuguccucugccauuaugguacaccuaccaacuugauaaguuaugguuucuucaaauucauucauucacuuagcaaauaauaguucgcauaccuacugcaugcuagggaaauggcaguggacaaaauagaaauuuccugcccucgugguacuuacaguguggugggaaggggaagguguguguggaaaaagacaauguaaauaaaaugagagugggaaauagggaguuggguagggguagcaauguuagauaagguggccagggaaggccucagagagaaggugauauuguggggagggucaagacaaacacagacaacauccuauugguucaagccuaaguaaugauuuauuagcgaguacuugagcaucucccucagaucugucaguaggggauuggguuggcagggaggaauagaugcuauaaaaugggcagggguggccaggcgugguggcucacgccuguaaucccagcacuuugggaggccgaggcggguguaucacgaggucaggagaucgagaccauccuggcuaacacggugaaacccugucucuacuaaaaauacaaaaaauuagcugggcgugguggcgggcgccuguagucccagcuacucgggaggcugaggcaggagaauggcgugaacccaagagguggagcuugcagugagcugagaucacgccacugcacuccagccagggcgacagaacgagacuccaucucaaaaaaaaagaaaaaaaaggacaggggcaggcaaugaccagcaucucugauccaaauguggugccccaugagcucuaagcugguaucccuuacuggauuugggguccagauacaggauggagggaaggggcauguguaucgagucccuaauuuaugcugcacauuauauuuuauuuaagccucucagcagccuugcaaagaaauuaguuauuauccuuguuuuuggagacuccgaguaguaaaguaacaaauuaaagaagggaagagucaagaaggagaaaaauauuagaaaauuaaagaagucauugaguauuauaauagauuuagugcuaaagagggcguaaguuaaaugauaauaaguuagugauuuagaacauuuugucacauuuauaucauuuucagucccuccacuucucuuuuauguuucuauuuuugcuuccugacaggaauggguaacugccacugacaucagaguaacucuuaaucgccugaacacuuuuggagaugaaguguuuaacgaucccaaaguucucaaguccuauuauuaugccaucucugauuuugcuguagguggcagguaaguaaacuauuaaauuagucuugaaaguguuuggagcuuuugcauagaggugaaucuagcaacuuguuuacaacuauguuaauaccguuguuagauguuuucuuuaccaagaauaggagcggcaguccuuccugugugauaaugcuuagcugaaaagacagacagcagccuaggauauuuucacugugagaucuucuuguuguucuggaaacuaagcauguagguuuuccaaaaccuugucaaauccacacauuuagugaauucuuauugacaauuuaagugcaagggcacugugaagcacuugaggaaggguaagacucaccuuauccuacggagaaguccugaccuucuuggaucuuacacaugaacaggguaggcaauguaugaauaugugaaaacugaaauacuuguaaucaccuguuuuuaaaaaauagauaaagcagcaguagaaaagaugccacauaucaagaaugauccaaaacugccaggcuagagaagcagauggcaucuaagcugggucuugaaagcuuuggauaaggaaggagaggaugccuugguuggaugcaagaggauggacauguuguaagcagaaguuuagagacgggagaguauaaacccauuuaacugaaggaaaaucucuuaaauuuguagaguuguaaaccagaaagauaguuucguggccagagaccuuaaacagcaggugaagaaucuuggacuuaccuccccuguguuagaccaugagaucccaaaagcagaaaacuuauuuuuguuuacauuguuuccgguaugggauuggugcuuagugaaaguugaugggaacuguacccaaugagaaaucaggcagaauuuuuggaguaggacucugguaagaaaacagugggccaggaggauuaaugugcaaacaggguaaaaauaguauacaauugagggaauuuauauuccuguuaugaugcuggauuaggcaacaaauacaugacauuaagcugguggcagcagaauggaaaggaacauauagaugcauuuuauugugaaggaaauguuaccaggacuucagucaaagguccuuuuauuuagugaucaggagaaugguugguaccauuaacaaaauaaagaagaugagcuaaacugaagaguuugguuauacauauguaaaauuucaggucaugggggacaucaaaguuugugcagcagucaaggauaagagcuugagagaagaugagagcuggagaucuaaauuugggacuuguccugccacacuaucaaugauucugaaguauuuuaguguaucagugaaugguaguugaagcuaugagacugauugcugucauuaaggaagcaagugaggggaacauuacgacuccaugguguacauuaguauugaugggaauuuccaugaguccuuaauuuguuaucauacuugcaucuaggggaucuuucagggauucuugcuccagacaaccucaggggauauuagucugacuaccaaacauccauaugggggugagguaucuaaugugucucaccaccuuuaggucggaauacuuuaaaaucauuauggcagauaauugcugauguucaucaacuuauuuugugguuuugcaauccugagcacauaaauaaagcacuccuugaucuucccaauaaccuuaugaaauaggcauugucaucaucccuguuuuacaggcgaggcacagagguuaaguuacacugguaagugacagggaaggguuucaaacccaggcagccuggcuucagaguccaugcuuuucugaaccacuauauucugcuaccucuugacacacagguuugacuucaggaauugauccuacagguagccucagaaauuguuagggacuuucuuuucauaccugguuaaucccuaccccuguuaaguaaagcuaccuuguuuaauuuuuuuuauccuuaaaaauucagacauccauuacuuaaucuugcucaguuccccaguuuacacuuuugaaugguaaaacuuacuucuuuguguacauaguuuuucugugugcauuucugggacuuugcagcuguuccauuuuuuggaguaucucuucucuccccagauguaaauguaauggacacgcaagcgaguguaugaagaacgaauuugauaagcugguguguaauugcaaacauaacacauauggaguagacugugaaaagugucuuccuuucuucaaugaccggccguggaggagggcaacugcggaaagugccagugaaugccugcgugagugccccaugacgucagucugucaguugucuuaaggacuuccaaggguggaagaaggaaugggugacuuucuuuuauuccuccuugaaaggaaagcucugaaaggccagcuuuuuguguaauuugaguaguauucaagucagaggaaagucauagaugagggcaauucacuguaaaggcaaacugaggguuuuguguuuccuucaugaacacaugucccagaguuggagcagcaucugcaagguuuagaaauuuguuuggauccaaauacugggccaguguagucuacuccggaauaugguuucucuagucguauuuguuccccuuuaaaauacuauuauuuuuaucaaugcucaggcauccaagguaauuaacauguaucaaauauaaugaguucuaggcuaagagggccauuccaagauuauuucuuuuuucuuuucuuuuuuuuuuuuugagacugagucucacucugucagcuaggcuggagugagugaucucaacucacugcaacuuccaccuccuggguucaagugauugucuugccucagccuccugaguagcugggauuacaggugcaugccaccaugcccagcuaacuuuuguguuuuuaguagagacgggguuucaccauguuggccaggcuggucucgaacuccugaccucaggugauccaccugccuuggccuccuaaagugcugggauuacaggugggagccacugcgccuggccgcacaagauuuuuucucaaaacuauuuuuucuuuaucucacugaagaguacaacggggagaauuuucccacuccccuguuggagagguggguagcuuugggaagaagaauagguccuaguauuccuagaaaaagguaaaaaugaaaaaaaaguaaaaugaaaaaacuugaaacauuguuuaucccuucauaaugucaugguuuauucugaacagauagagaaagaaaucucaggagaaaggaaccuuuuaaucaugauuuuaaagcagaaauacuuuucuuauguccuuacaaauauuguuuaucauauucuguuaagaauaaagagaaaaagaagauacucuuaacuugcagaaauuauuggcagaggcugggaacgguggcuaacgccuguaaucucagcauuugggaggccuaugggguuggaucaccugaggucaggaguucgagaccagccuggccaacauggugaaaccccgucucuacuaaaaauagaaaaauuagccaggugugguggugcacgccuguaaucacagcuacucacuugggaagcugaggcaggagaauugcuugaaccugggaggcggagguugcagugagucaagauugcgccacugcacuccagccugggcaacagagugagacuccgucucaaaaaacaaaaacaaacaaaaaaauuauuggcagaaaccccgagaagggaccacuaucuuaacucacuacuguuuccacugaacugccgagaggagauuuucuuauucaucuuuucaacaaauccuaagauuugcaaguaaaauuuacagccuccucuaacauuuguaagcacuugcuugaccuucuuuaauuccauuacugaacuguaauauucaguguuggaagcucuacaauaaaggcugguacaagaaugaaauacuccuaauauguggcaucuaaauaaauggacaugugugcuugaaaagcauucugcuuaauaaugucguauuuugagucuauccaggaaguuacuuaaagaaccaaacauugccaauucaccucuagcaaaugaacugaguacuguagcuaaaggacuuugaugaggaacuaagucaauuugcuuuucucguuggucccuucagcacugugacacuucaaagagugacauuucuggauguugugacaauacuacauuaauugucaggaugcuagggcuagggaagagaacuaccuucucucaaggagggagccauggcauuugcuuuagcuguagguugggacaguguggacagugguguuauucugcuuuaccgucucagaacaucagaucuucagguggguugggcuugguggauugagggauaagcuagggcgucuugagggaagagaaauagcuaaugaaggaaggaaaagggcacuuuaaaacuaacuuaacaaaacucuaauuuuugguggcaauaacucaaguuucuaaaaaaguuuucaguuguaauacuguacuaugaaauaacugaucauaagaaagagagaaaaagaacaaaaggggcugaguaugguggcucacacuugcagucccagcacuugggaggccaaggugggagacucauuugggaccaaccugggcaauauagugaaacccugucucugcaaaaauaaaaaauaaaauaauuagcaaggcaugguggcaugugccuguacucccagcuacguggcaggaugaggcagaaggaucacuugagccugggaguuugagaccagucugagcaacagagcaagaccuugucucugcaaaaaauuuuuuaaaaauuagcugaguauaguggcacacaccuguagucccagcuacuugggaggcuaaggcaggaggaggaucacgugagcucaggaauuugaggcugcaaugaguuauggugacaccacugcacuccagagugagacccugucuccaaaaaacaaacaaaucaaaauguguucaugauuuugguuagaagaagucugcauuaaaaaagaaaaauauauuccaaaaaagauguauucgaauauuuuuuuuaaacaacauccuguucgauuugaaaccaaauaaaacuucuuuuuauuuacucuucaagauacugucuacauuuugggaagaaucaauaacucagaaaaaaaucuuuuuauuauaaauauaguaaggaauuuuugugacuacagauacuuggucuugaaauaugguugugcccugcagggaauauagcuacuuaacagaucacccauuuggaguugaggcuucccuguacauggauguuucuggaggaucuagauuucuuuuuaauucugcuuucaucugucguggcacuaauuuugacccauaugucucaaguuaccccagucuagauauauaaauaaucuggcacuuuggaaguuagugucuuaauguauuugacucaucugaggccuaaaaaguuaagguaaauugaagccugcauauaaaauggcacuuuguuuuuggaguugauacuagaauaaaggcuaaagauucaggagaauuauaauuugacuugacuuuuacuuguauaugaacaauuaccuggaggcagauuauuuucuaaguacgagaauuccuuguaucuuacgauggugcuguuuuuuagagggaggaacauuucuuuaucaucuggcuguauauacccuuuauugacauccuguuggguuuuguugguggugguuuuuuguuuguuuguuuuugagacagaguuuuagcucuugucgcccaggcuggugcccaguggcgugaucucagcucacugcaaccuccgccucucaggcucaagcgauucucuugccucagccuaccaaguggcugggauuacaggcaucugcuaccacacccggcuaauuuuuuguauuuuuaguagagaugggguuucaccguguuggccaggcuggucucaaacucaugaccucaggugaucugccugccucagccuuccaaagugcugggauuauaggcaugagccacugcaccugaccuucuuguuguuguuaaugaacagugcaucugguaaucauucuuagucuaccaccaucugucugucucagagaugugggaaauuauguuugguuuuaagucuuaaaaugcucuucuuaaagguacccagaucugauguaacucguguguuuugacugacagccugugauugcaauggucgaucccaggaaugcuacuucgacccugaacucuaucguuccacuggccaugggggccacuguaccaacugccaggauaacacagauggcgcccacugugagaggugccgagagaacuucuuccgccuuggcaacaaugaagccugcucuucaugccacuguaguccuguggguaagugacaggaagauggauugaaagacaaaaugauaguuccguggacccccggaaaggaaagcuuuguuuccaaggcauuuggacaacuaaauguggagauguauacauuauuguaacacagaaaucagucaagaucugucucuaccccaugccuccaccuuuuuuaaccaaguugaacuuucagaugaguuucugguguguaagaggggggugguggccugaguaaugguucugcaaauaauuagcagcaggaucauagagacaauuugaacuuugacuguaaaagguuaacugcuuugugaguucuuccuuguugaugauuuuguuuagucuaaucuccuuagagugcugaaauauucuuagcauguuugcguguguacagagaugcacagcauucuuagucuagcccauucuucaagaguuuaaccuuuauauuugucauuuaggccuauauauacuuaaauucuagacaugggccuuaaggggcugugaucacccacagagaaguaacugaucuugugugcaguguuucauuggguacaaagugauuuucaacauugaugaguaaauucaucuuagcaugugucuagaaacuuaaaaugccaugacuuaaagggucaugauuuugagaaaguucugauuuaaaauuugguuuuuauuaccuuugugaccaucaggagauugcauacugguucucaggcauugcuuuuaauuaccaguuaucuuucuuuaacacauugauuuuacuuacguaucuggccgaauuuuuguuugacaauaggcauuuuacauuuuaggcucucuaagcacacagugugauaguuacggcagaugcagcuguaagccaggagugaugggggacaaaugugaccguugccagccuggauuccauucucucacugaagcaggaugcagguaaaauauuuucaaagccagaagaagggggcagaaucuauauauagucaacacauauuaauagaucuuauggcuuauuggcagcaggguaaacauuuuuccuguaauaauugucaacaagacugaggacuagcuguaauggugagccacaagggguuuggcuuguacagagaguaagcagaguuuuaaugggaugacuaucuuaaacugaaaccaaauauaaaaaugacuuuaggcucacaccuguaaucccaacacuuugggaggccaagguggcuggaucacgaggucaggagaucaagaccauggugaaaccccgucuauacuaaaaauacaaaaaaaauuagccaggcgugguggcgggcagcaguagucccagcuacucgggaggcugaggcaggagaauggcgugaaccugggagguggagcuugcagugagccgagaucgcgccacugcacuccagcgugggugacagagcgagacucugucucaaaaaaaaaaaaaaugacuuuaggguccauuuuguucuauguguauuucuuuuaaaaaagucuguuggcugggcgccuguggcucacgccuguaaucccagcacuuugggaagccgaggcaggcggaucacaaggucaagagaucaagaccauccuggccaacauuuugaaacccugucucuacuaaaaauacaaaaauuagcugggugugguggcgugcgccuguagucccagcuacucaggaggcugaggcaggagaaucucuugaacccuggaggcggagguugcagugagcugagauggcgccacugcacuccauccugggcgacagugugagacucugucucaaaaaaaaaaaaaucuguuaacauguaaaacaaagggcugacuugaagaguggaaguuuucucccuucucugauuguuuuauccauuuuucauugaauaggccaugcucuugugaucccucuggcagcauagaugaauguaauauugaaacaggaagauguguuugcaaagacaaugucgaaggcuucaauugugaaagguagugcauucuuucucuagcugcauuguguuuucuguuaccauauuucaaguaaaaaaaaaguaacugauugugucuuaaucuuuuucagaugcaaaccuggauuuuuuaaucuggaaucaucuaauccucgggguugcacacccugcuucugcuuugggcauucuucugucuguacaaacgcuguuggcuacaguguuuauucuaucuccucuaccuuucagauugguaauuuagaccucaucccccaaccuguuagaacugugagauuacacuuaaaauauuuuuaaaaauaaaaucagugacucuuugagggcuuuuugaugguuggcaacacuuuguauuauuuagcaugcauaguuuuuguaguuuggccuuuuaauuuaaugaaaauguacuuuuggcuuuagaauuuaucucaaugaauggugauuacaaauguuauauaaauaguaauaaaguaaaauauaguuugagugguauagcauauauugguacuguuguaggauccauuuauucaaaaagguuuauugaugccuuucuguauacaagguguggucuuacacauuuuuaugauacauagaggaccugaauucaggauguuuacaguguaaagugcuuguguuuuccuucucuaccugcagaugaggauggguggcgugcggaacagagagauggcucugaagcaucucucgagugguccucugagaggcaagauaucgccgugaucucagacagcuacuuuccucgguacuucauugcuccugguaaguaaggcuagaaagcagucugaccugcugugugccucuguuuagucucagucucacauucuugcccaccauugugucuguauuccagcaaaguucuugggcaagcagguguugaguuauggucagaaccucuccuucuccuuucgaguggacaggcgagauacucgccucucugcagaagaccuugugcuugagggagcuggcuuaagaguaucuguacccuugaucgcucagggcaauuccuauccaagugagaccacugugaaguaugucuucagguaagauagccuucuuuguaaagugagacuugacgaacauugugaaaguggugucuuuauuuaaguuuaacuggccucuagauguauuuuaaagaaaaacuucuggguuauuguggugauuuuguaaaagggagccuuccuuucuuuaccuuuaucuuuuccaauuguacuaccaaaccaauagucuuauuuuuuauuugauuugauuguuagagcauugcauuguuggggcauaaaugaauaagaaauauuuccccaacauccagaauuguccuuacagagguuaauguggcccuuucuuucucuccaggcuccaugaagcaacagauuacccuuggaggccugcucuuaccccuuuugaauuucagaagcuccuaaacaacuugaccucuaucaagauacgugggacauacagugagagaaguaaguuaugauauaauuuaggagaguuguuuaaaaagaugauugguuagaaagauucaugauaaugcaaaaguuucucuuuccuaauaauauaacacugagaaguguauaacaacucacauuauacaugaauuauauauaaagacaaugcauuuuuuaacggcuuucaaggaccuggaaaaaauuugguaaaauuaguaaauaguauuauuuacuaauugauuacucaauugaucaguaggucaauugagguuacauuguauauaaauagauuuucuaaaaaaccuaauuauaggcuaggcgcaguugcuuacaccuguaauccuagcacuuugggaggcugaggcgagcagaucacuugaggccaggaguuugagaccagccuggccaacaugguggaaccccgucucuauuaaaaauacaaaaauuagccaggugggguggcaaaagccuguaaucccagcuacuuggguggcugagggaugagauucgcuuaaacccgggaggcagugguugcagugagcugagcucaugccacugcauuccagccugggcgacagaaugagaaucugucucagaaaaaaaaaaaaaaucugauuauaauucuacuggcucaaguugccucaucuucauuucuuuuuauuuacuguuguguaauuauaauuuauaauuugagccauugguuaaauuauuaaaagucauaaauuauugaaugauuuuguuauaauuuuuggugaacaagaguuuaagacuuaaaaauuuuuuuuuuugagacggagucuugcucugucacccaggcuguggugcaauagcaugaucuuggcucacugcaaccuccgccuccugguucaagcgauucuccugcucagccucccaaguagcugggauuaccggcacgccccaccacacccagcuaauuuuuguauuuuuaguagagaugggguuuuaccauauuggccaggcugaucucaaacuccugaccucaggugaucccccugccucggccucccaaagugcugggauuacaggcaugagccccugcacccggucaaaauuuuuuuucuuaaaaaaaaguuuuaaacaaggaccuuuuucucuagcaagguacagcuguuuggggagguggaguuagugaugaugugguauugggagaggcaucugcagcuuagauguguugauuuuugaaaugccugcaugaauauccagauaaaaauggcuuauaaguaguuagaaauaugaaucuggggcuuaggaagagauuaggacuagcgauccagauuuagaagguugucaacauaugggcaauaauuuuuaaacuuggaaauaugacagaaaauauagauggaaaagaaggauggaauccuggaaacaguuaaguccaugcucuaagacccaagggcaacauggcgaaaccacaucucuacuaaaaaguacaaaaauuagcacaguaugguggugcaugccuguagucccagcuucucuggaggcugaggugagaggaucacgugcacucaggaggucaaggcugcagugagugguaauugugccacuccacuccagccuggacaaugagugugacccugucugaaaaaaaaguaaaauaaauaaauaagagccaagggagaaaaagaauuuuaagaaagagaaacaauuaacaaguuuaggaagcuagcaucguuggguuuuggauuggugauuccuuaaucacugcugaguuuuuguuuuuaagaaguguuaaaacuguccaggcgugguaacucaugccuguaauuccaguacuuugggaggcugaggcaggaggauugcuugaggcuagguguucaagagcagccugggcaacauagcaagauucugucucuauaaaucaaaaaaauuagcugggcaugguggcacacaccugugguccuagcuaccucggaggcugagggcaggaggaugcaugaacccaagaggucaagcucgcagugagcugugaucaugccguugcacaccagccugaguuuacagaguggaucuaucucaaaaaaaaaaaaaaaaaaaaaaagguggcggggugguguugaaacugaaagaucacagugcuuuaagaaguaauuugaaguugaguaaguaaaauaaagaauguucaguuaagaaguuuggcuauaaggaaaagacauggacuauaauuugggaguaggaacaagauugaagaaaguauuuuuagaauggggagacuuaaggauguuuagaauuggaagcacaguaaccaauaaagccauaucucaugaccuaacuaggcaagauaaaccuguaaacauacuaaaaguaguacauuuaggguaguaauggagguguccuucagccuuaggugguuaauuuucaaaugaauuuuauaaacagcaagugcuauuucauaacaugaaaaauacgcuuuaagcauaagacugcaaaacacuagaguggaauggagauuacagggaaauaugaugauguuacugaggccuauaccucucugauaaaauguuccuguugaugcuuguaucaggggcaccacuggauuggaugaaccauuggucuaaggcaauauaagguuuccucugauuucuuauagaaauggaaaagcauugagcuuuggaguaauuguauacuugucagaaguaacccugaguauuagaacuuuacuugagaguuuuuguuuuuuguuuuuugggggguuuuuuggcuguuuuacagagggcagaaauuauguaaccugaguauuaccuguugacaggugcuuucccuucugucuuacccuugaacucuguagugccugcuuuuguagcaaaagaaugaaaacacuccuuaauggcuguagacauaaacucuucuuuuccccccacacucuuguucauaucucuucucacuccaaaugauugucugaugcuuuucauuuuucacauugguggggacuguaaaauucagcaaaucuagggguacauguguguguuuuaaaaaaaauuaguuugggccgggcaugguggcucaagccuguaaucccagcacuuugggaggccaaggugggcugaucaccuaaggucaggaguucgagaccagccuggccaacauggugaaacccugucucuucuaaaaaaaaaaaauacaaaaauuagccgggcaugguggcaugcgccuguaaucccagcugcuugggaggcugagacaggagaauugcuugaacccaggaggcggagauugcagugagucgagauugcaccacugcacuccagccugggagacggagugagacuccaucucaauaaauaaauauauauauaaacaaacaaauaaauuaauaaauaaaauaaaaguuugcuauaccaccacuccagauacuuagcacucaguaccacaugauuguucuaaaugcuguuuucuaauucucuucuccaggguguagacguggauaucucguuuaguguaucagagcccaguuaagcaaauggcuaauuuucucuggaauuuggggucuaguuacuuuuuaguguuacugacuuuacacaagguuuggaaaacaagccaguucagugauuuucuuuuccucacuauacacaggugcuggauauuuggaugaugucacccuggcaagugcucguccugggccuggagucccugcaacuuggguggaguccugcaccuguccugugggauauggagggcaguuuugugagaugugccucucagguuacagaagagaaacuccuaaucuuggaccauacaguccaugugugcuuugcgccugcaauggacacagcgagaccugugauccugagacaggugagaugaucuuuggcagcucuuagaccuaacuucucuuuagcaauuguguagaaagugcucauugucuuauauacuuguacauuugccuguuuucucacgccugccuuccaaauagguguuuguaacugcagagacaauacggcuggcccgcacugugagaagugcagugauggguacuauggagauucaacugcaggcaccuccuccgauugccaacccuguccguguccuggagguucaaguugugcuguuguucccaagacaaaggagguggugugcaccaacuguccuacuggcaccacugguaagucugcucgcuucaucugcuuucaguguucccuucuauaaaaagaccuaggggaaaggggcuucggaguuguuuuggaucuuuguguuugguucaguuucagugguuaugguuuuccuaauaggaagcugaggcucacucuccuuguuuccuuccaucucucuuuuggguauccccugauugucuccaucugucaaccaagggcuuucaugucaccuugaucuaccgucuccccuuuaggugaucaaaucucaucuugaggcuucaaaagccuuucuauaucuaugauagcuaaguuuguauuuccagcccuggcaccucuccugagcuaccuacuugccauuuccacuuggauggugggcuagaagccuuccacuugccuuuccacaucccuguucaccuuucugcacccugacugagaccugcaugcacuacaucaaaugucaggcuccauuugcauucagacagcagaaagcacauaugggagcucacagagaaggaggagggugaggacagaguauuuaucccauggccccuucucuaugggguucucuggaucgaugaccucaaauccgucauugaugagccaaaucagcuccugguaggccuucuccaaacagcucuuuuugccuuuagguucugcuagcugccccacccaccaccugaggcccaggguauggagccuaucucaagugcugcacucuucucgcaguuuccuuacacuccgugcugauuugauugugucagccauuuucugcugugauuuugauucacauagccaaaggaacucaaauuuaaacaaauccaaguuaaauauuugauuuccucccuuuuucuucgacccuuuguuucuccuccagucuuguucaucuuaguaaauaugcugccauuagccuaguugcucaagcugaaaccuuagggccuauacuugauucaucuuccuuucaaguccuagaaacagucagcaaaucuuacugauguuaucucagaucugaccacuuuucaccacuucaacuaucaccaaccugguucaaaccucuguuaucucucaccugggauugccuaauuguucucccugccucaccugcuccccuacaauggcuccaaucucaacaugaaagccaaaaugguccuuucaaaauguaccucagauuacaccacuuuuaaacccuccaauagcuucuugauacacuaaaaccaaauccuuuacucugaccuccaugcuucuacauggguuugaacugcuuccauggcuuaucuuguuuuucugaaacuuucuucccuuggauauuauccuggcuggucucuucucugucuuuccauugcuaucccaaugucuccuucuuacagaggcuuucccuacccaccaauauaaaguagcccucaccuucaccccaucaugcugcucuauuuuguuuaaauuuuuuaugcuuaucccuaucugaaguaaucuuguuuauuuguaugucuguguauuggucuucaccaaccgcugcauacacuucaugagagcagagaccuuguccaccuuguucacaucauccuaaugaccuagaacagugcugguauauaguagaugcucagaaaauacuuguugaaugaauuaauaaaccucggauucccagaaauuugagucuaauucaggcccuacugguuacaaagauaucacgagcccaacuugaacuaaucaagguaggaaaguggaaaaggaaggaugaggagcagugaguaguagaguggaaagagcucuggauucuagcucucccucucuaccugucacuucuuugguugcaggcaaauuacuuauccucucuguucucugagcuauaauauuuaauacaagcagucagcaacugaugauuucuaaguucucuucuaacaugcccugauucuguaccaauugauacugauuaacaaggauuagcacaugccucuuacauuuuaagagaaugguucugcucacccuguugugugggaaacuuacagugucaagaguggcacuucaccucuuuuaauaucaucugccaaaacaacauauaugaaugugccauccuuugagacuggagaaguuuauaaaccuugggcuugacucauuuaccgagcacuuuuaauacaugauuuggguugauugucacaacaauuaaagugaaguaggcagaccaggugcuuccugucuagugaggaaauagagaugugcucaaggucacucugguggucuggccccgugccagggcugcagcccagguccucugcccuccacugcaccaugucuucucucaugugaugauuacacuagauuaccuguagccagugguaaucuagcaccaaaaaugucuaaggccuuucuuucauaacaucagauugucucauccccagguaagagaugugagcucugugaugauggcuacuuuggagacccccuggguagaaacggcccugugagacuuugccgccugugccagugcagugacaacaucgaucccaaugcaguuggaaauugcaaucgcuugacgggagaaugccugaagugcaucuauaacacugcuggcuucuauugugaccggugcaaagacggauuuuuuggaaauccccuggcucccaauccagcagacaaaugcaaagguaaucagccuuugaucagauucugucacagcuaaaugccccuuuauugugagaauucuugugugucucuuaaaauauguauaguuguuuaguccaauagaaauacauugugaaccgcuuuugucuuuuaaaauuuucuagucaccacauuaaaaaaguauaaagaaggacagucaugguggcugacaccugugguccuguaaaaagaaacaggugaaaugaauacuaauguauuuuauuuaauauauccaacauaugauuucaauaaguaaucaauaaaaauuguuaaugaaauauauguuuuuucucacgcuaagccuucaaaauccaguguguaucucacguuuauagcacaucucaauucagacucaccagccacauuuaaagugcucaguagccacaugugacagcagcuaccaaccuggcaacacaggucuaaagaaucucuuuagguuguuuauauuuuaguauuucucucaggugauuugugucuuuugccaucucugucuuccugccuuagccugcaauugcaaucuguaugggaccaugaagcagcagagcagcuguaaccccgugacggggcagugugaauguuugccucacgugacuggccaggacuguggugcuugugacccuggauucuacaaucugcagagugggcaaggcugugagaggugagacauaggugccuuuggugaaaguaaucuuugcuuuuucuguuauaaaaaaugaauuuuuauaaguacauuuaauaauugacuguucagaaauuacuggagcgccuaauguaggcaaggcauccuucaggggcagugcuggagaauuguaauaaagcuaaugaaagaaaggaguggagcacaguggccccagcugugccagaaucaccugagcaaccuuuuaaaagcacaaauugccggguccuuucugaggcacuuagaaucagacccuucaggguugcagccugggaacuucuguuuucaaagcugcuacuuaguguccauacagucccaggcuggagagcacugguagcaguuaaguuaggaaaagagguucugaauagcacucaugaaaauuacuugaaccuuaggggcuuaauaacccuuaacauuccaucuuaguaacccuuaccauucaguuuucugauacaaguuacaaauuacaucagugcuauacuaaaaaaaaaaaaaaguugugcuuaaagucuguuuuucuugccugagaaauguccuguguucauuuucaggugugacugccaugccuugggcuccaccaaugggcagugugacauccgcaccggccagugugagugccagcccggcaucacuggucagcacugugagcgcugugaggucaaccacuuuggguuuggaccugaaggcugcaaacguaagggguguugguggcauacaacucuaagcuuccacuaauuccaguuagugucuuaaggccagaaaggacuuugacagccucagucuagccacuugacucauagucagggcuguaccuaagucaucguagaugcuuuauuugaagaauauuauccauuucuaaaacucugcagaucaaagccuucucugguuucuuuguauguuuucuuuuacaacguuucugaugcuuccuuuuuccaaucuuuuauuuuuuccaaggaagucuuccuuugauuacugagcuuucccacugugguucaugaaacuucuuuauugauugcauucuuagugcagauaaugaaauaguggaggauucuguucacaacauguuuguugacuugcuguaguugcuucccacccuuggggcccuuuugguaugauuacguguaaacaucugcuucuccuuggcauaaacacuugccuggaauugggccucagaacagauuggcuuuugcuuucugaauuccuucauuucuccuguggaauguagcauaaguaauugacucaguucagagaacacagugaauaaacaaacuauaagauaaugcaaaagaagcauuagcauuuggguuuucuaguuccuuagagaaauauuaaacaguggagaauugaagguagagaugaauccuugaagugcaugaaacgagcacugauaguuucauaacuucucuaauugcuaaguaaccugaagugugucccaaagguugcacguuuuacuuuaaagcucauuuugacuuuuaaaaaugucaguuuucucugcuaaacagacuuagccauuuaagaucucauaaauaguccuguuuuucaaaaaaauuaugacaguauagucagcuuauagucagcuuauuguuaucagucugaauuaagagauauacucuuccuucuuuugcuaauuauguauuauuuucuccuuauucugcagccugugacugucauccugagggaucucuuucacuucagugcaaagaugauggucgcugugaaugcagagaaggcuuugugggaaaucgcugugaccagugugaagaaaacuauuucuacaaucggucuuggccuggcugccaggaauguccagcuuguuaccggcugguaaaggauaagguaagcugucaauagugcauucauucauucauccagcagacguugaguggcaacuuacugugcacuaaucucuauagaaaaaguggugaacaagguagauguggucccuguucuuaaagacuuauguuccaguugggaggcaaauaauaaaaaauaaauaaauaaacaaaacaaacacugagauaagugccaggaagaauacaaauggagaauaacugggggaaacuacuuuauguaaggccucucuacagaauucaucuaaggugagaucugauggauacaaaggaaugagccgagugaaaaguaaugguagguuuguuccaggcagaaggaaccugguauacagaggccugaaagcuggagaguggcuggagccugcugagugcagaggguguguucuguuuuuuaagacgggagagguugguacggacagguuauaugggaacaugaugaccauaguaagaaguuuagauuuuaucccaaauccaauaagaaugcauugaagaaacucuuaaaaucugggaaauccagauuauauuuuaagaggagcacucuugacugaugugugaagaaugaugguuaggaauggggcuuaaugggaagccucaauuggauuggauaaauaugcguguuuggggacaggauaggaaaagagaagaauaaggaugugucuuggguuuuuugcuuaagguagcuggaggccuuauuuacugagauggagauuccucagagagaauagagguaagagguauaauuuuggauguuaaguuugagauaccuaucagagagcugaguggagguaucacgaagguaaucugacacucaagggagaggucagagcuuaagacucaucagcauacagucuuuaaagucaaaggaacagcucugaagguuuuuuuugaagcuggaaaaauaaacuagccacgucuucucuucagaaguagacaugcauggaguggauagaacuacauauucaugcagcacaccaacauggcacauguauacauauguaacaaaccugcauguugugcacauguauccuaaaacuuaaaguauaauaauaauuaaaaaaaaaaaaaaagaacuacauauucauggagugcccaugauuccugcaggaagugugauugaguucuucaggaauacuuguguguccuaccuuucccuuuucuuucuucuuuauguuuagguugcugaucauagagugaagcuccaggaauuagagagucucauagcaaaccuuggaacuggggaugagauggugacagaucaagccuucgaggauagacuaaaggaagcagagagggaaguuauggaccuccuucgugaggcccaggaugucaaagguacgcaugauugaacagugcaugacuucugugagauggaccaaucuuuagauguggcuccuaaagcaagguuaguauaguuuuauaaaauucuuucucaguuuuuaaacuacucauagauuauaaaucauuucauuuuuuaaacacuaauucaaaaagcaaccugacaaauuuacugcuuuaagcuacaguaagcauagggugauuuuccaacaaauaaaaaacuauucgauauucaaauuucaagcauuuuaugaaucuguucuauuacaaggugucuuaaaauauuaaaauaguuuuaaaaaucauuaaaggcaugcgucuucauaagcuuuuuuuuuuuuuuuuuuuuuuugagccacaaucacucuguugcccaggcuggagugcaguggcgcgaucuuggcucacugcaaccuccaccuccuggguucaagugauucuccugccucagccucccaaguaccugggacuacaggcacaugcccaccaugcccgggguaauuuuuuuguauuuugaguagagauggcgguucaccguguuagccaggauggucucgaucuccugaccucgugauuugcccaccucagccucccaaagugcugggauuacaggcuugagccacugcgcccagccaaaaaauuuuuacauuaucaaauaauugaguaaccuuccaagcaggaccaccauauauaguuaggcaagaguuuguagaaugucaccucugcacauacauuugguagccaaguuccaaguugguuuuuuccaaaccuguauucaucuucauuggucuuaccuuugacuucucaucuuuuuuuuuuuuucccacauuccuuagaaaauuuagaccccaacaccgagcaugaugcugaaauaugaauuggucaauuuacuuaaugguuuuuauauauuaauaaaaccucaugauacaugagaguuuuaauaauaacagacuuauauuuaucuuuugauuuguuaggaccugaguaugagauuuaaguugaaugagcauauuaauaaagaauaauuugaagaacuauucaaaaacagagaucaguuugaaagaaauuacacugauaugcuggcacauggggguggcaaaagagucuauuuaguuuaaaauacaaaaugaguuuaauuugucauacuucaacuuauguuuuaaaccuaguuuuuucuggguuuugaaaaauguucggcuuuuagggcuggcagcauuuuuaacaacauuguagauuuaugacuaaauugcaugugcugguauuaaagucagucauucucaccuucauuaaacauuccuugggugucuucucuuugccaaccacugcauaagaccagcgauauaguggugaguaagaaagaguucguagucaaguggacagauggacgcacgguuggaggugugaugagugcacagugaaggaccuacugggugugguaaaggcuguccagcuauggcaggggcuuuguggaaaccuggcagaaaguugcgauguuuagaagaguagagauacauagggccucagauuucaugugagaugauaugauccucuucagauaauuuacagacuuucuucugcaaaccauuuuagauguugaccagaauuugauggaucgccuacagagagugaauaacacucuguccagccaaauuagccguuuacagaauauccggaauaccauugaagagacuggaaacuuggcugaacaagcgcgugcccauguagagaacacagagcgguugauugaaaucgcauccagagaacuugagaaagcaaaagucgcugcugccaaugugguaagugauugcaaacgucugagguggggaugggggaggccccugggguuuguagcaagucuguuacuggcaguggagugcuucuucaacuaaauugacuccaugcaucuuuuuauuugucccuaaauauggggcagaaaagccacauugcucauaguuggcaugaaacaguuauuaaaaacuggauaaaaaccaagggacaucuggguuauuucucuagcuuuguuccuucuauggaacuaggcaguuuaaucuuccuuuauccuuuacugaaaauagaaucugcaaucaagggugcugauauuaaauaaagaucucugaaaauaagaagagguauucuuggggccaggcgcgguggcucacgccuguaaucccagcacuuugggaggccgaggcggguggaucaccugaggucgagaguucgagaccagcuugaccaacauggagaaaccccgucucuacuaaaaauacaaaauuagccggguaugguggugcaugccuguaaucccggcuacuugggaggcuaaggcaggagaaccacuugaacccaggaagcagagguugcggugaacugaaauugugccauugcccuucugccugggcaacaagagugaaacuaucucaaaaaaaaaaaaaaaaaagguagaggcauucuuuuugcccucuaacaaaaauuuaguuuugacucuugcuuuauuaaauguaaauaauucaguccuuugagaauaagugcuuuauuuccugugcagucagucacucagccagaaucuacaggggacccaaacaacaugacucuuuuggcagaagaggcucgaaagcuugcugaacgguaacuucuagaucccuguuuaaugguuaaguuguggcuucuguuaugggguguguguguguguguguguguguguguguguauugucuuaucccauaacccauaaacacuuucuacauaacccacuuuugcacacuuugcucucuuuucuaagauauuaucagcuguguauacucuuuucuuccuuuuacuuugacauuagaauauucacuuugaauauuagaauacaaugguuugaagacaaaucauauuuauauuucucaaaaccauaauauuuuuagauuuuuaacuuauuuaagacuguaguaacugaaugaaacuagcagauuguuguuaauaaagauuaggcaugggauuuguuuuuaacuagguaaaugauuucuugcuggcauacacaauuuuauauguacauuacucucaaauaauuaaauuuaaaaguaguuuuucugaagaauuauaaacauuuucucuuauaaauguauaccaauaauuuuuuuggaaaauauucucaucucaguuuuagaaugcuauucauaaauucagccccacugaaaugaucacaaaauuccaaaugaaugacguuuucuaauauuuguagaauuguugcccauguuaguauauguacauauaauaaaguaggccgggagcaguggcucaugccuguaaucccagcacuuugggaggccaaggcggguggaucaccuaaggucaggaguuugagaccagccuggccaacauggcgaaacccaucucuacuaaagaugcauuagcugggcaugguguguaugcguguaauaccagcuacucaggagacugagguaggagaauugcuugaaccgggaggcggagguugcaauaagccaagaucacgccacugcacaccagccugggugacagagcgagacuccauuucaaauaauaauaauaauaauaauaauaauaaaguaagcauuaccugaauuuuacuuaugucccuaucagaugguuguuucauggcuuauuuuuuguuuuaucuguauagucauaaacaggaagcugaugacauuguucgaguggcaaagacagccaaugauacgucaacugaggcauacaaccugcuucugaggacacuggcaggagaaaaucaaacagcauuugagauugaagagcuuaauaggaagugaguauaauuugaaagugguuuacaccccuucagguguucugguaaguaacacuaguucaaugaaaaauuaaaugcuggugcauucagggcauacauucaugcaguaagauuuccuuuguuaaucaugcuuuugaaauggaaaaguaaguagagaagggcaugugaagccacagagauuugguuugauucaauuacuguaacuacagagaauaguaacaagaugagccaugauacuuaaaauugugcacaaauaaagaagaaaaaauauaauagaguaaguagaggaaacauaauugaacuacaaaucuuuaaagggugucugaaauaagaaaguauaugguaagccauacauuauagaaaauuuuuucuuuuuuuuguuguuuuugugagaugaagucucacucuugucccccaggcuaaagugcaauggcgcgaucucggcucacugcauccucugccucccggguucaagcgauucuccugccucggccuccugaguagcugggauuacaggugccugccaccacacccagcuaauuuuuguauuuucaguagagacgggguuucacuauguuggccaggcugguuuugaacuccugaccugaagugaucugcucaccucagccucccaaagugcugggauuacaggcgugagccacugugcccggccaagccauacauuauaaauagaaaugauaaaagaaaauguaaauaugcaaaauguugguauuaaaaugcaagcauuuuaauguagcauuuccuuugagguuuugggcguauuaucacaugaucauguuaaucugguuaacauuaagaugcuaaaagcagcuaagauugucauuaaaccacauuauuugugucuuagguaugaacaagcgaagaacaucucacaggaucuggaaaaacaagcugcccgaguacaugaggaggccaaaagggccggugacaaagcuguggagaucuaugccagcguggcucagcugagcccuuuggacucugagacacuggagguaugggggcagccuguacgcacagccccaccccgucucucccccaagucuaugugagagccgacugcucugcaccucccucuguccucccacugacucgcugguaaaguugagucuuauuucacauacgcuaauagaacuuaccaagguagccagaugugguggcucaugccuguaaugccaacccugggaggcugaggugggaggauuccuugaggccaggaguucaagaccagccuggucaacauagugagaccccaucucuuaaaaaaacaaaaacaaaaacuuaccaagguaaagaauccugugauuguaaacauuaaauagcaaagacuacuuuaaugauaugaacaaucacuccuaagucuuuagugcaaauccaaauuauaauaauacauuugaauugcuuaaagcagaguacauguagacauuuacucccaggcucugucuaguagagaccuagagagaaauaagagagaaugguuuaauuaaaagacuauagcaggauguucugaggcagguaaaauauuuuggaauugguaggauuuuauuucauaucuguacucuuaaucauggauucucacuccaagcucuguauaaaugguauuuuuuuugcauuaagcuugagguuuacuaaguuucacuucuuauaucugagguguugacuugauuuuuaccauaaagguuuaggucucuuuagauauguacagauugucugauucuauauauuuauaauuagaaaauaggcagaauuagucuaugaugauaaaaaucagaacaauggcaggcacaguguuggaaagguagaguagagaucggguggaaagggagaaaagggagcuucuugggugauggaaaucuguauuuugauugggguguugguuaugcagaaaugcauuugucaaaacucaucaaacuauauguggauucugugaacuucaguggguguaaaguauaucucauuuuuuaaaaaaguccauaaaaucuugaucugugcaguucuuuuaaaaauaucauugaguauuagguguuacagaguuccuaagccuaccuuuucauuaguuuaaauguuuuauccaaaguguagugaucuuacuugcuuuucacagaaugaagcaaauaacauaaagauggaagcugagaaucuggaacaacugauugaccagaaauuaaaagauuaugaggaccucagagaagauaugagagggaaggaacuugaagucaagaaccuucuggagaaaggcaagacugaacagcagguugguuugauuugcaggucgcuucauuucuugaggcaacauuugaacaguccaaaugggucugugaugaugccguacuuucagagacagcagaccccagugcugagagagcagccuaacagauuuuaugcuggcaagucucaggguggcaccucuggagagccuugucuguccaggagacagaagggauuugcuuugaggguucauccucucaucugccauguguuugcagaccgcagaccaacuccuagcccgagcugaugcugccaaggcccucgcugaagaagcugcaaagaagggacgggauaccuuacaagaagcuaaugacauucucaacaaccugaaagguagaaaaggcugagauaacaggggcaaaugcuuccgccacuagagugauuuuuuuuuuuaaucaugacuuuuaccauauuuauuacuucauccccaacucccuacuuuuuuuaugcuaaaguauuucaaagggaaaucccagagcuccugucauuuuaucccugcauacuucaguauggauuuuuuuuuaaagauguuuucuuauuaggcaaacucacauaaccaagaugccuauuuagagaacuuauauagguaaauggagauuaucuuucauuuucucugccaguggcaucugauucuuuguuguuguuuuuuuuucuucaccccagauagaagagaaaugugaccaauucacugagcaacugugaauucuugucugauaaaacagucauagguucuauaaauagagaagcuuuacaggaugcuuuacaggguacuaguugaaaauaugggccaggcacgguggccuguaaucccaacacuucgggaggaaggaucacuggaggccaggaguugaacaccaguuccucacuggggaauauagugagaccccaucucuauaaaaaaaaauuuuuuuuuuaauuagccgggcaugcuggcacauaccuguaguccuagcuacuugagaggcugaggugggaggaucccuugggcucaggaggucaaggcugcacuaagcagugauugugccacugcauuccagccagggugacagagugaaaccuugucucucaaaaaaaaaaaaaaaaaaaguaguaguucaaaauauggacucuggugucagugggccuugguucaaaacccugcacccugcaccacaggucauguaacuucuuuaauccucaauuuucuuauaaaaaugauacagccuauuuuaugucaaagacacaaagcucuuaacucaguacccgacacacaguaaacacuaaauaaauugcagcuuuuaauaaugguugagguagugguaaugggaugcucagcgcucugcauuuuaaagcacauuguugaaguaagaauucuauuuccagaaacggaacauuucuauaacacuaacugggagaccuauucuguagagauguguaauuucuaaaauuucagcccaugcucucuuccauuuuuuacccugacuuccauuguucauaaaacaaaauccaguuggaacucccugaaaggcccccuuuuuacuuguugggaguuuagcucaaauguguccuugaacuuguuucagauuuugauaggcgugugaacgauaacaagacggccgcagaggaggcacuaaggaagauuccugccaucaaccagaccaucacugaagccaaugaaaagaccagagaagcccagcaggcccugggcagugcugcggcggaugccacagaggccaagaacaaggcccaugaggcggagaggaucgcgagcgcuguccaaaaggugugcguuuccucuucuccaagagucccugcccauaucuuucucuggucacuuuccaguuucuuuccagacccucagagcccuugcagauuuuuuuccugaacuucaguaaaauugucuuaaaccauauuugucuuuuuuuuuuucuuuugacuaggcaugagaguagguauccacauugaggaggggaacucaguaaaagggugcuuuacucuaaaauuucuacuaugucucagugugaggucuggcuucagaggucuauagagcccauucccacaaaaaaucagacuuuuucuaaauaaacauucuucuuugaccuagacaggugguauuuauuucaauacuauguagugugccuuaucaauauaacuuucaagucccccuuucaaguauauugccauauguaagccacuccuaggagagacuucccauagcugccauugcuaggauucuuugaagucaucuucaagaauaauguuuuuuaguuuggcuuucucuuauuucaaggucaaucuguuuguuuuauuuaaaagagagauuggagcaauuuuagaauuagguauuuaagaaucagagaaaccucuuaguuuccuuagaacaguuggcuuuuggauuaauuauauuuuauaaaauacucauauuucaggauuguggucuuuuuguacauuaugaugaacugccaagaaugaaccaagcuagcuuugaauuuaaauuuuaccucagcgaaagcaucuaaucaauaugaugucguagaaaguguaugccauuaaauguuuaucauuugcugucuguaugaccccaacuaaaaauagcaauaauagaacagaaguuuccaggauuaaagaagaggauacaaaugaaagugcuagauaaaauacaaaauguuauuauguggguaguaauuuuuuuuaugauuauuuauaacccaaauugauaauguaagucaugagauaguauaaaucaauauauuauuauuucuggauuauauuuuuaagacauuuuauaaauuauaaaaggagcgggagcauacuugagaaaaaggaaagcuuuuuuaaaaaaaguacaauuuucuuuugugccuagaaugccaccagcaccaaggcagaagcugaaagaacuuuugcagaaguuacagaucuggauaaugaggugaacaauauguugaagcaacugcaggaagcagaaaaagagcuaaagagaaaacaagaugacgcugaccaggacaugaugauggcagggaugguaagagguuuugguauauuugcucauuggcagaaagugaacaguguuuaauaauaaagaucccccacuuguugagaagagucuuuuuuauauugacuucuguuuuucaucacauugucucgucaagaauuggguuaguagcuuacauagaagacaaagaauuuggaucuucugccagguaauuuuguugcacaauuguccugucccaaaguuacucaguuaaaaguaaaacauugcuuuacacguuugagguuuuaggacauuaaaaguauguguuuauauuuuucacuggguaauucauaaauguuaauaaaaaaggaaugcaaugaaguuaauuuucuucuuauucuuguucucccagcaccuuuagagacaaagacaaguuucuuguauauaagaaauuuuugaagauggcauugucuaccaccccaccaaaacauaugaaacuuacaucuaguuuaauuuuucacguuuugugauaauguguaugcaagguacuauuuguaacaaaauugacuugucaauggauggcccaaggaagaacuaagguccauuuuucuguucuaugcuauauuuugcuuugaaaagacuuuaauggagucacaguaggaauauucuuuuuccaguuggguguagcaaucacgguaaugacauacacgaacuugugguuacuugcucacuuucaguggcaaagaagaggccgucguucacugcugccagaaaacauagucccucagugugggucauuuucaucuugggauggaaaaaagaaguacaaagccuguuaaucucaguaaaaacucuagggaagugauaaaggaaacuaucucugugcaaccaccuaauuuuauuaugcuuuuuacagguagggggguggauguugguuuggauuguccugauuuucuccguuaugguguggcucaaguaaaaauucccauaaaggugucugggcgcagugguucacuccuguaaucccagcacuuugagaggccgagguggguggaucgccuguggucaggaauucgagaccagccuggccaacauggugaaacgcuaucucuacuaaaaauacaaaaauuaguugggcaugguggugggugccuguuaccccagcuacauaggaggcugaggcaggagaauugcuugaacuugggagguggagguuguaaugagccaagaucacuccacccugggccacagaggaagacuccgucucaaaaaaacaaaaauucccauaaaaaaaauagauguuucucacauguugagcauauauggauuucauuuuuaauaugauuguagaaacauuagauuuaaagcauauugaaaaagaaaacaguauauucuuuaggagcuucaaaaaaggguuuugguuuaguucaaagggugaaagaagaucuuuuauuauuuugguaaauaacuucuaaggaaacaaaccacccucacaugcacuaucucauuuguauuucugucaauucugaaaggccagcauuuggccaguauuauuugaaucuguauuguauuuuuuaaccagaagaaugaagguuuauagcuucauucuuuuggaagaggaggcuggagaccacagguuaaaugcaggugcaucgcucuuggccggcccuggcaggguccuuucucccuccuuuuacacucgcagacaagcuuguggaugcucaauaaggacagcugccguuuggacagagauuaaucauuuauuugugaagguuuuuucugccuugcuuucuuguucuuuuuuaaaucuucacauuguuuugaucccaaaauguuuguguuguccuuacucaaaacuaggaaaaacaauuaugugguaagaggcucagagccacuuacuuaaaucucaacuagauuuauuugugagaacaucuguuuucugauauuuagacacuuccucuuccauugcuguuuccuaugacucaugcacaguuauuuguucagguuucauggaauuucccaaguguauuuaccuuuguuugguuuuuaaaauguaaauuauauugccccaauaaaugaguaugugugucagggggacuguggcugggucauugcauguggagggggaguuuacagaagagaacuccuagaagagcuuuacuuaacuaugaaaauuuucaaagaauaggacauuucuaauaagucccuaagaguguccugaaggacauguuuugguucugaaacauaguuucuauaaucauccuuaaaaaauaacuuguuucugcuuaauaggcuuuacuaugaauauaccuccauauauuauugaguuagaaugugagaaaaggagauuaauuuuugaaguacaaauauagugaguuagugaguguaggcauccugacugccuagucauaacuuugaugaaguagaaauaccaacauccucaauaugaagauaugcagcagccccaccaaaaaaaaaaaaaaaaaaaagcaaugagagguuucaauuuccuaaguuagaaaagggaagaaaaucuggaaauuagauuuguugggucauugggaaaaaagauuuaaagaagaugaaaacauacagucaagacucuuugccucauuuuucccuuacaggcuucacaggcugcucaagaagccgagaucaaugccagaaaagccaaaaacucuguuacuagccuccucagcauuauuaaugaccucuuggagcagcuggguacguagccauagagucauuuuugucagucucugaaucuuuuguacuguucuuaggaucugauauaguacaguugacucaaaagcagaugauauagguuuacaugaaucccuuuuaagucauuaauuaaauuauuaauauuuccuuuugcuguugcuuauuuuugaaagccuuauaaaauaaauguuugucuugcaugacagggucuuuaagagcaacuugcuucuuuaccauacuuauuauuugucagcuuuacagugugaccugaaucaugacuuuaggcuguguuaaugugacaaguacuuacuaggugccuucuguggaccuugcccuaaguagaacacuguggucugaggaguuucuuuuuauauuuugaagauauauugccagcuaggguagcauuuaugguccaguaucauuguacaacuaaacagugauuuuucuuaacucaucuugcuggcaguaucuuuaagggauuuaaaguaaaggauuucaauaguagaauaaaagaauaguagaaucacaggcugggugugauggcucacacugguaaucccaguacuuuaagaagccaugcaaggaggauagcuugaggccaggaguuugagaccagccuaggcaacauagcgagaucucaccucgucucuucaaauuauuuuaaaaauuagcuggguguggugcuacacgccuguaguccuagcuacccgggagacugaagcaggugcaucacuugaguuugaggugauagugagcuguuaucgugccacugcacuccacccugggcaacagagcgaaacccugucucaauuuaaaaaacgaaaaagaacacuuaaaacuggucaugacuuuacugccuggaauucucuucauuugcuaaguaaggacaguccgaugaggggaaagcuuucaugccaaaagagagaaaaaccuugauuuuucaaggaaaucuaugcauacggaaaccuucuuuuaauccaguuugauaggguguuagggagcaggcuucauuuuaggacagaugcacuuuugucaccagacuccauuauaaagugucaacacucuagccaggacucuuuguagcaaggcauuauauuuuaauuugccagccuuuaaagacuggugcauuuuguuuugguggggggcuacagggguauuuuuuaucggucucaaaugucaagaauaaguuaugugccaacagauggauauaaaaugaaaguaagcuagaagagaaagcuuuuuguggaacagccagacuuuuaacauuagucugacuuggguuaguaucuuugcuuuguugccuauaggcugugcaaacuugggcaaauuauuuaacaucugagaaucacugauguaaaauggucuugugagacuuuaaucaagucaaguaugcaugaaaugcugucuauugugucugcuuuuguuuguuauggaaacaucucauuucuuucaaaagaaccucuuuuucuugcuaagcuuaaagugaagacuugcugaaauuauuucagcauuuuacuccuggccauuuuccauaggaaggcuccuaauagugucuaacuccugaaagcagaaagugaccuucaaaacugacccaucuucccuggaaucucucuaagagcugagggauuaggguucuuagagauuuguguaucuuugauggcacuaaaaugacauagaguuuacauguauacaccuggaaaagguauuaaauguuaucagauggcccucaaaggucuagaacaugguagcugugcauugaggaaacauucugcaaaaaccauugucucagaaagaaacauccagcucuauauuaauuguaugcucagacccaucccugcuggguuaggucagcauuuguacuugguuugcauauuuuauaccauugugugacaucaacaaucugcaagucacauuugccgggcugccugugcagaauggcagcugcugggccuagagucuagugcagguacuugugaagggaucauucuuacugaauaugucuguucucuucuauguacuuucugacccuccagggcagcuggauacaguggaccugaauaagcuaaacgagauugaaggcacccuaaacaaagccaaagaugaaaugaaggucagcgaucuugauaggaaagugucugaccuggagaaugaagccaagaagcaggaggcugccaucauggacuauaaccgagauaucgaggagaucaugaaggacauucgcaaucuggaggacaucaggaagaccuuaccaucuggcugcuucaacaccccguccauugaaaagcccuagugucuuuagggcuggaaggcagcaucccucugacaggggggcaguugugaggccacagagugccuugacacaaagauuacauuuuucagacccccacuccucugcugcuguccaugacuguccuuuugaaccaggaaaagucacagaguuuaaagagaagcaaauuaaacauccugaaucgggaacaaaggguuuuaucuaauaaagugucucuuccauucacguugcuaccuuacccacacuuucccuucugauuugcgugaggacguggcauccuacguuacuguacaguggcauaagcacaucgugugagcccauguaugcugggguagagcaaguagcccuccccugucucaucgauaccagcagaaccuccucagucucaguacucuuguuucuaugaaggaaaaguuuggcuacuaacaguagcauugugauggccaguauauccaguccauggauaaagaaaaugcaucugcaucuccuaccccucuuccuucuaagcaaaaggaaauaaacauccugugccaaagguauuggucauuuagaaugucgguagccauccaucagugcuuuuaguuauuaugaguguaggacacugagccauccgugggucaggaugcaauuauuuauaaaagucuccaggugaacauggcugaagauuuuucuaguauauuaauaauugacuaggaagaugaacuuuuuuucagaucuuugggcagcugauaauuuaaaucuggaugggcagcuugcacucaccaauagaccaaaagacaucuuuugauauucuuauaaauggaacuuacacagaagaaauagggauaugauaaccacuaaaauuuuguuuucaaaaucaaacuaauucuuacagcuuuuuuauuaguuagucuuggaacuaguguuaaguaucuggcagagaacaguuaaucccuaaggucuugacaaaacagaagaaaaacaagccuccucguccuagucuuuucuagcaaagggauaaaacuuagauggcagcuuguacugucagaaucccguguauccauuuguucuucuguuggagagaugagacauuugacccuuagcuccaguuuucuucugauguuuccaucuuccagaaucccucaaaaaacauuguuugccaaauccugguggcaaauacuugcacucaguauuucacacagcugccaacgcuaucgaguuccugcacuuugugauuuaaauccacucuaaaccuucccucuaaguguagagggaagacccuuacguggaguuuccuagugggcuucucaacuuuugauccucagcucugugguuuuaagaccacagugugacaguucccugccacacacccccuuccuccuaccaacccaccuuugagauucauauauagccuuuaacacuaugcaacuuuguacuuugcguagcaggggcgggguggggggaaagaaacuauuaucugacacacuggugcuauuaauuauuucaaauuuauauuuuugugugaauguuuuguguuuuguuuaucaugauuauagaauaaggaauuuauguaaauauacuuaguccuauuucuagaaugacacucuguucacuuugcucaauuuuuccucuucacuggcacaauguaucugaauaccuccuucccucccuucuagaauucuuuggauuguacuccaaagaauugugccuuguguuugcagcaucuccauucucuaaaauuaauauaauugcuuuccuccacacccagccacuguaaagagguaacuuggguccucuuccauugcaguccugaugauccuaaccugcagcacggugguuuuacaauguuccagagcaggaacgccagguugacaagcuaugguaggauuaggaaaguuugcugaagaggaucuuugacgccacagugggacuagccaggaaugagggagaaaugcccuuucuggcaauuguuggagcuggauagguaaguuuuauaagggaguacauuuugacugagcacuuagggcaucaggaacagugcuacuuacugauggguagacugggagaggugguguaacuuaguucuugaugaucccacuuccuguuuccaucugcuugggauauaccagaguuuaccacaaguguuuugacgauauacuccugagcuuucacucugcugcuucucccaggccucuucuacuauggcaggagauguggcgugcuguugcaaaguuuucacgucauuguuuccuggcuaguucauuucauuaaguggcuacauccuaacauaugcauuuggucaagguugcagaagaggacugaagauugacugccaagcuaguuugggugaaguucacuccagcaagucucaggccacaauggggugguuugguuugguuuccuuuuaacuuucuuuuuguuauuugcuuuucuccuccaccugugugguauauuuuuuaagcagaauuuuauuuuuuaaaauaaaagguucuuuacaagaugauaccuuaauuacacucccgcaacacagccauuauuuuauugucuagcuccaguuaucuguauuuuauguaauguaauugacaggauggcugcugcagaaugcugguugacacagggauuauuauacugcuauuuuucccugaauuuuuuuccuuugaauuccaacuguggaccuuuuauaugugccuucacuuuagcuguuugccuuaaucucuacagccuugcucuccggggugguuaauaaaaugcaacacuuggcauuuuuauguuuuaagaaaaacaguauuuuauuuauaauaaaaucugaauauuuguaacccuuuauauuugguguggccugagugugguacuggggacauaagauguuuuaaaagguauaaugaaugaaaagccauacauaauaccuucuuugggugacuuauuuucuugagaacaauucaguauacauuuuauau

SEQ ID NO: 12898 - RNA, 6936 nt, Homo sapiens
ccaggcgcgggcccagugggccguaggggcgacauuguugccguugucuuucccccccagucccggggauggagaugucgggacucagcuuuucagagauggagggcugccguaaccuacuuggccuacuggacaacgacgagaucauggcccuaugcgacacugucaccaaccgccuggugcagccucaggaccgccaagguaagggcggacccuucaccuagaaggcugccgccccuuccccggccucacgccuaccccgcuuaggcagaauccucgggaauguuggccgcagccgcagauccacagcucuggaaccacuacgccgacuugggcugccgggucaaggcggggaggugguggcggugauaauggcacggcuuccagguuuuauccauugaauauuaugggcagcgcuuguugauucaaggauucggaauaagucauuuaaauuuuuaaaaauuuuaaaaaauuuucuggggagccagaauguuuugcauuuucaguuucgaucagcugaagagucagcugcugcucgggcuuuuuucuucaaguuugagugggaggaggauggcaaacauuuuguaugucucugguaaaaagcaacuacuguaauuaaauggcaggcaccuugaauccaugucuccuuuuggaggcaaaauuuuucugagaugauuuucguacuaggaauacacacaagcgagcuaaauacauauaccgguggauuuuuaagggguauuagugcuaagucugauugugacuaguccauauaaaaauguaaagcguuuguucauuuugugugucggguagcuaguuuuauuuuaaauuugcugaauuuuacuucaaaacgugaaaaauuccagauucccauauuaguauaugauuaucuuuaaaagauucugcccuuauaaaacuggguuuuucugcuuaagucggauuucauuuuuggcauugaagaaagucauuugucacuccgaaccauggacacuaaaagaggaaguuccaaagaauuaagaccgaaaauagcuuuagacuuauaugguucuucagcguuuauuuuacauggcuuucaccuucuuauaaucauggugagugugaauuuaaaauuauaauggauaaaaugcugcauuuaauuauaggguaucuaaaagcaaauaagaaaaaaauucccaguucaaaaacguuuaaaugacuugaagaaacauuccuggggcaggggguggggaaucacccuuaagcauaugaaaguauacucagcaucuuuggaaacuaaugaaaugaaaaccagaaacagaaguugucuuuucuguguaccagauuggaaaaaauauauauauauauauaaacuauaaacuucaaguguucaugaucaggugaagcaacucguugacaacuagugaaggaguuuaaguuaaaacugccacuuugaaaaaacaaauuugacaucuccuaaaauggcagauuagacacauacucgagaccuagucuucucaaacuugaauaugcuuuugaaucucucagggaucuuguuaaaaugcagguucugacucauuaguuuuaggggaggcccagaaauucugcuucuaacaagcuccagguugaugcucauacugcuugccccuuuuugagcacugggagauguguaugagaauguucaaaguaacagcguuuguaauuggacgcagaauagaagucuguaaacagaagaauaguuggauaccuugugugcagucauauaacuaauuaugauauagcagugaaaaugaguuagcuauguauaucaaauuaauccagaaaauauugaaugaaaagcugauuacagaaaacuauauacuguauauggauggauugaauuuauagcacaauuuaaaacauaccaaacuaaauauaguucagggauacauacuuaugcuguacaacuauaaaagaagggaaauuuuaaagcaacauuuaggauaguagcuacucugagguggaugcgaauaaagaggaauagcauuagggaagagacgaaaugggggccucaaagauaguaauuucuuauguccuaagcuaggggguaugcauaugggaguucguuuuauugccauucuguaugacucacacaugucagaaauauucuuuggucuuguauuuuaaaauacaagugggccaggugugguggcucacgccuguaaucccagcacuuugggaggccgaggcaagcggaucaucugaggucaggaguucaagaccagccuggccaacauggugaaaccccgucucuacuaaaaauagaaaaauuagcugggugugguggcacacaccuguaaccccuugggagacugagggaggagaaucccuugaacccaggagguggagguugcagucagcugagaucgcgccacugcacuccagccugggugacagagugagacucugucucaaaagaauaaaaauuaaaauauauaaagauacaagcccugguucugccacuuucuagaaauacaauaguugggccgggcuuggugacucacaccuguaaucccagcacuuugggaggccgaggcgggcggaucaugaggucaggagaucgagaccauccuggcuaacacggugaaacccugucuguacuaaaaaaauuagcugggcgucguggcaggcgccuguagucccagcuaccugggaggcugaggcaggagaauggcgugaaccugggaggcggagcuugcaguaaucccagaucgcaccccugugcuccagccugggcgacagagcaagacuccgucucaaaaaaaaaaaaaaaaaagaaauacaaucauugauaccuaauauggccucaacuuucauuaucuguagagugaggagauaugacuaaaauuccuugacaucuaaaauauuguuguaauugucccuauuuuuagagguugugcaugaauuuaggacuguuggccuuauuagaaaaaauauuuuuucucacuuaaauguuuucuuaaaauguaauucuuuaagaggaaaugcuaaacuuucacuaucacuuaugggaagugaacagaagagauuuuagguaagggaaguuuaaggcauaaagauguuaaaagaaaacugacaacggacuuccuauuuuuuaaaaaugaugacuaucauguaacagcaauaaugcugugacgagaguuuauaaacauauuugauagaguuucugcccaccuggcacaaauuuguaagugccucaugauuuuuuauuaaucuuugcaauuucuuucuagaugcuguucaugcaauauuagcauacagucaaagugcagaagaacuucugaggcguagaaaaguccaccgagaaguuauauuuaaguacuuggcaacacaggggauuguuauaccuccagcuacugaaaaacacaaucuuauucagcaugcaaaagauuacuggcaaaagcaaccacaacugaaauugaaggaaacgccagagccaguuacaaagacagaggacauccaccuauuucaacagguaaaauaaaucuuaugguuguauucugaaccuuuguucugucugaaacuuuguugauaauccuagauuguggggaacaugguuaauaauguuugugggguuuuuuuauuuuuauuuuuuaagagauucuugcucuguugcccaggcuggagugcagugguguaaucauagcucacugcagccuugaacuucuggacucaaguguucugcccaccucugucuccugaguagcuagggcuacaggcaugcaccaccaugccuggcuaauuuuuaaaauuuuuugguagggauagggucccaacuauguugcccaggcuggucuugaacuccugaccucaagugguccucccgccucagcuggaauuacaggcaugagccaccaugcccagccuauuuuuuuuauauuuuauaauuuuaacuuuauuucauauccuaucaauccugaaggaaggaagagaccaguaaagcaacuaagagcaaaaauauuucugacauauagugaugcauauauaaucaucuauugauaugugagaaaguauuuuucaauaucagcaucaucaaaugaggacuauuggauuuuuagagaguaaacugcaagguuaauuuuaacuuuagcuccguguaauuuuuuuucacuuuagaagaauuuuauugcaaauucuuucucacuuuuaagacguuuuugguauugcaaaaaugucaugaaaggaacuuaaaauuuuacuuuaaaaaaaauuuucuuuuaaguuccaggguacgugugcagguuuguuagauagguaaacaugugccauggugguuugcugcgccuaucaaccuaucaccuagguaugaagcccagcaugcguuagcuauuuuucuugaugcccccgcccccacauuggaaccuaaauauuuuuuauacuuuuuuuuuuuuaacuagaaaaaguccuauuguagaaauauucuccagcggacauuggcuguuucuguucuuuauauuaucuccacuguacauuuuagauacugcacaaauauuuaaguguugcuugaauuaaccucuauguaauuugcagauuuuuaaacuacauaccacauuuuuugaauuaaugagguuucacagugagaaagcuuugccuucacacuaggaaagaaucuuuaagagcuuucuuacuuuauguacugauaagagcauugacuuugaaaucauacaaauacgacuucaaauuagggucugcaauauacuagguguguuaaauuaggcaaauaaccagugccacgcacagugcccaguguauuaaauagcaggugcucaguaaaccuaagaucucauacaucucaguaaaguacuguguuguggaacacauggaugaaugagaucuaguguaucagguagauuuuuacaguaacuuuuuuuuuuuuuuuuugagacaaagucugcccugucacccaggcuggaguacaguuggcaugaucucagcucacugcagccuccacccucuggguucaagcacuucuccugccucagccucccaaguagcuggaauuacaggcaugcgccacuacacucagcuaauuuuuguguuuuuaguagagacgggguuucaccauguugucaagacuggucuugaacuccuaaccucaagugaucugccugccucagccucccaaagugccgggauuacaggcaugaaccaccacgcccagcuuacaguaacauuuucugugaaaaaagagaaauaauagaauaaaauuaaucccaguuauagaaaauaaccuguuucaaucaccguaagaguaucuauuuaaagacaaugaaaaugcuugcuuauauuaacuuuaugucauuuauaugcaaaaugcauccauuuaaagugaacguuuugaagguuuucacauauauaccugugauauacauauauaccugugaaaacacugccacaaucugaggaaacacuuacauaaaucaucauauaauuuauauauuuuuauauaugacuguucauacugauuuuuuuuuuuuuuucacacggagucucgcucuguugcgcgggcuggagugcagugaugcuaucuuggcucacugcaaccuccaccucccaaguucaagugauucuccugccucagccuccugaguagcugggaauacagguacacgccaccaugcccggcuaauuuuuguauuuuuaguagagacgggguuucacuauauuggccaggcuggucucaaacuccugaccucaccauccgccugccuccuccucccaaagugcugggauuacaggcgugagccaccacgcccgccaaguucauacugauuuuuaaauuggccuuacuaaaccuuacucucuuagcugaauuuucagcaauuuaagcuggaaauuucuaaaaugauuuuucuccucuugaaaaaagauuuuuacuaugcauaauggguucagcaaguucacauaugguucauuucucucugguguaauggguucauucaaacuuaauaggcuagauagaaaaauagauaugaaaguuaaaccuuaguguuauuuuguauuuauuuuauuuguuucaaucagcaggugaaagaagauaaaaaagcugaaaaaguugauuuucgucgccuaggagaagaauucugucauugguucuuuggacuucuuaauucucagaauccuuuucuaggaccaccucaagaugaauggggaccacagcacuucuggcaugaugugaagcuuagguuuuauuacaacacaucagaacaaaauguuauggacuaccauggagcagaaaucgugagccuucguuugcugucacuaguaaaagaagaauuucuuuuucucagccccaaccuagauucacauggacugaaaugugcaucuucuccucaugggcugguuaugguuggaguugcugggacuguccaucgaggaaacacuuguuugggcauuuuugaacaaauuuuuggacucauccgcugcccuuuuguggagaauacuuggaaaaucaaauuuaucaaccugaaaauuaugggagagaguucccuugcuccuggaacauuaccgaaaccaucuguuaaauuugaacaaagugaucuagaggccuuuuauaauguaaucacuguaugugguaccaaugaaguacgacauaauguaaagcaggcuucggauaguggaacuggggaccaaguuugagguaguggaaaugagacauugcugaacaaaagagaacuggguuuaccugacccucuaaagcgcuaaguacugucagccugaaaaaaaucuucuauacagaaacucuuccaaauacuauaucaguaaugucugaaugauuucagaugugaaaauugacauauuuuaguugaaauaccuuucuggacuacagacuuacauaucaugugaauacuuaccuauuucuacccgaguugcagcaaguauucugaaagcuuaaugcaaauaaaucccacuuuagaucuuaca

SEQ ID NO: 12899 - RNA, 12584 nt, Homo sapiens
uguauuaguuauucuuaacauucaaaagagaaaguucugcaucagagcccacccauguccagccauugugcccugagaucccaagacuguggggaugagggcagagcccauuaacaucagggauucuggucacuggggucacacuugagcaugauuuucaaccccaaucccuuuuuaaauguuucaaaggccuccagagcuuucuccagaggaaaccuaugggugacgagggguuuuacauucacagacuuggacgcaagcaucgaaaucgccacuggccaccuguaaaagagcacgagcauuauauucaaccuucaagaggaaagagccaggugccccaaacuaccaagcacuagaucagcuuggccguauuuauugauagcacugugguucugcaaagccaauuuuacaggccaacaacccaggaaaggaccuuauggcuuaugauucagggguacagagccuauuugcaauugcccccaccccucacccacccgcucacucugccacgucugccauggagccuagaauuccuguggcaugaagguacaaggcacaugguggaggccacugggaaaaggcagagaagccguggggaggcagcccgggacaauccagucacacccacuaacagcucagcuuacuggaaaacuggcgcccugaugagggcauggaguuacagccucuaaagccaggaguaagggacacugcuggggagaggggucccagccagagggccccagcaggggagaggguggagcugcagaacauggguggggcaaacuaagacccuuucgcuccccagggugggcccuagggcuaaggaacggaagccacaggacuugauuucuuccuuuuguccuccuuucucuccuucuucccuuuaaagggagaaaauggagaccuggcaacuuaagaaaauagggggaaaaaaggggccugggggggauaagcagcagacacucaguaagacuaugcuucaaaauccccuccuucccucccuccauccauccuucuguuccucccauucuuuaacuggcagugaguguucucucuuuggaucccuguuauaucacacagcuaucaguguggccagggagugccccccaugaacaaacaggcagagacucaugggcccagaggcugaguggggccugccauggucuugcuggaggcugggcaucccggcucacccacggcauacucacguguugcaguaucgaaacacgcccuugauauccaccucccggauggcugcaugcaguagggguacgguggucaucucagagcccagccccacaagcacgagguucccaccagagcgaguggccuguaaaggagguaaaaacaagaaagcucagaagauaagaaauacugacuucccacuuacaauaacauauugucaucacacaaguaucuucugguugcaucagcugagcauccaaaaauuccugagaaugugauuuguguacacugcugaacugcucaaccugccaaccaaacuuaacugagcgggagaguaaacacgguuuucuuuaaaguguauugugaaaacauacacuuaacccauggagaaccaggcacagugggaacaucuuccaaagcuuuacagauucgggacccaauauuggcuucagccaccuccacagucuaagcaccuguuccucccccagagcgccccuccacaggcagcacuuucaucagagcuggaaggaaccacuggcccucuaagcucaccgguggugagaaaacuauaaacaugagacagaugggccacuuguauucuguggcuuaaaaaaggcuucauacaugcaugcaggcuggcaguuagaaaucuuuuuguuccagagauguuuaccucaacaguaugagccauaauggguuuugucuuccuugaauguuuaucugccuuaucaguuccccacuuggagugggucacaggcagcagugaaauuucuccugaaaauuuccccagaacucccugugagugcugugcuuguuccagagcuuucuggggaucacugugcucagugcggugagagacagaagaauggauaauucaaucaugcugauuguucauuauagucagcagcaagcauuuauugggaccauucugggugcuaaacaguggaacuagagaaaggcacaugucacagccuccaguucugagacgaaggauacaccacgaucauagccuccacuucugagauggauacaccauggagacaggccuguggugccgugagcaagaggugaacucaggguuugaguggugugggagugacucccagcgcugcugcuucagagcuguggcacccuggacgugcccucucagcccauuuucuagggaaacuacuuccucaucagcacuuccucucuaccugguggugaggaggaacaccaacuggccauuccaagcugccaagaugccagcaguuugcugaccccaggucaaggaaugcuggaaccaccuggacacuauccuguagguauggcaucugcaccaaggauaugacaucaauucuaccccaaggcaucugccacgucucaucacaaacacuauccagucauaaccuggcaggauggcgaugcucagauuuguccauauuugguccagccaccuagccugcucauuggcgggguggccuauagcauucuacagcacccgucaugcgugacgucaggagagacacugcuucaggccuggugaggcccaugggucacauucaacuccaugccugccucagguagccuggcaaccaggcccccaccgucaacaguggaaaugccaacuguuccaaaugcucuaagggcagggcacaagaggaaggagagccauguccuuuaagucccccagcuuauacugccucucugcgggguggaggucacuuaccugcugacaacuugaagacagcagaugcaaccuacucaugucuuagcccucaaagugcccagcacaaagccuggcacaugguagguacccaagacauaccauggguagaucaaucacacacagauccauuguuccucucugagcuucggcuucuuuuugccccuucccacauggcgaccacugccuaugacagugaagcagagggcuggccgacuccagcugaaacucacgacacugccaagguggcacccgcuccucccucucccccacugcuuccucagcucccaaggccgcugggcaacuuaguaggaggaggucuaggcagcucugcuacucagcuuggugggucagccuucccuagaaugucucaugugaugcaaagugcccuccugcugugagccucagaaggaaggaggaagcccacgcuaccuggggaggcugucugggaggcagggacaggaguccccugugguggcggcugccugcuacccucuccagcccuggcccuguccccccacccuagcaugguuguucgugcccuccuucccuuccucuccuaagcagcggggcaacucaggcacuggggccuggcagggcugggccugggccugacuuggcuugccucaaacaaaccacaaaucccucagcauaaaaugguaacugguuuucagggcuauugugcagauuaggccucauguuuauaaaguacagcagagaaccuggcguacaguagggcuuggaaccuggaaguuguuauuuucccuucguuuccucauacuuugaucugucaaugacacucccucccaccaccuccaacuuccugccaacuucccauaaguggcuggugggucgcugaggggcgagucgggcacuggcagcuuaucuguuccuaggucugggagacaaaacaagcaguagucagcugugacccuggaaaaucaccucaccuucaugacuaacuaaaugacuguuauuuuauauaagugacuaaagacugcaguuuuccucaauaaaauaagacggggauuucccacauacaauuaaggcaugguucccuguuuuucuucuuggucuuuuuaccaaaacuacugcacuuuuaacaaauaugaucaugaagccaaccccauccccaaaguguguguccuuaacauuuuucaaggcccguguauagcuguuaucuugugugaaccucagauggcccaauaaggauguaaggcaaguucaaguacagucuccgcacuagagauaagaaaacagagauagcgccuguaaucccagcacuuugagaggccgaggagggcggaucaugaggucaggagauggcgaccauccuggcuaacacggugaaaccccaucucuucuaaaaaaaauacaaaaaacuuagcugggcaugguggcaggcgcccguagucccagcuacucgggacgcugaggcaggaaaauggcgugaacccaggaggcggagcuugcaguuagcugagaucgagccacggcacuccagccugggcgacugagugagacucugucucaaaaaaaaaaaaaaaaaaaaaaaaaaaaaagaaaaagaaaacauagauggcaaaagaugaauaaguuuggcuuggggcucacgcagcaagcugguaaagaaguuugacucccuacuucugccuccuucacuccccuaugcugauuccccaaagcugcccucagcccacucacguagaugcccgccuggauggaggccucugcccccgugcacucgauggugacuuccggcuugcaccccagcugaccuucuacuuuccuggcgauuuccugagggcucuccuuggagaucuggaggacuaaaucagccccaaucuccuuggcuuuggacaaucggguagcagacagaucugaagguaaaaaaaaaaaaaaaaaaaauucuuucaaacaagagaaaucugaugacucauuaggaagaaaagaaaauggagauguaagaucugauggcaacaaagcucucgugcaauggguggugguguugagcccaacacacauacucuucacaccaagcuuguccaaccugcagcccacaugcagcccaggauggcuuugaauauggcccaacacaaaucuguaaacucucuaaaaauauuaugaaauuaaaaaacaguuuuguaaaguucaucagcuaucauuaguguuaggguauuuuauguggggcccaagaccauucuuccaauguggcccaaggaagccaaaagauuggacaccccugcucuacacccucauauacccccauauccaccauacagcuacacacagacacacacacacacacucucucacacaaacucucucucucucugauagcuucuccuaacacaaaacacacacucacacucuucuauauuuccacaauccauaugacacuacacacucacccccuccacacugucacagauaaccucuccucacacaugcacauacaguaggacccgcuguuucccagucaaggagauugauaaagaacaaagucuuaccagucaccacuacuugagcugcucccauugcuuuggccacgagcaaagugaccaucccgauuggcccuaaacaaagcagaagauggaauauguucgugaaauauuaaacaucugcucucccacuuguccaggccauggauaggaaccauaucuuuugugugucucuagcaucuaucccagugccuggcaugauaagaccuuagcggcuguuuguugaaugcagaagugaauaaauccaugaagaauuauucucuacauaaaauacgcuccuagugcuggguucuauuuaauccucucaaaccucagagcuaaaauuuuccuacuuacuccugggcacuaguggagauaaucucaaagaaccacaggauucaaggaaacacaaacuuauucagaaaauaagaaaucucagaaggucuggacuuguuuuccuggucuuucuuugccccuaccuuugugagaacccaucacaccucccccagagagagacauauuccuuuuaggugcccucugaggaccaccuggagaggguucuuaagugagcuggcucccuggguuggcccuggugcccagauagccccaggauacucagguauccaaggauuugccugagacaccugcuuccccaugguaucugcaugcuaugugacacuaugguuuuaauauaaaaaucagacccacggaaugaaagcaaugcagacuaucuuuggggguuuacuuuuuguacacaaccccgagaacaauuuugugagcucccucagaaaacaaaauacugaaaaauaauaccugaaauguccaacaaagcaugauuuaaaaacuacauggcuacuaaaaauuacgccauaacucuuuaucuauugacauggaaaaauguucacaguauuuuuuuugagacagagucucgcucugucacccaggcuggagugcaguggugcaaucagcucacugcaaccuccgccucccggguucaagcaauucucucaccucagccuccuaaguaguggagauuacaggcacccaccaccacgccuggcuaauuuuuguauuuuuaguagagacgggguuucaccauguuggccaggcuggucucaaacuccugacuucaggugauccgacugcuucagccucccaaagugcuaggauuacaggcaugagccaccaugcccagccugauuuuuaaaaaagaguagguaaaggaagcguauuuagcauggucucagaaaaaaacuaacuaacuaaaagauucuauacccaaauauuaacagugguucucuugggcuaaucggugacgggauugcaggugaauuucuguguguguguguugggggcaaggcaugcaugugugugguaugugugacuuauuuuccuuuucuaugguaaaaagguacuggauccaugcagauuuuuauaagaaucugucaccugagucccgcagucugcuagcccauuguggcaagucuauucuacauccaucaccccucuuaggaagccgugugaucacuuauuuggccagccaaagaaaaucacaaacaaguaugaggaacaccagaucacacccacaaggagcgugagcguacugucugggucaccagaaugauuuggucuaaggcugcuagggccuguuccagauggcuugaaacaggggaugagagaaggcagcuagcuacagcccuacugcaggcagauugcuggcucacaguggugugggagcagaccacugcucacuccucccacuggccgggagcagggucuaccuuauucauagaugggacuaggccaucacuuugcugguauaauuugaaaguuccaagaguugcccuucccuuuacuaucaaaaauauuucucuaagguggagguugcagugagccaagaucgcgcugcuguacuccagccugggcaacagaguaagacucugucucaaaagaaaaaaaaaaauuucccuaguuucccaucaaggguucaaaaauaaucgccagauuaauuccuuuuuuuuuuuuuuuuuuugagacagaaucucgcucugucaccuaggcuggagugcaguggcacaaucuuggcucacugcaaccucugcuucccagguucaagugauucuccugucucagccuuccaaguagcugggacuacagggggugcaccaccacgccuggcuaauuuuuguauuuuuaguaaaguugagguuucaucauguuggccaggcuggucuugaacuuuuggccucaagugaucuacccgucucagccuuccaaagugcugagaugagcuaccccgccuggcccagauucauucuuuuuguuuguuuguuuugagauggggucuuguuuuuuuugagacagggucuuguucugucacccagacuggaguucaguggcacaaucauggcucgcugcacccuugaccucccaggcucaagugauccucccaccucagccuucugaguagcuggaacuacagacacacacuaccacaccugcuaauuuuuguauuuuuuuguagagacgggguuucaccauguugcccagacuggucucaagcuccugggcucaggugauccaccggcuuugguuucccaaagugcugggauuauaggcaggagccacugugcccagccaauucauucuuuaaaugaacaaaaagggcuauguugccuaggacauauaacccuaguuaauaucaugucugcagauacucauuuguuuagcaaagugcuagucacugagggaaugggacacugcaauccucccuuacccagaaggauucuagaacaaaucucaagccuuggagggggaaugagaugggcagaggguucccugaauucccagucaaugaacccgcaacaggguggcuucuguuucuuaccagcuccacacacaaggaccuugugucccaggguaacuccgccucuccugcaggcauggauccccacagaaaguggcucgaucagggcgccuuccucaaaggugacauugucaggaagccugaggagucaauugacacacagagauccucugaguuaacuacaaugcuaacaauaguauuauauaugcccaaugucacuguaauaacaaccauagcuagcauuuaucgagcauuuauuuaugugcagagcaaugugcuaagcaauuuauauacauuaacucacguaaaucccuggaauaguucugugguagguacuaucauucccauuuuacagaugaggaaacaggcgugguggguuaaaugacuugccccaaccauccaaagcuagugaggggcccaaaggguucaaauuagaagacagauauguucucaucacagaacccaugccacaauguccccaucugaagaaggcaacaugguuuucuuuggauaaaucaauucagugaaaugaacacauuauguuuucuuuaaugugcuauccaagcuacgguauggugguuaucauuaauaaaugaaaaguuuauuuaacaaggaguuaacauggccacguuccagcaucucaucugcuucucaaacuuacagccuuuuuaguuucacuuuagcaaacaauccugacuaucaccaguuuuguagaacagugauuuagcaaugggcaucacucugauagucgccucccauauuauacauuccagaagaaccacaucugaggacaguggcugcccugcugacccaggaccagucaagaagaaaaaaggaccuguuccacaaagcugauuaaaugcagugucaccuucacucuggguucuagguuuucacuuccacugguaucuugacccuaucaauaauacagcugaugacgauagcaaauauuugcauaaagcuuuacagauuaggaagcacgcucauccauuaucucauuuaauccucaugaaaaccauguuaggcagguagggcaggcuuuuuuagaaaacccuuaguuuacagaagaggaaacugaaacucacugacauuaagagaauugccaagguuaugaagcuagggaaugaaggccagacuuaaccaagguguccugauuccacauccucugccugucccauaucagcuccauccugguaugagcagcuguguagcuaauauuaauauccaauuucugcuaguuccucacugcccaggauuuacccagcaccccaaaucugcacacacaggaacaggaaaacccucaaguuccaaaaagaaauaaaugugacagccaaaccaugugcucauccccaugauccuuucaacacugucuccaaucuucaacagaauaacucggaguccuccugucacugucccugauccuugacagaacuacucaccaggccaauggaggcccagcugccacccaccacccccuuaucccuuccccucggcuucuuucccaucacuuccccuacuccaauccacucuccugcucugacugcggucacacuccuucuacucccccuagaaguaucccuucuauauaauaggaaaaaggugaaaaugaaaucgugaagauuccuaaacucucucagggacuccacagguuccuagacacgccugcccuuccacaucugggccuccugaggaacuuauaagggcucuaugcagaggguggcuugcguggaaacuacaucgaggagagaugggauuggggaaggugaugagggaagauuguuaucaggaagaauacucuacugauuaagcagaugcugccucauccgccugcacccaacacagccaaccguguuggaaagccaccugguguggaggcagaagcauguacaaggaguccuggaggccagccccgcugccacugaccuugggaaaaccacugacuccacccuccccaaucuuguccaguggggguugauggagaacgaggaugagaagacuccaaguuucuucccagccccaaccuuucaugcuuuauaaacaccagagagugaugaggcaacuugguaguuuuuacaaugggguucagggaacaguccaaauuggguaacagaugaucaagaagccaaggagaagcaggaaaauagaaagaaaauagauacaaaaauaaagaggcugugguaguaugggaauccuaaaaagacaucagagaggagggcuugggucuagggaagaacuggggacacaggcagaaagcccccugggaggagaagaaaggcagggcuguaggacuccccagagaccuuccucagcacccccacugccacugccacugccagccagagccccaucauucccuauaaaccaccagcacaaggcucucuuucaggccuacuccugcaccuccaugcccagaccacuaggccaugacuauggcauagcuugguaccauuuacugagcauuuacuaugugccagaccucaugcuggagacuugauaugcuuuucucauuggaucucaucaguaauucugugagggagguaccaucacuauuucuauuuuacaggcgaggauauugagguuacaaaauuuaagugacuugcccaaggucacacaguuguaauuggcagagaccagugggcuucaccacuaugcucuucugccuuccaugaaacuuucguuuggugucuugacuuggaaagggcccgagaaagaugggcccauucaggaaccacuugcugaaagguguacucugcacauguaaccugcuuacuucuagagcagguucagguguugacuuaaacccaucacaaggucucuggccugugacuccucucaaggcucccagugggcccuagaaaaacucagaucugucagacugcuccugugacuggcaccuggccuccaccggacaagccccauccuggcugaaaaccaccacuggggccaggcugcggugggggaagaaugcaucuggguugggucagggggaaagcggcacuucggcacccuagagcuccacggcuggggccauggggggccacgcagaaagggaggcacuuugcuuccuccagacucaacuucacaauuucaggggugagaaucggaguaggguaggggagugggcacagggcaggagcuugagacucacagagaccccaguuugacucuugguugugcucugugcccaagucaaugagcuuccuucugccuugguuaacccaauaacggugcccaccucagcauuauucuuguggagauuaaauaaauugaagcaugcaaaccacuuauuagcacaagggcaggcacauaguaauaauaauuaugacucuccaugcaucaccuuauuuaauauuuuggcgauuaaaugaaacugaaucagagaaaagugaaauaauuucuccaaaaucacuugccaggagggaguagauccaggaucccagagcucaagcccuggcagcacaccacaccucaggaaaugucagccguugcugucaugguguguuguugcuauugucgaggucauuguuguuguuuuucuuuuugagacggagucucggucuguugcccaggcuggagugcaguggcgccaucucggcucacugcaaccuccaccucccguguucaagccauucuccugccucagccucccaaguagcugggacuacaggugccugccaccaggccuggcuaauuuuuuguauuuuuuuaguagagaugggguuucaccguguuagccaggaaggucucgaucuccuaaucucaugauccacuggccuuggccuccuaaagugcugggauuacaggcaugagccaccacaccuggccgaggucauuguuguuaugacguuucuggugguugcaguggaaacuaauaacagaggaugaaccacaggaauucccuccaggaugucugcagagggugagugauuucagcaauaauuuucuauuguugcucuaaguaagggaaacugaaacugaaagacuaaaaccaaccacugugagucagucuuauuccuagggaggcuacccucucucaaugccaccaagaagaguagccuguccaggugaugccucauguuuggaauuaugagcugaaaagaauaaagaaauaaccacaggaaacagcaccaagcuaaugaagggaaagaggucccaggugacccagugggacuguggacacuaacuuguaacaaaaggcugcauugugcuuauagaaccggcagagguucccgucaucggggggcguggcacagaagaagauggaaggugacagauuguaucggcccaucuugcagaauucaucauuuucucggggagcaccaggcucgauggcaacacgaucaccugg

SEQ ID NO: 12900 - RNA, 12584 nt, Homo sapiens
ccaggugaucguguugccaucgagccuggugcuccccgagaaaaugaugaauucugcaagaugggccgauacaaucugucaccuuccaucuucuucugugccacgccccccgaugacgggaaccucugccgguucuauaagcacaaugcagccuuuuguuacaaguuaguguccacagucccacugggucaccugggaccucuuucccuucauuagcuuggugcuguuuccugugguuauuucuuuauucuuuucagcucauaauuccaaacaugaggcaucaccuggacaggcuacucuucuugguggcauugagagaggguagccucccuaggaauaagacugacucacagugguugguuuuagucuuucaguuucaguuucccuuacuuagagcaacaauagaaaauuauugcugaaaucacucacccucugcagacauccuggagggaauuccugugguucauccucuguuauuaguuuccacugcaaccaccagaaacgucauaacaacaaugaccucggccaggugugguggcucaugccuguaaucccagcacuuuaggaggccaaggccaguggaucaugagauuaggagaucgagaccuuccuggcuaacacggugaaaccccaucucuacuaaaaaaauacaaaaaauuagccaggccugguggcaggcaccuguagucccagcuacuugggaggcugaggcaggagaauggcuugaacacgggagguggagguugcagugagccgagauggcgccacugcacuccagccugggcaacagaccgagacuccgucucaaaaagaaaaacaacaacaaugaccucgacaauagcaacaacacaccaugacagcaacggcugacauuuccugagguguggugugcugccagggcuugagcucugggauccuggaucuacucccuccuggcaagugauuuuggagaaauuauuucacuuuucucugauucaguuucauuuaaucgccaaaauauuaaauaaggugaugcauggagagucauaauuauuauuacuaugugccugcccuugugcuaauaagugguuugcaugcuucaauuuauuuaaucuccacaagaauaaugcugaggugggcaccguuauuggguuaaccaaggcagaaggaagcucauugacuugggcacagagcacaaccaagagucaaacuggggucucugugagucucaagcuccugcccugugcccacuccccuacccuacuccgauucucaccccugaaauugugaaguugagucuggaggaagcaaagugccucccuuucugcguggccccccauggccccagccguggagcucuagggugccgaagugccgcuuucccccugacccaacccagaugcauucuucccccaccgcagccuggccccaguggugguuuucagccaggauggggcuuguccgguggaggccaggugccagucacaggagcagucugacagaucugaguuuuucuagggcccacugggagccuugagaggagucacaggccagagaccuugugauggguuuaagucaacaccugaaccugcucuagaaguaagcagguuacaugugcagaguacaccuuucagcaagugguuccugaaugggcccaucuuucucgggcccuuuccaagucaagacaccaaacgaaaguuucauggaaggcagaagagcauaguggugaagcccacuggucucugccaauuacaacugugugaccuugggcaagucacuuaaauuuuguaaccucaauauccucgccuguaaaauagaaauagugaugguaccucccucacagaauuacugaugagauccaaugagaaaagcauaucaagucuccagcaugaggucuggcacauaguaaaugcucaguaaaugguaccaagcuaugccauagucauggccuaguggucugggcauggaggugcaggaguaggccugaaagagagccuugugcuggugguuuauagggaaugauggggcucuggcuggcaguggcaguggcagugggggugcugaggaaggucucuggggaguccuacagcccugccuuucuucuccucccagggggcuuucugccuguguccccaguucuucccuagacccaagcccuccucucugaugucuuuuuaggauucccauacuaccacagccucuuuauuuuuguaucuauuuucuuucuauuuuccugcuucuccuuggcuucuugaucaucuguuacccaauuuggacuguucccugaaccccauuguaaaaacuaccaaguugccucaucacucucugguguuuauaaagcaugaaagguuggggcugggaagaaacuuggagucuucucauccucguucuccaucaacccccacuggacaagauuggggaggguggagucagugguuuucccaaggucaguggcagcggggcuggccuccaggacuccuuguacaugcuucugccuccacaccagguggcuuuccaacacgguuggcuguguugggugcaggcggaugaggcagcaucugcuuaaucaguagaguauucuuccugauaacaaucuucccucaucaccuuccccaaucccaucucuccucgauguaguuuccacgcaagccacccucugcauagagcccuuauaaguuccucaggaggcccagauguggaagggcaggcgugucuaggaaccuguggagucccugagagaguuuaggaaucuucacgauuucauuuucaccuuuuuccuauuauauagaagggauacuucuagggggaguagaaggagugugaccgcagucagagcaggagaguggauuggaguaggggaagugaugggaaagaagccgaggggaagggauaagggggugguggguggcagcugggccuccauuggccuggugaguaguucugucaaggaucagggacagugacaggaggacuccgaguuauucuguugaagauuggagacaguguugaaaggaucauggggaugagcacaugguuuggcugucacauuuauuucuuuuuggaacuugaggguuuuccuguuccugugugugcagauuuggggugcuggguaaauccugggcagugaggaacuagcagaaauuggauauuaauauuagcuacacagcugcucauaccaggauggagcugauaugggacaggcagaggauguggaaucaggacaccuugguuaagucuggccuucauucccuagcuucauaaccuuggcaauucucuuaaugucagugaguuucaguuuccucuucuguaaacuaaggguuuucuaaaaaagccugcccuaccugccuaacaugguuuucaugaggauuaaaugagauaauggaugagcgugcuuccuaaucuguaaagcuuuaugcaaauauuugcuaucgucaucagcuguauuauugauagggucaagauaccaguggaagugaaaaccuagaacccagagugaaggugacacugcauuuaaucagcuuuguggaacagguccuuuuuucuucuugacugguccugggucagcagggcagccacuguccucagaugugguucuucuggaauguauaauaugggaggcgacuaucagagugaugcccauugcuaaaucacuguucuacaaaacuggugauagucaggauuguuugcuaaagugaaacuaaaaaggcuguaaguuugagaagcagaugagaugcuggaacguggccauguuaacuccuuguuaaauaaacuuuucauuuauuaaugauaaccaccauaccguagcuuggauagcacauuaaagaaaacauaauguguucauuucacugaauugauuuauccaaagaaaaccauguugccuucuucagauggggacauuguggcauggguucugugaugagaacauaucugucuucuaauuugaacccuuugggccccucacuagcuuuggaugguuggggcaagucauuuaacccaccacgccuguuuccucaucuguaaaaugggaaugauaguaccuaccacagaacuauuccagggauuuacgugaguuaauguauauaaauugcuuagcacauugcucugcacauaaauaaaugcucgauaaaugcuagcuaugguuguuauuacagugacauugggcauauauaauacuauuguuagcauuguaguuaacucagaggaucucugugugucaauugacuccucaggcuuccugacaaugucaccuuugaggaaggcgcccugaucgagccacuuucuguggggauccaugccugcaggagaggcggaguuacccugggacacaagguccuuguguguggagcugguaagaaacagaagccacccuguugcggguucauugacugggaauucagggaacccucugcccaucucauucccccuccaaggcuugagauuuguucuagaauccuucuggguaagggaggauugcagugucccauucccucagugacuagcacuuugcuaaacaaaugaguaucugcagacaugauauuaacuaggguuauauguccuaggcaacauagcccuuuuuguucauuuaaagaaugaauuggcugggcacaguggcuccugccuauaaucccagcacuuugggaaaccaaagccgguggaucaccugagcccaggagcuugagaccagucugggcaacauggugaaaccccgucucuacaaaaaaauacaaaaauuagcaggugugguagugugugucuguaguuccagcuacucagaaggcugaggugggaggaucacuugagccugggaggucaagggugcagcgagccaugauugugccacugaacuccagucugggugacagaacaagacccugucucaaaaaaaacaagaccccaucucaaaacaaacaaacaaaaagaaugaaucugggccaggcgggguagcucaucucagcacuuuggaaggcugagacggguagaucacuugaggccaaaaguucaagaccagccuggccaacaugaugaaaccucaacuuuacuaaaaauacaaaaauuagccaggcgugguggugcacccccuguagucccagcuacuuggaaggcugagacaggagaaucacuugaaccugggaagcagagguugcagugagccaagauugugccacugcacuccagccuaggugacagagcgagauucugucucaaaaaaaaaaaaaaaaaaaggaauuaaucuggcgauuauuuuugaacccuugaugggaaacuagggaaauuuuuuuuuuucuuuugagacagagucuuacucuguugcccaggcuggaguacagcagcgcgaucuuggcucacugcaaccuccaccuuagagaaauauuuuugauaguaaagggaagggcaacucuuggaacuuucaaauuauaccagcaaagugauggccuagucccaucuaugaauaagguagacccugcucccggccagugggaggagugagcaguggucugcucccacaccacugugagccagcaaucugccugcaguagggcuguagcuagcugccuucucucauccccuguuucaagccaucuggaacaggcccuagcagccuuagaccaaaucauucuggugacccagacaguacgcucacgcuccuugugggugugaucugguguuccucauacuuguuugugauuuucuuuggcuggccaaauaagugaucacacggcuuccuaagaggggugauggauguagaauagacuugccacaaugggcuagcagacugcgggacucaggugacagauucuuauaaaaaucugcauggauccaguaccuuuuuaccauagaaaaggaaaauaagucacacauaccacacacaugcaugccuugcccccaacacacacacacagaaauucaccugcaaucccgucaccgauuagcccaagagaaccacuguuaauauuuggguauagaaucuuuuaguuaguuaguuuuuuucugagaccaugcuaaauacgcuuccuuuaccuacucuuuuuuaaaaaucaggcugggcaugguggcucaugccuguaauccuagcacuuugggaggcugaagcagucggaucaccugaagucaggaguuugagaccagccuggccaacauggugaaaccccgucucuacuaaaaauacaaaaauuagccaggcgugguggugggugccuguaaucuccacuacuuaggaggcugaggugagagaauugcuugaacccgggaggcggagguugcagugagcugauugcaccacugcacuccagccugggugacagagcgagacucugucucaaaaaaaauacugugaacauuuuuccaugucaauagauaaagaguuauggcguaauuuuuaguagccauguaguuuuuaaaucaugcuuuguuggacauuucagguauuauuuuucaguauuuuguuuucugagggagcucacaaaauuguucucgggguuguguacaaaaaguaaacccccaaagauagucugcauugcuuucauuccgugggucugauuuuuauauuaaaaccauagugucacauagcaugcagauaccauggggaagcaggugucucaggcaaauccuuggauaccugaguauccuggggcuaucugggcaccagggccaacccagggagccagcucacuuaagaacccucuccaggugguccucagagggcaccuaaaaggaauaugucucucucugggggaggugugauggguucucacaaagguaggggcaaagaaagaccaggaaaacaaguccagaccuucugagauuucuuauuuucugaauaaguuuguguuuccuugaauccugugguucuuugagauuaucuccacuagugcccaggaguaaguaggaaaauuuuagcucugagguuugagaggauuaaauagaacccagcacuaggagcguauuuuauguagagaauaauucuucauggauuuauucacuucugcauucaacaaacagccgcuaaggucuuaucaugccaggcacugggauagaugcuagagacacacaaaagauaugguuccuauccauggccuggacaagugggagagcagauguuuaauauuucacgaacauauuccaucuucugcuuuguuuagggccaaucgggauggucacuuugcucguggccaaagcaaugggagcagcucaaguaguggugacugguaagacuuuguucuuuaucaaucuccuugacugggaaacagcggguccuacuguaugugcaugugugaggagagguuaucugugacaguguggagggggugaguguguagugucauauggauuguggaaauauagaagagugugaguguguguuuuguguuaggagaagcuaucagagagagagagaguuugugugagagagugugugugugugugucuguguguagcuguaugguggauauggggguauaugaggguguagagcagggguguccaaucuuuuggcuuccuugggccacauuggaagaauggucuugggccccacauaaaauacccuaacacuaaugauagcugaugaacuuuacaaaacuguuuuuuaauuucauaauauuuuuagagaguuuacagauuuguguugggccauauucaaagccauccugggcugcaugugggcugcagguuggacaagcuuggugugaagaguauguguguugggcucaacaccaccacccauugcacgagagcuuuguugccaucagaucuuacaucuccauuuucuuuucuuccuaaugagucaucagauuucucuuguuugaaagaauuuuuuuuuuuuuuuuuuuuaccuucagaucugucugcuacccgauuguccaaagccaaggagauuggggcugauuuaguccuccagaucuccaaggagagcccucaggaaaucgccaggaaaguagaaggucagcuggggugcaagccggaagucaccaucgagugcacgggggcagaggccuccauccaggcgggcaucuacgugagugggcugagggcagcuuuggggaaucagcauaggggagugaaggaggcagaaguagggagucaaacuucuuuaccagcuugcugcgugagccccaagccaaacuuauucaucuuuugccaucuauguuuucuuuuucuuuuuuuuuuuuuuuuuuuuuuuuuuuuuugagacagagucucacucagucgcccaggcuggagugccguggcucgaucucagcuaacugcaagcuccgccuccuggguucacgccauuuuccugccucagcgucccgaguagcugggacuacgggcgccugccaccaugcccagcuaaguuuuuuguauuuuuuuuagaagagaugggguuucaccguguuagccaggauggucgccaucuccugaccucaugauccgcccuccucggccucucaaagugcugggauuacaggcgcuaucucuguuuucuuaucucuagugcggagacuguacuugaacuugccuuacauccuuauugggccaucugagguucacacaagauaacagcuauacacgggccuugaaaaauguuaaggacacacacuuuggggaugggguuggcuucaugaucauauuuguuaaaagugcaguaguuuugguaaaaagaccaagaagaaaaacagggaaccaugccuuaauuguaugugggaaauccccgucuuauuuuauugaggaaaacugcagucuuuagucacuuauauaaaauaacagucauuuaguuagucaugaaggugaggugauuuuccagggucacagcugacuacugcuuguuuugucucccagaccuaggaacagauaagcugccagugcccgacucgccccucagcgacccaccagccacuuaugggaaguuggcaggaaguuggagguggugggagggagugucauugacagaucaaaguaugaggaaacgaagggaaaauaacaacuuccagguuccaagcccuacuguacgccagguucucugcuguacuuuauaaacaugaggccuaaucugcacaauagcccugaaaaccaguuaccauuuuaugcugagggauuugugguuuguuugaggcaagccaagucaggcccaggcccagcccugccaggccccagugccugaguugccccgcugcuuaggagaggaagggaaggagggcacgaacaaccaugcuaggguggggggacagggccagggcuggagaggguagcaggcagccgccaccacaggggacuccugucccugccucccagacagccuccccagguagcgugggcuuccuccuuccuucugaggcucacagcaggagggcacuuugcaucacaugagacauucuagggaaggcugacccaccaagcugaguagcagagcugccuagaccuccuccuacuaaguugcccagcggccuugggagcugaggaagcagugggggagagggaggagcgggugccaccuuggcagugucgugaguuucagcuggagucggccagcccucugcuucacugucauaggcaguggucgccaugugggaaggggcaaaaagaagccgaagcucagagaggaacaauggaucugugugugauugaucuacccaugguaugucuuggguaccuaccaugugccaggcuuugugcugggcacuuugagggcuaagacaugaguagguugcaucugcugucuucaaguugucagcagguaagugaccuccaccccgcagagaggcaguauaagcugggggacuuaaaggacauggcucuccuuccucuugugcccugcccuuagagcauuuggaacaguuggcauuuccacuguugacggugggggccugguugccaggcuaccugaggcaggcauggaguugaaugugacccaugggccucaccaggccugaagcagugucucuccugacgucacgcaugacgggugcuguagaaugcuauaggccaccccgccaaugagcaggcuagguggcuggaccaaauauggacaaaucugagcaucgccauccugccagguuaugacuggauaguguuugugaugagacguggcagaugccuugggguagaauugaugucauauccuuggugcagaugccauaccuacaggauaguguccaggugguuccagcauuccuugaccuggggucagcaaacugcuggcaucuuggcagcuuggaauggccaguugguguuccuccucaccaccagguagagaggaagugcugaugaggaaguaguuucccuagaaaaugggcugagagggcacguccagggugccacagcucugaagcagcagcgcugggagucacucccacaccacucaaacccugaguucaccucuugcucacggcaccacaggccugucuccaugguguauccaucucagaaguggaggcuaugaucgugguguauccuucgucucagaacuggaggcugugacaugugccuuucucuaguuccacuguuuagcacccagaauggucccaauaaaugcuugcugcugacuauaaugaacaaucagcaugauugaauuauccauucuucugucucucaccgcacugagcacagugauccccagaaagcucuggaacaagcacagcacucacagggaguucuggggaaauuuucaggagaaauuucacugcugccugugacccacuccaaguggggaacugauaaggcagauaaacauucaaggaagacaaaacccauuauggcucauacuguugagguaaacaucucuggaacaaaaagauuucuaacugccagccugcaugcauguaugaagccuuuuuuaagccacagaauacaaguggcccaucugucucauguuuauaguuuucucaccaccggugagcuuagagggccagugguuccuuccagcucugaugaaagugcugccuguggaggggcgcucugggggaggaacaggugcuuagacuguggagguggcugaagccaauauugggucccgaaucuguaaagcuuuggaagauguucccacugugccugguucuccauggguuaaguguauguuuucacaauacacuuuaaagaaaaccguguuuacucucccgcucaguuaaguuugguuggcagguugagcaguucagcaguguacacaaaucacauucucaggaauuuuuggaugcucagcugaugcaaccagaagauacuugugugaugacaauauguuauuguaagugggaagucaguauuucuuaucuucugagcuuucuuguuuuuaccuccuuuacaggccacucgcucuggugggaaccucgugcuuguggggcugggcucugagaugaccaccguaccccuacugcaugcagccauccgggagguggauaucaagggcguguuucgauacugcaacacgugaguaugccgugggugagccgggaugcccagccuccagcaagaccauggcaggccccacucagccucugggcccaugagucucugccuguuuguucauggggggcacucccuggccacacugauagcugugugauauaacagggauccaaagagagaacacucacugccaguuaaagaaugggaggaacagaaggauggauggagggagggaaggaggggauuuugaagcauagucuuacugagugucugcugcuuaucccccccaggccccuuuuuucccccuauuuucuuaaguugccaggucuccauuuucucccuuuaaagggaagaaggagagaaaggaggacaaaaggaagaaaucaaguccuguggcuuccguuccuuagcccuagggcccacccuggggagcgaaagggucuuaguuugccccacccauguucugcagcuccacccucuccccugcuggggcccucuggcugggaccccucuccccagcagugucccuuacuccuggcuuuagaggcuguaacuccaugcccucaucagggcgccaguuuuccaguaagcugagcuguuagugggugugacuggauugucccgggcugccuccccacggcuucucugccuuuucccaguggccuccaccaugugccuuguaccuucaugccacaggaauucuaggcuccauggcagacguggcagagugagcgggugggugaggggugggggcaauugcaaauaggcucuguaccccugaaucauaagccauaagguccuuuccuggguuguuggccuguaaaauuggcuuugcagaaccacagugcuaucaauaaauacggccaagcugaucuagugcuugguaguuuggggcaccuggcucuuuccucuugaagguugaauauaaugcucgugcucuuuuacagguggccaguggcgauuucgaugcuugcguccaagucugugaauguaaaaccccucgucacccauagguuuccucuggagaaagcucuggaggccuuugaaacauuuaaaaagggauugggguugaaaaucaugcucaagugugaccccagugaccagaaucccugauguuaaugggcucugcccucauccccacagucuugggaucucagggcacaauggcuggacaugggugggcucugaugcagaacuuucucuuuugaauguuaagaauaacuaauaca

SEQ ID NO: 12901 - RNA, 2461 nt, Homo sapiens
ccucaaagguuuuuuuuaaaagaggcuugcaaccccguccagguaacagaaugaaacugccgacugcauuucaguggguaguuuacuuucagauuuuuuuugguaguagcaaaggaugagacauucacacuucccucuaguucaucuuguaacaaguuguguguuuccucagggugguugacuuggauuagguuagagaacaaauaauuugaccaaauuauuaaauagcaacauagcucaccaguagacccaggggauagagacaccugugccccaaauauauuacuacaacuuccuaaauguggcuucguaauauuacuaugacucuauuuuuuuuuuaugagacguauuuuuggucuugucgcccaggcuggaguguaguggcgugaucucggcucacugcaaccucugacccccagguucaagcaauucucccaccucagcuucccaaguagcuggaauuacaagcaugcaccaccacacccagcuaauucuuuguauuuaguagagaugacguuuugccauguuggccaggcuggucucgaacuccugaccucagaugauccaccugccucugccucccaaagugcugggauuacaggcaugagacacugcguccagcccuaugacucuugaauaugaagcauggcuugccucugaggacacuuuugugucuaagagaauggggucuuuuuuuuucuuuuuuugagacggagucucgcucugucgcccagauuggagugcaauggcaugaucucagcucacugcaaccucugccucccggguucaagcgauucuccugccucccugccaaguagcugggauuauagacaugugccaccaugcccagcuaauuuuuuuuguauuuuuaguagagaugggauuuuacaauuuuggccaggcuggucucgaacucaugaccucaggugauccacccaccucggccucccaaagugcugagauuacaggcgugagccacugcacccagaugagaauggggucuucaagaggguguggaggagcagugagcuuggacaauuaggggcacccucacacuauuacuuccuuucuuucuucuacaguucuuaaacuuaagcugcuuccuaucucucuucuuuucuuccucccacauccgcagaugggguggcugcauuccgugccuucuugaagacggaguucagugaggagaaccuggaauucugguuggccugugaggaguucaagaagaccaggucaacugcaaaacuggucucuaaggcccauaggaucuuugaggaguuuguggaugugcaggcuccacgggagguguguuggcagcggcgaccauccugucuauccauggcuccuagcuugcauuucucuccucagagaggaucugagccaggcuugaugaggacuuucuuauacuaaacugagccucaucacucugguggcccuugaugaaaaaaggaucauuuuuaagaaacugaaacccaggguuuccaucaaaggagcuccauuaggaguguuuuaguuaucugucaguuaaacaugugcuagcaggaacuguguugcuacagagauuuugcaagaauaagugcuaccgagucuauguucauuuuccugauggaaagcagcauagcuuaaugaaauguggaucugcuuugaaaucuuguuucaauuuuagcuccaccacuuacuagcuaugagaucuuggucaaguuacuaaaccucucugggucucaauuuccccaauguaaaagcguaccuacuuuucagaacaugagagauaaagcaccuguucaguauuugccacugcucauuaaugaguaauuacaauuauuuacauuauuuaauuauacuuauuuguaauaauaggaugaauuucuauuauacugcuguugugaguuauaauacagaauuucacuugggaggggaggguuuaaaugaagaaaaauguuugcuacaaguuuaagugcauugcauuuuuagauuccuucaauuaugcuuugacuugggaugcgagaagucuuuaccaguuggcuaggaugcuacaggcccuuuauaaugcuguuuggaacacagaugugcauucuaaccagggccucccuccacagggcauuuguuuccuuaguagacaagaaaggagaggacagaaagcuuacuucaggggacuugcguuagcaacuggcuuggaucuaucccuuugccugccauggugaaggucccuggauuagggauucaaguaauuugggauuuugccuuggcucuguuacuaacuuuccauacuacuuuaaacaagcuuuuuagucucuucuuuccaguauuguugucuauaaauugggacugagaauaucuggucuucagaccccacaggauucuugcugugaucaaaagggaugaccuccauggaagcaauuugaaaagcagaaaucaccuuaaauauguagaugcugucauucauaauuauugcauaguuagg

SEQ ID NO: 12902 - RNA, 2461 nt, Homo sapiens
ccuaacuaugcaauaauuaugaaugacagcaucuacauauuuaaggugauuucugcuuuucaaauugcuuccauggaggucaucccuuuugaucacagcaagaauccuguggggucugaagaccagauauucucagucccaauuuauagacaacaauacuggaaagaagagacuaaaaagcuuguuuaaaguaguauggaaaguuaguaacagagccaaggcaaaaucccaaauuacuugaaucccuaauccagggaccuucaccauggcaggcaaagggauagauccaagccaguugcuaacgcaaguccccugaaguaagcuuucuguccucuccuuucuugucuacuaaggaaacaaaugcccuguggagggaggcccugguuagaaugcacaucuguguuccaaacagcauuauaaagggccuguagcauccuagccaacugguaaagacuucucgcaucccaagucaaagcauaauugaaggaaucuaaaaaugcaaugcacuuaaacuuguagcaaacauuuuucuucauuuaaacccuccccucccaagugaaauucuguauuauaacucacaacagcaguauaauagaaauucauccuauuauuacaaauaaguauaauuaaauaauguaaauaauuguaauuacucauuaaugagcaguggcaaauacugaacaggugcuuuaucucucauguucugaaaaguagguacgcuuuuacauuggggaaauugagacccagagagguuuaguaacuugaccaagaucucauagcuaguaagugguggagcuaaaauugaaacaagauuucaaagcagauccacauuucauuaagcuaugcugcuuuccaucaggaaaaugaacauagacucgguagcacuuauucuugcaaaaucucuguagcaacacaguuccugcuagcacauguuuaacugacagauaacuaaaacacuccuaauggagcuccuuugauggaaacccuggguuucaguuucuuaaaaaugauccuuuuuucaucaagggccaccagagugaugaggcucaguuuaguauaagaaaguccucaucaagccuggcucagauccucucugaggagagaaaugcaagcuaggagccauggauagacaggauggucgccgcugccaacacaccucccguggagccugcacauccacaaacuccucaaagauccuaugggccuuagagaccaguuuugcaguugaccuggucuucuugaacuccucacaggccaaccagaauuccagguucuccucacugaacuccgucuucaagaaggcacggaaugcagccaccccaucugcggaugugggaggaagaaaagaagagagauaggaagcagcuuaaguuuaagaacuguagaagaaagaaaggaaguaauagugugagggugccccuaauuguccaagcucacugcuccuccacacccucuugaagaccccauucucaucugggugcaguggcucacgccuguaaucucagcacuuugggaggccgagguggguggaucaccugaggucaugaguucgagaccagccuggccaaaauuguaaaaucccaucucuacuaaaaauacaaaaaaaauuagcugggcaugguggcacaugucuauaaucccagcuacuuggcagggaggcaggagaaucgcuugaacccgggaggcagagguugcagugagcugagaucaugccauugcacuccaaucugggcgacagagcgagacuccgucucaaaaaaagaaaaaaaaagaccccauucucuuagacacaaaaguguccucagaggcaagccaugcuucauauucaagagucauagggcuggacgcagugucucaugccuguaaucccagcacuuugggaggcagaggcagguggaucaucugaggucaggaguucgagaccagccuggccaacauggcaaaacgucaucucuacuaaauacaaagaauuagcugggugugguggugcaugcuuguaauuccagcuacuugggaagcugaggugggagaauugcuugaaccugggggucagagguugcagugagccgagaucacgccacuacacuccagccugggcgacaagaccaaaaauacgucucauaaaaaaaaaauagagucauaguaauauuacgaagccacauuuaggaaguuguaguaauauauuuggggcacaggugucucuauccccugggucuacuggugagcuauguugcuauuuaauaauuuggucaaauuauuuguucucuaaccuaauccaagucaaccacccugaggaaacacacaacuuguuacaagaugaacuagagggaagugugaaugucucauccuuugcuacuaccaaaaaaaaucugaaaguaaacuacccacugaaaugcagucggcaguuucauucuguuaccuggacgggguugcaagccucuuuuaaaaaaaaccuuugagg

SEQ ID NO: 12903 - RNA, 5776 nt, Homo sapiens
cgcuugcaggcugcuaaacccaaccgcaguugacuagcaccugcuaccgcgccuuugcuuccuggcgcacgcggagccuccuggagccugccaccauccugccuacuacgugcugcccugcgcccgcagccaugugccgcacccuggccgccuuccccaccaccugccuggagagguaaggggagguuguccaacugcuugggggaagucccaccaacucuuagggaguggagcggcaggccuggggaccugggugggcgcggggauggggcgcuagaggcuugaguagagagguagaagcgcacuugaugccacgugcucagauuccaggagcagggagaaagcaaggggaagggaagcaagggcccgcggcuugcugccauccccauccucugacaaacugcagucgugcucaggugaccugcugaagacccggcugcgggaaggccacguugacauuuccaggcagcacugagccugcccauuucuuaagcauuuguuuuucauuccucagaccagagcuaggggcauugccuccucugccccuggaagacagggagauuuuuuuuuuuuugguggggugugugggggugggggcucccacuguugaggguguguccauauuccagagagcuacucaacagcuuccaauccuuacuggcugggaaggaaaaaguaaagaugaaggcaggaaucaguuucccacacaguucagaaauacuucugaaaagaaugcugaguucuuuucugaaucaacaggcacgaagagagaucagugugacuuuagggaaaagcccauauaugcagcguguguauuacccagaaaguguaagaccuaccacagcauagcucaaacauugcuuuuguugcuuugggguugaugaugcugauaagagaagcacucuuggccuggggacagccaagaguuuccaggaacucuugaggcuaaaguuuggguggcaccacccagagcucuucugggacccauaaaccucuccacacuggcugagcaaaugagagaaugcuuucauguuccugauuuguuuuucagagccaaagaguucaagacacgucuggggaucuuucuucacaaaucagagcugggcugcgauacugggaguacuggcaaguucgaguggggcaguaaacacagcaaagagaaguaaguguugcugaccagcucagggcuccgagagggaagggagugggaagggagucaugaggagggaaauacagggagaagccaggacacgcuaaguggaccuuggcaacaccucccuagagauuuuagugggacuuguugcuggucuguuaugacuacuuggcucaugggugaguggguagguggcuccagggcuccaaguccauccacggaugagggcacacagggcaugaaugccuaguucccagacucucccaccucgggauucauugcacgugcauccagggcuaggacagaauccaagaccacuugaaguuuucuaguaugcaccuugccuagaaacucuuucauauuggcuaucaacuguaccaaacucuggaguuauguguagauguaaucucuauuuaugaggaccuuauuuccuugggaagguguacaaaacaaaucuuugagagucaggggaauugaaauaauuuuuggacagagacgagacaggcuuagagauauugacugaggacuaaagagucccuggcuuugauuucugguugcugaauugugcucuagaaagcacuacugcuuacccuaaguccaacuaagaguuugaggugucagcuucagcaaucaccaagcaagccuuucugugaauuuuaugcaguuuuccaucagaguucuggcuagaauuuguacuaugcuuugguuuguugauuuuuuuucuuacucuuuuuuuuucuuuuugucuuuuaguagaaacuucucagaagaugugcugggguggagagagucguucgaccugcugcugagcaguaaaagugaguaggagccuuuugugucugucucuggguggcacauguguacucaugugcuuuggagccagccccaggacugcugagagccugggcagaauaauaguaguaguaauaauaauaauaaugauccccuagugugccagccucuauucaacauauaaaggcaggucauuguucaagaaaauuauguucuaaaaauagagccauuaauugcaauugcuuuccuuucuucuuguauucccugcugucccuccagcugaccuauuuccucuucuuucccgcaaccccagauggaguggcugccuuccacgcuuuccugaagacagaguucagugaggagaaccuggaguucuggcuggccugugaggaguucaagaagauccgaucagcuaccaagcuggccuccagggcacaccagaucuuugaggaguucauuugcagugaggccccuaaagagguuagagcccccauaugcccagugaauccucacgacccugccugcuccuuccccucugagaaucagggcuagaggggaggaagggcuagguguagagguagaagggccuuacuuggcacaggggugacugggcuucugugaccagagacuaggaaagccaggcccagugccacuccugggugcuuaacccuaagacucaugauggggcaggauguguuggcagguuuuucggcuucuguccauacccaccuuuauaaacccauccguuuuuagaggcucaaaacacuuagcaacuggggagacaaggucagcacagggaccuuauguaaccuggcucaguccccaggcugaccugccugaggccugcuggucuguggucugugauuuuuuugucuaccuucucuccuggccgcuaaacgcauggcagcugcauuugcuaaagaacacagcgccaccugguggaaagauaagaguaaugccuuacuuuuguaccuuauuuuuguuuucugaccgcugauugauuccacauaauucuguaaagguguauugagccccaauuauauucaagacacuguuacagucacuguguaugucacagugagccacacaaagucccuuaccuaaugaaacuuauaauuugaaugggggaagaugccaauaaccaacuagacaaauauaugccaggugaugagcuaugcacucauaaaaauacagcaggaaaugagagacagggaguaccagagguagggccugggaagacguaagguuuuccauucuguaaagggaagugaggacauaugaacagagauaagaaagaauucagggagggaagaacauuccaacacaggaagcagcaaaugcaauggccagagccugccugucacagucacggaugagcaaauggaccuguguagagcagggcaagagcaggagaugaggucaggcaugaggaggauggccaggugugggcuuggggagccucgugggcccagcaagcccuuuggcucuucuucugaaagacaugaggagacaacagaggagcuaccaaacugaguuggguuuuuaaaggcucacuguagcgacuggguagagaacaaaccacaggggugggggguaagguagcagagagaccagguaggaggccuuggugcaaaucccaggagagcugauagugacuugaagcaggguugcuguagaagaaagggugaaaggggauugcguuuguauacauucuugauagauccucauguuaauucugagagauuggaggacagacacuggaucagauguggguacaagcccagagcugaaaagcuagugaucaacucaggagcccccacuuccugaugcagcauccgaugcucuuuccaaugcccagccugccguuggcccucccucagccaugcccacccucuuccccaacucacccuguguguguccuccuucccgcaggucaacauugaccaugagacccacgagcugacgaggaugaaccugcagacugccacagccacaugcuuugaugcggcucaggggaagacacguacccugauggagaaggacuccuacccacgcuuccugaagucgccugcuuaccgggaccuggcugcccaagccucagccgccucugccacucuguccagcugcagccuggacgagcccucacacaccugagucuccacggcagugaggaagccagccgggaagagagguugagucacccauccccgagguggcugccccugugugggaggcagguucugcaaagcaagugcaagaggacaaaaaaaaaaaaaaaaaaaaaaaaaaugcgcuccagcagccuguuugggaagcagcagucucuccuucagauacugugggacucaugcuggagaggagccgcccacuuccaggaccugugaauaagggcuaaugaugaggguugguggggcucucuguggggcaaaaaggugguauggggguuagcacuggcucucguucucaccggagaaggaaguguucuagugugguuuaggaaacauguggauaaagggaaccaugaaaaugagaggaggaaagacauccagaucagcuguuuugccuguugcucaguugacucugauugcauccuguuuuccuaauucccagacuguucugggcacggaagggacccuggauguggagucuuccccuuuggcccuccucacuggccucugggcuagcccagagucccuuagcuuguaccucguaacacuccugugugucuguccagccuugcagucaugucaaggccagcaagcugaugugacucuugccccaugcgagauauuuauaccucaaacacuggccugugagcccuuuccaagucaguggagagcccugaaaggaggcucacuugaauccagcucagugcucuggguggcccccugcagguggccccugacccugcguugcagcaggguccaccugugagcaggcccgcccuggggccucuuccuggaugugcccucucugaguucugugcugucucuuggaggcagggcccaggagaacaaaguguggaggccucggggaguggcuuuuccagcucucaugccccgcaguguggaacaaggcagaaaaggauccuaggaaauaagucucuuggcggucccugagaguccugcugaaauccagccaguguuuuuugugguaugagaacaggcaaaaagagaugccccgagauagaaggggagccuuguguuucuuuccugcagacgugagaugaacacuggagugggcagagguggcccaggaccauggcacccuuagagugcagaagcuggggggagaggcugcuucgaagggcaggacuggggauaaucagaaccugccugucaccucagggcaucacugaacaaacauuuccugauggcaacuccugcggcagagcccaggcuggggaagugaacuacccagggcagccccuuuguggcccaggauaaucaacacuguucucucuguaccaugagcuccuccaggagauuauuuaaguguauuguaucauugguuuucugugauugucauaacauuguuuuuguuauuguuggugcuguuguuauuuauuauuguaauuucaguuugccucuacuggagaaucucagcagggguuucagccugacugucucccuuucucuaccagacucuaccucugaaugugcugggaaccucuuggagccugucaggaacuccucacuguuuaaauauuuauuuauugugacaaauggagcugguuuccuagauaugaaugauguuugcaauccccauuuuccuguuucagcauguuauauucuuauaaaauaaaagcaaaagucaaauaugacauccugu

SEQ ID NO: 12904 - RNA, 5776 nt, Homo sapiens
acaggaugucauauuugacuuuugcuuuuauuuuauaagaauauaacaugcugaaacaggaaaauggggauugcaaacaucauucauaucuaggaaaccagcuccauuugucacaauaaauaaauauuuaaacagugaggaguuccugacaggcuccaagagguucccagcacauucagagguagagucugguagagaaagggagacagucaggcugaaaccccugcugagauucuccaguagaggcaaacugaaauuacaauaauaaauaacaacagcaccaacaauaacaaaaacaauguuaugacaaucacagaaaaccaaugauacaauacacuuaaauaaucuccuggaggagcucaugguacagagagaacaguguugauuauccugggccacaaaggggcugcccuggguaguucacuuccccagccugggcucugccgcaggaguugccaucaggaaauguuuguucagugaugcccugaggugacaggcagguucugauuauccccaguccugcccuucgaagcagccucuccccccagcuucugcacucuaagggugccaugguccugggccaccucugcccacuccaguguucaucucacgucugcaggaaagaaacacaaggcuccccuucuaucucggggcaucucuuuuugccuguucucauaccacaaaaaacacuggcuggauuucagcaggacucucagggaccgccaagagacuuauuuccuaggauccuuuucugccuuguuccacacugcggggcaugagagcuggaaaagccacuccccgaggccuccacacuuuguucuccugggcccugccuccaagagacagcacagaacucagagagggcacauccaggaagaggccccagggcgggccugcucacagguggacccugcugcaacgcagggucaggggccaccugcagggggccacccagagcacugagcuggauucaagugagccuccuuucagggcucuccacugacuuggaaagggcucacaggccaguguuugagguauaaauaucucgcauggggcaagagucacaucagcuugcuggccuugacaugacugcaaggcuggacagacacacaggaguguuacgagguacaagcuaagggacucugggcuagcccagaggccagugaggagggccaaaggggaagacuccacauccagggucccuuccgugcccagaacagucugggaauuaggaaaacaggaugcaaucagagucaacugagcaacaggcaaaacagcugaucuggaugucuuuccuccucucauuuucaugguucccuuuauccacauguuuccuaaaccacacuagaacacuuccuucuccggugagaacgagagccagugcuaacccccauaccaccuuuuugccccacagagagccccaccaacccucaucauuagcccuuauucacagguccuggaagugggcggcuccucuccagcaugagucccacaguaucugaaggagagacugcugcuucccaaacaggcugcuggagcgcauuuuuuuuuuuuuuuuuuuuuuuuuuguccucuugcacuugcuuugcagaaccugccucccacacaggggcagccaccucggggaugggugacucaaccucucuucccggcuggcuuccucacugccguggagacucaggugugugagggcucguccaggcugcagcuggacagaguggcagaggcggcugaggcuugggcagccaggucccgguaagcaggcgacuucaggaagcguggguaggaguccuucuccaucaggguacgugucuuccccugagccgcaucaaagcauguggcuguggcagucugcagguucauccucgucagcucgugggucucauggucaauguugaccugcgggaaggaggacacacacagggugaguuggggaagagggugggcauggcugagggagggccaacggcaggcugggcauuggaaagagcaucggaugcugcaucaggaagugggggcuccugaguugaucacuagcuuuucagcucugggcuuguacccacaucugauccagugucuguccuccaaucucucagaauuaacaugaggaucuaucaagaauguauacaaacgcaauccccuuucacccuuucuucuacagcaacccugcuucaagucacuaucagcucuccugggauuugcaccaaggccuccuaccuggucucucugcuaccuuaccccccaccccugugguuuguucucuacccagucgcuacagugagccuuuaaaaacccaacucaguuugguagcuccucuguugucuccucaugucuuucagaagaagagccaaagggcuugcugggcccacgaggcuccccaagcccacaccuggccauccuccucaugccugaccucaucuccugcucuugcccugcucuacacagguccauuugcucauccgugacugugacaggcaggcucuggccauugcauuugcugcuuccuguguuggaauguucuucccucccugaauucuuucuuaucucuguucauauguccucacuucccuuuacagaauggaaaaccuuacgucuucccaggcccuaccucugguacucccugucucucauuuccugcuguauuuuuaugagugcauagcucaucaccuggcauauauuugucuaguugguuauuggcaucuucccccauucaaauuauaaguuucauuagguaagggacuuuguguggcucacugugacauacacagugacuguaacagugucuugaauauaauuggggcucaauacaccuuuacagaauuauguggaaucaaucagcggucagaaaacaaaaauaagguacaaaaguaaggcauuacucuuaucuuuccaccagguggcgcuguguucuuuagcaaaugcagcugccaugcguuuagcggccaggagagaagguagacaaaaaaaucacagaccacagaccagcaggccucaggcaggucagccuggggacugagccagguuacauaaggucccugugcugaccuugucuccccaguugcuaaguguuuugagccucuaaaaacggauggguuuauaaagguggguauggacagaagccgaaaaaccugccaacacauccugccccaucaugagucuuaggguuaagcacccaggaguggcacugggccuggcuuuccuagucucuggucacagaagcccagucaccccugugccaaguaaggcccuucuaccucuacaccuagcccuuccuccccucuagcccugauucucagaggggaaggagcaggcagggucgugaggauucacugggcauaugggggcucuaaccucuuuaggggccucacugcaaaugaacuccucaaagaucuggugugcccuggaggccagcuugguagcugaucggaucuucuugaacuccucacaggccagccagaacuccagguucuccucacugaacucugucuucaggaaagcguggaaggcagccacuccaucugggguugcgggaaagaagaggaaauaggucagcuggagggacagcagggaauacaagaagaaaggaaagcaauugcaauuaauggcucuauuuuuagaacauaauuuucuugaacaaugaccugccuuuauauguugaauagaggcuggcacacuaggggaucauuauuauuauuauuacuacuacuauuauucugcccaggcucucagcaguccuggggcuggcuccaaagcacaugaguacacaugugccacccagagacagacacaaaaggcuccuacucacuuuuacugcucagcagcaggucgaacgacucucuccaccccagcacaucuucugagaaguuucuacuaaaagacaaaaagaaaaaaaaagaguaagaaaaaaaaucaacaaaccaaagcauaguacaaauucuagccagaacucugauggaaaacugcauaaaauucacagaaaggcuugcuuggugauugcugaagcugacaccucaaacucuuaguuggacuuaggguaagcaguagugcuuucuagagcacaauucagcaaccagaaaucaaagccagggacucuuuaguccucagucaauaucucuaagccugucucgucucuguccaaaaauuauuucaauuccccugacucucaaagauuuguuuuguacaccuucccaaggaaauaagguccucauaaauagagauuacaucuacacauaacuccagaguuugguacaguugauagccaauaugaaagaguuucuaggcaaggugcauacuagaaaacuucaaguggucuuggauucuguccuagcccuggaugcacgugcaaugaaucccgaggugggagagucugggaacuaggcauucaugcccugugugcccucauccguggauggacuuggagcccuggagccaccuacccacucacccaugagccaaguagucauaacagaccagcaacaagucccacuaaaaucucuagggagguguugccaagguccacuuagcguguccuggcuucucccuguauuucccuccucaugacucccuucccacucccuucccucucggagcccugagcuggucagcaacacuuacuucucuuugcuguguuuacugccccacucgaacuugccaguacucccaguaucgcagcccagcucugauuugugaagaaagauccccagacgugucuugaacucuuuggcucugaaaaacaaaucaggaacaugaaagcauucucucauuugcucagccaguguggagagguuuaugggucccagaagagcucuggguggugccacccaaacuuuagccucaagaguuccuggaaacucuuggcuguccccaggccaagagugcuucucuuaucagcaucaucaaccccaaagcaacaaaagcaauguuugagcuaugcugugguaggucuuacacuuucuggguaauacacacgcugcauauaugggcuuuucccuaaagucacacugaucucucuucgugccuguugauucagaaaagaacucagcauucuuuucagaaguauuucugaacugugugggaaacugauuccugccuucaucuuuacuuuuuccuucccagccaguaaggauuggaagcuguugaguagcucucuggaauauggacacacccucaacagugggagcccccacccccacacaccccaccaaaaaaaaaaaaaucucccugucuuccaggggcagaggaggcaaugccccuagcucuggucugaggaaugaaaaacaaaugcuuaagaaaugggcaggcucagugcugccuggaaaugucaacguggccuucccgcagccgggucuucagcaggucaccugagcacgacugcaguuugucagaggauggggauggcagcaagccgcgggcccuugcuucccuuccccuugcuuucucccugcuccuggaaucugagcacguggcaucaagugcgcuucuaccucucuacucaagccucuagcgccccauccccgcgcccacccagguccccaggccugccgcuccacucccuaagaguuggugggacuucccccaagcaguuggacaaccuccccuuaccucuccaggcaggugguggggaaggcggccagggugcggcacauggcugcgggcgcagggcagcacguaguaggcaggaugguggcaggcuccaggaggcuccgcgugcgccaggaagcaaaggcgcgguagcaggugcuagucaacugcgguuggguuuagcagccugcaagcg

SEQ ID NO: 12905 - RNA, 6974 nt, Homo sapiens
ccugaugcagcauccgaugcucuuuccaaugcccagccugccguuggcccucccucagccaugcccacccucuuccccaacucacccuguguguguccuccuucccgcaggucaacauugaccaugagacccacgagcugacgaggaugaaccugcagacugccacagccacaugcuuugaugcggcucaggggaagacacguacccugauggagaaggacuccuacccacgcuuccugaagucgccugcuuaccgggaccuggcugcccaagccucagccgccucugccacucuguccagcugcagccuggacgagcccucacacaccugagucuccacggcagugaggaagccagccgggaagagagguugagucacccauccccgagguggcugccccugugugggaggcagguucugcaaagcaagugcaagaggacaaaaaaaaaaaaaaaaaaaaaaaaaaugcgcuccagcagccuguuugggaagcagcagucucuccuucagauacugugggacucaugcuggagaggagccgcccacuuccaggaccugugaauaagggcuaaugaugaggguugguggggcucucuguggggcaaaaaggugguauggggguuagcacuggcucucguucucaccggagaaggaaguguucuagugugguuuaggaaacauguggauaaagggaaccaugaaaaugagaggaggaaagacauccagaucagcuguuuugccuguugcucaguugacucugauugcauccuguuuuccuaauucccagacuguucugggcacggaagggacccuggauguggagucuuccccuuuggcccuccucacuggccucugggcuagcccagagucccuuagcuuguaccucguaacacuccugugugucuguccagccuugcagucaugucaaggccagcaagcugaugugacucuugccccaugcgagauauuuauaccucaaacacuggccugugagcccuuuccaagucaguggagagcccugaaaggaggcucacuugaauccagcucagugcucuggguggcccccugcagguggccccugacccugcguugcagcaggguccaccugugagcaggcccgcccuggggccucuuccuggaugugcccucucugaguucugugcugucucuuggaggcagggcccaggagaacaaaguguggaggccucggggaguggcuuuuccagcucucaugccccgcaguguggaacaaggcagaaaaggauccuaggaaauaagucucuuggcggucccugagaguccugcugaaauccagccaguguuuuuugugguaugagaacaggcaaaaagagaugccccgagauagaaggggagccuuguguuucuuuccugcagacgugagaugaacacuggagugggcagagguggcccaggaccauggcacccuuagagugcagaagcuggggggagaggcugcuucgaagggcaggacuggggauaaucagaaccugccugucaccucagggcaucacugaacaaacauuuccugauggcaacuccugcggcagagcccaggcuggggaagugaacuacccagggcagccccuuuguggcccaggauaaucaacacuguucucucuguaccaugagcuccuccaggagauuauuuaaguguauuguaucauugguuuucugugauugucauaacauuguuuuuguuauuguuggugcuguuguuauuuauuauuguaauuucaguuugccucuacuggagaaucucagcagggguuucagccugacugucucccuuucucuaccagacucuaccucugaaugugcugggaaccucuuggagccugucaggaacuccucacuguuuaaauauuuauuuauugugacaaauggagcugguuuccuagauaugaaugauguuugcaauccccauuuuccuguuucagcauguuauauucuuauaaaauaaaagcaaaagucaaauaugacauccugucuucaagugcugugugggucaggggaaaaggggaaguguuguggagagcucuggggaggagcuggcuuuugggaauuccacaggacaggcgaguaagcuuccauggcacaggcagaaguacagggagagcuugauauucaccugguaccugccagagucaagagaagggauagguucuaacgaggcugcuaugaucagugacuuuuuaagcucgugacagccccacuuguguugggcuguuguguggauuggacugggcucagcccacugucauuucagagcccguaucuuuugcccaccuggcugggacucggcaugagccauuuccaauucugccuguaacagugcaggggucaguaccccuuggucaaguagcaagacaucaucaguuagguggugacuuuuguaggauuuuuacuuuuaaaaguaauuuguaauuaaauucaauuacaaaucuuuuguaauuuauauucaagaaauuauuauucuuuuuauaauuucauagaaguaucugagaugagguauaugaagccacucuguacaugaggcugcuccauuccaugggccaagggaauaaggguugaacugugcuugaaagaauuuggggguacggagacaggcgcgguggcucaugccugugagcacugagggagggaggcugaggaggguggaucacuuaagcccaggagcucaagaccaggcugggcaacauggcaaaacccaguuucuacaaaaagucaaacauuagcagagugugguggcacaugccuguagucccagcuacuugggagacugaggugggaggauggcuuaugcuggggaggucaaggcugccaugagcugagaucacucuaccgcacuccagccugggggacacagugagacccuggggguagguuugcaaggaucaaaaucuguucuuccucugcuaauugccugcuuguucuccuuuuucauccuacugaaucccucucauuuuuuucugauuacgacuacuuaaaaaaauguuuucuucucuguugaaugaucuguuuauacacagaucuggaccuuaaaugaaccuuuauuucuucccuauugauagucugaguaaagugaucagacuucaggaacaugggguagaaauccccauagaaucacaucuuaagcacagaucuaaggagggauucugugggugacaccagggaggauccugaaauuaagggccugggaaggaagacagggaccaacacuguggcaggcccugagcucuguuaguccuuacaacagcucuguggagugggucugaacacuuuaucauccagagaaggaaacaagcucugagagggagggacaugcuuggggcagccagccagugaguggcagaauggggaucugaacucaguuaugccauggggaguccagucugugaaagauggguggaggaaugugacugauaagggaaggaagagcggaggacccagaaagacagggagguacuaacacucgcccuuuccuacugcucuccuuccaucuuuaugccuuuaacaugcauguauugagugcaucgaaaucccucagacccaaaugcguuggguccagcuucugcacaggcucaccaaggcuuccuuagaggacucucucauccucuccaaucagauaccacaauuucccggcgggucucccuaccccagccucucccugugcugguucauuuuccacacugugccagucuucagcucuaaagcacagaucugagcacuuuguggcuacguuagaaccccucagcgguucacuuuugacucuaaaauaaaguccagcuuuaauccugacacacaagggggucucugaccugacccaagucccucuccagacguaucuccugccuggacagccuucauucucagacuuuucccuucucucucucucucuuuuuuuuuuuuuguggcuacacaugcuguucucucugccuagaacaccucuuucuccucuuuuuuagaaaaaauuggggguugaggugcgaggaggagaaugccaacuuucaaaauccagcaaaaacaucaccuccucagugaagccuucccagaugucccuguacagaguuaauugcucccaacuugcaugauucuaagacacaguguucuuacuuugauuguagcacauaugguauuccuccauaacuucuuucuucauggcuuuugcucuccuauuaaacugagcucuucaaagucagggucauauuauucaccuuggugagauggggcagaacagacuacagcaaagcaguucuccagucccagcuguggagccggaauguuggguuggaauccuggccauucaccuuggaaaguugcuuaagccucagcuguaaaaugaggauaauaagaguaagcgucacagggaacacugaaugaaauaaaagugugcggcacaauguuaaugccucaugacuauuggcuauuauuauuaucugauucccaguacuuagcacagugauuuguauacaguaggcauuagucaagucaaaaagucuuuugacuucuugaauaaaauggcaggaucagaauuucaacucaggauucuaaaucuacuuuuuuuuuuagcugcuucaguaccauauuuugucugauguuuacagcauuccagaauuucagaaaaagaaauggaaggcuggaggcauuaaguaagccaggguauuagagggaccaugggauuccuggaaaccaggucagccaacgcuguuuucaaauaugugcccugugacugugcgaggcugcuugucucucacccucuacugccucacuguggccaugccaggcaaugcaagcuuuuaaaguuuggcuucuuccuuuggaauuauacauccaauggcuuucauuuguuucacuguaguuuuauuuauuaaugcauuuuaauaaacaugugaaauuuuaacagaaaugagaauuauuaauaucacuacugagacagcacagcagguauaggaguuaaaccgagauucuuuaguuuauagggaugaaauuacuuuuaaaaauggaagcuguaagguagagagaaaaaaggugucagggggccgggcgcgguggcucaggccuguaaucccagcacuuugggaugcugaggugggcagaucaccugaggucaggaguucaagaccagccuggcuaacauggugaaaccccguuucuacuaaaaauacaaaaaauuagccgggcaugguggcacgcaccuguaaucccagcuacucaggaggcugaggcaggagaaucgcuugaacccaggaggcggagguugcagugagccgagaucgcgccauugcacuccagcuugggcaacaagagcaaaacuuccaauuaaaaaaaaaagugucagggccuauugccuugcugacugcaaaguaauuuacugucacgaaucuuuuaaauugguccaguuauucaaauugcuuuaaggaagaaaagaaagacuugaaacuuacauaacugaggugugcuccugaggguaagagauauacggcgguuaggcgcuggauaauggaguuggaguccccaucauuuagaaaagauguuucuugauucacaguguuggugauuuucaagcuuugaucuguaaccuggagaaugauuuaauuuaaucuuugagaaaagcaacaauguguggauuaaucuuaugauuguaaugggaugccacuuaagggacaguuccgugccggggaggagaauugccuuagcucaguuaaucucacaguuccaaggcgcagccucacaggcagcgugguauaaccuaaucauggagucagcaggcucggaaguuaggcaacugaauuaaguuccacaucugcuauuuaucagcugaguaaacugcagcacauuacucaauuucucagagccucacuuuuuccuguaaaaugugaauaacaauaauauuaucuucauaggacuuuugugaugacaaugagaacauuuaggaaaaauauuuaucauagcacuuaaaaguaaguguucaaaaaugguagcugcuuguauguggcaggcaauguucuaaguccuucgcguauguuaauuucuguaauccucaugauacuccuaugaguuagcuacuauuauuaucauccucauuauauagacacagaaaucaaggccuagaaaguuuaaguaaauugcccaaauucaaagagcuagcaaguagcuaugucaguuagccauugcuacauaacaucaaaccauuccaaaccauucucauauuacugaugugagcacaucaguguaaucuuucuuucuuucuuucuuuuuucuuucuuucuuucuuucuuucuuucuuucuuucuuucguucuuucuuucuuucuuucuuccuuccuuccuuucuuucuucuuucuuucuuuuuuucuuucuucuuuucuuuucuuucuuucuuucuuucuucuuuucuuuucuuucuuuucuuuucucucuuucuuucuucuuuuucuuuuugagacagggucucauucugucacccaggcuggagugcagugaucaauucgaccccauugucuucucaccaagauccaagaagggcuuuuggcaaguaaaaugcaauuuauuccuaagcuuagagaaaaucucugcagucccagcgaucuuucuugucaaaggaaggaaagguuaagaacauugcuuaauucuaacaucuugagugugggaaggagggagccagagggaaggaggaagguauccuuacauuucaccuuggccuugguuucucucuccauguucccagccuggaauucgcauccacugcugggaggggucucuucugcucuuggugauucugucuucagagucugggccucugaaccagcagcgacuggggucucuuuguggacagacugaucucuccuucugccaggacuguugucagacuccaccugucucuuggggcaccccccuccuugauacuccuggcucccauggaacaaaacaauucugcagaaugccaacaaua

SEQ ID NO: 12906 - RNA, 6974 nt, Homo sapiens
uauuguuggcauucugcagaauuguuuuguuccaugggagccaggaguaucaaggaggggggugccccaagagacagguggagucugacaacaguccuggcagaaggagagaucagucuguccacaaagagaccccagucgcugcugguucagaggcccagacucugaagacagaaucaccaagagcagaagagaccccucccagcaguggaugcgaauuccaggcugggaacauggagagagaaaccaaggccaaggugaaauguaaggauaccuuccuccuucccucuggcucccuccuucccacacucaagauguuagaauuaagcaauguucuuaaccuuuccuuccuuugacaagaaagaucgcugggacugcagagauuuucucuaagcuuaggaauaaauugcauuuuacuugccaaaagcccuucuuggaucuuggugagaagacaauggggucgaauugaucacugcacuccagccugggugacagaaugagacccugucucaaaaagaaaaagaagaaagaaagagagaaaagaaaagaaagaaaagaaaagaagaaagaaagaaagaaagaaaagaaaagaagaaagaaaaaaagaaagaaagaagaaagaaaggaaggaaggaagaaagaaagaaagaaagaacgaaagaaagaaagaaagaaagaaagaaagaaagaaagaaaaaagaaagaaagaaagaaagauuacacugaugugcucacaucaguaauaugagaaugguuuggaaugguuugauguuauguagcaauggcuaacugacauagcuacuugcuagcucuuugaauuugggcaauuuacuuaaacuuucuaggccuugauuucugugucuauauaaugaggaugauaauaauaguagcuaacucauaggaguaucaugaggauuacagaaauuaacauacgcgaaggacuuagaacauugccugccacauacaagcagcuaccauuuuugaacacuuacuuuuaagugcuaugauaaauauuuuuccuaaauguucucauugucaucacaaaaguccuaugaagauaauauuauuguuauucacauuuuacaggaaaaagugaggcucugagaaauugaguaaugugcugcaguuuacucagcugauaaauagcagauguggaacuuaauucaguugccuaacuuccgagccugcugacuccaugauuagguuauaccacgcugccugugaggcugcgccuuggaacugugagauuaacugagcuaaggcaauucuccuccccggcacggaacugucccuuaaguggcaucccauuacaaucauaagauuaauccacacauuguugcuuuucucaaagauuaaauuaaaucauucuccagguuacagaucaaagcuugaaaaucaccaacacugugaaucaagaaacaucuuuucuaaaugauggggacuccaacuccauuauccagcgccuaaccgccguauaucucuuacccucaggagcacaccucaguuauguaaguuucaagucuuucuuuucuuccuuaaagcaauuugaauaacuggaccaauuuaaaagauucgugacaguaaauuacuuugcagucagcaaggcaauaggcccugacacuuuuuuuuuuaauuggaaguuuugcucuuguugcccaagcuggagugcaauggcgcgaucucggcucacugcaaccuccgccuccuggguucaagcgauucuccugccucagccuccugaguagcugggauuacaggugcgugccaccaugcccggcuaauuuuuuguauuuuuaguagaaacgggguuucaccauguuagccaggcuggucuugaacuccugaccucaggugaucugcccaccucagcaucccaaagugcugggauuacaggccugagccaccgcgcccggcccccugacaccuuuuuucucucuaccuuacagcuuccauuuuuaaaaguaauuucaucccuauaaacuaaagaaucucgguuuaacuccuauaccugcugugcugucucaguagugauauuaauaauucucauuucuguuaaaauuucacauguuuauuaaaaugcauuaauaaauaaaacuacagugaaacaaaugaaagccauuggauguauaauuccaaaggaagaagccaaacuuuaaaagcuugcauugccuggcauggccacagugaggcaguagagggugagagacaagcagccucgcacagucacagggcacauauuugaaaacagcguuggcugaccugguuuccaggaaucccauggucccucuaauacccuggcuuacuuaaugccuccagccuuccauuucuuuuucugaaauucuggaaugcuguaaacaucagacaaaauaugguacugaagcagcuaaaaaaaaaaguagauuuagaauccugaguugaaauucugauccugccauuuuauucaagaagucaaaagacuuuuugacuugacuaaugccuacuguauacaaaucacugugcuaaguacugggaaucagauaauaauaauagccaauagucaugaggcauuaacauugugccgcacacuuuuauuucauucaguguucccugugacgcuuacucuuauuauccucauuuuacagcugaggcuuaagcaacuuuccaaggugaauggccaggauuccaacccaacauuccggcuccacagcugggacuggagaacugcuuugcuguagucuguucugccccaucucaccaaggugaauaauaugacccugacuuugaagagcucaguuuaauaggagagcaaaagccaugaagaaagaaguuauggaggaauaccauaugugcuacaaucaaaguaagaacacugugucuuagaaucaugcaaguugggagcaauuaacucuguacagggacaucugggaaggcuucacugaggaggugauguuuuugcuggauuuugaaaguuggcauucuccuccucgcaccucaacccccaauuuuuucuaaaaaagaggagaaagagguguucuaggcagagagaacagcauguguagccacaaaaaaaaaaaaagagagagagagagaagggaaaagucugagaaugaaggcuguccaggcaggagauacgucuggagagggacuugggucaggucagagacccccuugugugucaggauuaaagcuggacuuuauuuuagagucaaaagugaaccgcugagggguucuaacguagccacaaagugcucagaucugugcuuuagagcugaagacuggcacaguguggaaaaugaaccagcacagggagaggcugggguagggagacccgccgggaaauugugguaucugauuggagaggaugagagaguccucuaaggaagccuuggugagccugugcagaagcuggacccaacgcauuugggucugagggauuucgaugcacucaauacaugcauguuaaaggcauaaagauggaaggagagcaguaggaaagggcgaguguuaguaccucccugucuuucuggguccuccgcucuuccuucccuuaucagucacauuccuccacccaucuuucacagacuggacuccccauggcauaacugaguucagauccccauucugccacucacuggcuggcugccccaagcaugucccucccucucagagcuuguuuccuucucuggaugauaaaguguucagacccacuccacagagcuguuguaaggacuaacagagcucagggccugccacaguguuggucccugucuuccuucccaggcccuuaauuucaggauccucccuggugucacccacagaaucccuccuuagaucugugcuuaagaugugauucuauggggauuucuaccccauguuccugaagucugaucacuuuacucagacuaucaauagggaagaaauaaagguucauuuaagguccagaucuguguauaaacagaucauucaacagagaagaaaacauuuuuuuaaguagucguaaucagaaaaaaaugagagggauucaguaggaugaaaaaggagaacaagcaggcaauuagcagaggaagaacagauuuugauccuugcaaaccuacccccagggucucacugugucccccaggcuggagugcgguagagugaucucagcucauggcagccuugaccuccccagcauaagccauccucccaccucagucucccaaguagcugggacuacaggcaugugccaccacacucugcuaauguuugacuuuuuguagaaacuggguuuugccauguugcccagccuggucuugagcuccugggcuuaagugauccacccuccucagccucccucccucagugcucacaggcaugagccaccgcgccugucuccguacccccaaauucuuucaagcacaguucaacccuuauucccuuggcccauggaauggagcagccucauguacagaguggcuucauauaccucaucucagauacuucuaugaaauuauaaaaagaauaauaauuucuugaauauaaauuacaaaagauuuguaauugaauuuaauuacaaauuacuuuuaaaaguaaaaauccuacaaaagucaccaccuaacugaugaugucuugcuacuugaccaagggguacugaccccugcacuguuacaggcagaauuggaaauggcucaugccgagucccagccaggugggcaaaagauacgggcucugaaaugacagugggcugagcccaguccaauccacacaacagcccaacacaaguggggcugucacgagcuuaaaaagucacugaucauagcagccucguuagaaccuaucccuucucuugacucuggcagguaccaggugaauaucaagcucucccuguacuucugccugugccauggaagcuuacucgccuguccuguggaauucccaaaagccagcuccuccccagagcucuccacaacacuuccccuuuuccccugacccacacagcacuugaagacaggaugucauauuugacuuuugcuuuuauuuuauaagaauauaacaugcugaaacaggaaaauggggauugcaaacaucauucauaucuaggaaaccagcuccauuugucacaauaaauaaauauuuaaacagugaggaguuccugacaggcuccaagagguucccagcacauucagagguagagucugguagagaaagggagacagucaggcugaaaccccugcugagauucuccaguagaggcaaacugaaauuacaauaauaaauaacaacagcaccaacaauaacaaaaacaauguuaugacaaucacagaaaaccaaugauacaauacacuuaaauaaucuccuggaggagcucaugguacagagagaacaguguugauuauccugggccacaaaggggcugcccuggguaguucacuuccccagccugggcucugccgcaggaguugccaucaggaaauguuuguucagugaugcccugaggugacaggcagguucugauuauccccaguccugcccuucgaagcagccucuccccccagcuucugcacucuaagggugccaugguccugggccaccucugcccacuccaguguucaucucacgucugcaggaaagaaacacaaggcuccccuucuaucucggggcaucucuuuuugccuguucucauaccacaaaaaacacuggcuggauuucagcaggacucucagggaccgccaagagacuuauuuccuaggauccuuuucugccuuguuccacacugcggggcaugagagcuggaaaagccacuccccgaggccuccacacuuuguucuccugggcccugccuccaagagacagcacagaacucagagagggcacauccaggaagaggccccagggcgggccugcucacagguggacccugcugcaacgcagggucaggggccaccugcagggggccacccagagcacugagcuggauucaagugagccuccuuucagggcucuccacugacuuggaaagggcucacaggccaguguuugagguauaaauaucucgcauggggcaagagucacaucagcuugcuggccuugacaugacugcaaggcuggacagacacacaggaguguuacgagguacaagcuaagggacucugggcuagcccagaggccagugaggagggccaaaggggaagacuccacauccagggucccuuccgugcccagaacagucugggaauuaggaaaacaggaugcaaucagagucaacugagcaacaggcaaaacagcugaucuggaugucuuuccuccucucauuuucaugguucccuuuauccacauguuuccuaaaccacacuagaacacuuccuucuccggugagaacgagagccagugcuaacccccauaccaccuuuuugccccacagagagccccaccaacccucaucauuagcccuuauucacagguccuggaagugggcggcuccucuccagcaugagucccacaguaucugaaggagagacugcugcuucccaaacaggcugcuggagcgcauuuuuuuuuuuuuuuuuuuuuuuuuuguccucuugcacuugcuuugcagaaccugccucccacacaggggcagccaccucggggaugggugacucaaccucucuucccggcuggcuuccucacugccguggagacucaggugugugagggcucguccaggcugcagcuggacagaguggcagaggcggcugaggcuugggcagccaggucccgguaagcaggcgacuucaggaagcguggguaggaguccuucuccaucaggguacgugucuuccccugagccgcaucaaagcauguggcuguggcagucugcagguucauccucgucagcucgugggucucauggucaauguugaccugcgggaaggaggacacacacagggugaguuggggaagagggugggcauggcugagggagggccaacggcaggcugggcauuggaaagagcaucggaugcugcaucagg

SEQ ID NO: 12907 - RNA, 10006 nt, Homo sapiens
uauguuaggcuauuguauuaggcuaggaauggucaaaacaauguuaugguaagccaaaaccaaacucaggggagcaaaggaagggggaggaguggggcuuguacccugcuacaaaccucuaggcuaggaaaugccaagauuguguguaacuaagucuaggugaaaaacuuaaucccuuaagucccaaauacccaacuuagagagguacaggaaacggcuggucagcaacaucacuccaguguuuuaaaaacucagaguacauaaacuugagcuuauuuugccuguuuuaggaaauaaagaaauauaauggcacauagggauuugaaagaaucacaaacacaucagagagaucuuauguuaggcugauuuauaagugcugcuuugggcaguuacacaguuuguuuacaaugaggaguuauuugacuuugaacauacuguacauggcaauuagaaguugucauggcaaaagaaaaccacagcuggccugccacagccaacacaagaaccagaaaaugguagaugaaaugaaggaauaaaggugggguuuauuccuuauuauaaaagaaaaaaaauaauucuucagcagucuuaacaaagacaucaagauacaaaauuacaaguguuuugacuccagcccuguccccaucuccuccaagagcagagguaggagacaguugaagcaaacaagcaauucuguaaaaauuaccuagaaacccuacaaauuugauuaaaaucuaaacuucuauaauuuugcuuuuuaaaaaauuuaauaucaaaaggccugcuuuagugacaugcuauuccuaccagaaaauaaccccaauacccccucugucaguaacaugcucaaguugaccagccaacucuuaucucuaaaccuauguggacaagugugucuuuuaaaccaaagccacggagaucaagugacugcuaguaacguguugucuguuaacuaauccagugcccaccuucuccagagggugggcagggcagaaacccaaaagggucuugagggccuaaucccagaucaccaucuaagaaccacuucccuugcucucuacucaaaaugagaugcuuuauuucuaauccgacuauuugucucaaauuuggugccccgugaccuggaugguuuuuuccuuuagcaaaacacacauaauccacaaaaccauacauauaguuuuuugucuuuacauuuaaauauaaaaauacuauucugcuuugugugauaaaucaaggaccaagcaguaagaaccuuuucuucuuucaagguagggauauccaucaguuuauacuaagcuucguguucagagcagggcauuuagucccaagccaggcuagucccacaagcaagagaccaaagccauucucucugauucccaaccccuaccuucucuccuaauucccacuuuuaauagaaaaguugguuauaacuuuuuaagaaaaguuuccaccacgagggcaaguccuaaccuaaccagaguacgucaggucuuccccuuucagcuaccuggaagaagagacccccuucugcaaacgugcucuguccggauagcuacgccuauuggacaggugcaccccauuaaauggaagcagugguuaugucuccccacccuccuccccacuaaugcacuaaaaagcuucagugauagggaaaaaaaggaggguaggugugaagaaauuaauaacuugaccccucuaucccagccaaacaaagaaagcaagauuaacugggcacauggaaugaaaaaaacgaccuugauauuccacccuuugaguuacaaucgggacaacugggagagggggaagaguuggagugggaugaagaacuaggaggggcucaacagcuggaggucuaguccacuuaauuuuuguacuggaagggcucaucgccgguuucauugagaagacacgugcggaugagggcuucugucaccgaaaaggggucgcaguuggcagaggggcgacgaucuucaaaguaacccuucuucuccuggccaacaguccggggaaugcguaugcuggcgcuacgauuggcuacaccagcagaaaagucguugauguuggagguuucauggaauccaguuagacgucgggcauuguccaggccucccuugggaucauaggcacggaugugguacuggugccgcuugcuuaguuucucaauggccuccucgauguaccuagaguaaacagaaaagauggcaguccaaccuugucuccagguauggagccaagaaugaagugcaccaaaauaugauaccaguagaacaaauacuucaugagggcaguggcugcaucuucuuaccugugugucucaguggugagaacagugcccgacaagcaguacaaaguuacuguuuguugaaaagacuaaucauuugaaacuuucucccccucauaagcauuaagcuuauccacaugccuguauuguuacuaauuuaguucuaaaagauuuucaaaugcaugaauuugucaacuuuucccugucaccaugacauaugucacaaauauauauaucgauauauauuuauauaaugauauaugacuaauauauauuauauaaauuau[450 bp omitted]aacgagaagcuuggccauuaaaacaaagcuaacugcucacuccaacucagaaucuccuaaaccuguucucuucucaccuguacuccaacccguucuuagguuuuggguuagugagugguguaucagcagcccuuacuagcaaaaguccuauguacaccuaccuacccuucuucauugauggauuggagcuauacuuaccugggcaggcaugaccucggcauuaguccccgcaaucuugacuccagcauacaagcaggcccgguaaugggccuccacgaugucccugccauaggcucugucugcucccacaccacaguaauauggaccuacagaagcaucaggacaaaacacuaagagucaagaaauccagagaaucccaaagucagagaucagaaggcccuuaagccuugcccucuugaaucacuauccuugccuucaucugcaggugcggggcaggggaggggcaauaggggaguuccucuucaccacagcuucaguggggccaaacguucccccuaaaaccuuacuuuauauauucauauccauuuuuggacuuuggugaugugagggcuguuucgccuuuacuguauuauuuugcuucuugauucugaaagucauucccaucccugggaaggggcauuccugcacaguuagacacuucugggaauuucaccucuaacccaaggagacuuacccuggggcccugggaagccguuggaaggccaaccaaaggggugcccaucuguccccaugaggguauacuccugcuccaugccaaaccaggggugcugguugcucaccauguccauuauccguuuacaggugugccucaaauuggucucuagaaaaaagagucaauaauacgccaucagggaucuaaagacauagaugcugaauaccgaugcugaugggagaauaguccuuggauucuauacaacugaggugugcacuaugguaugaacugacccaguauaggccuucuugggaucaccgagucagaaaaaugagagaagcuguuaauuguacaucuguaggaagacucugaaagacuucaguuuuaacuaaacucaguuacaaccaagucacaugggaguggauuuagaacagggcaacuuucaccuuaucugcauucuggccaccucccaagcaccaaaugccaggcacuuaacccucuauucacaagacagcugcuucugguugucagauuuauucuucauuucucaggcacuuggagccauucuauaauuuuugagaaacauuuguccauugguuuacauuuguccuggccuacauuccaggcaggaaggcuguuacuggggacuccaagaccggcaaacagaucuggacaaauccaaugcuauuuuaugcaaccaacagagaagaccauagaaagaugggccauauuaucucuuccucaaagcagaaguucagggaaaagaaucacucagauucuuaaaauagugcugaaauugccuagucuucccaaugcugauuucagaaugucuucucccuccccuucacagcauucacagauugaggagggguauccauagcugugcuauaacacaccugcaggccuucgauuguacuugaaaacuucacauaacaccagcuuguuaggguccuuacggaaggggucccgaaacauggcagcaggcacgagauacaugucacuguuggaacccucagacuguaaaguacuagagccaucgaaauuccacucaggcaacucuggggcaaaaagagggaaaauuacauuuaaaacauacaggagcuuuccaagcaaugcaaauacagccagcccuucacucaccuucccaucucuaaauaucucuuuuccaggaauucauuaagguauaaaugccaucauuaauauguauacccuggcaccuguaccugaucuuauagcccuuccuauuugaguuccaaguaagaccauuguaccaauuccuuaaaagaaauauaucagauacucccuucccaaaugucuuccaggagacaagcugaagcauucuguuaucacuaccauccuaucaaucacuuaaaauauugagauagugaaggauucugauucuuccauuagguaauguguugcauccuucuuaugcccccaguguauucuggcaaguuauguccuuauuuuauagaugagggaacagacgacuagcaggaugacuuacucuaggaugcucccuuaucaccuauccaccuuucccacuguuuugaaggcugcuuggucucucuagcugacugaguucucugaaggcagagacgagacucucacuuuguaucuucagugucugugcacuaucaucugccacauagcaaguacacaauauaggcuuuguauuaugaucauucacuuacucaaaaaggaaaaguaaacuacccuaaacuagguaggauaugauacuuuccucuggccccuuuccagaagagggaagacuauggcuuguucuagacugaaaaaugaaggucacaacuauaaucuaacuguagcuccuagagggauacgcaauuaguuuaagaauuuccaaaaguggcaucaacuaaaaauuaguccuauuuaaaaaccauuguagagcauuugcuucacaucuagaagccagugauaugaguauuaaacacaguuuucuaagaguuuguaaacuagauggcauucucagguuagagcagugguuuucugagggugccuuagagccagcuaaguggggauguccaggucggcaaccucuaagccccaugccaacucuccauaaaccagacuuaguuuuucuucaauacacuggccuacgugcacaauuccauugaaauaaaggguuccaucgucgcucugcuuugaggcaguguaggagcuuaauguugacugaauaaagucugaaaagcccugccuuagaaaaccuuuacaaacagaagaaagaggccuaauccagaggcugagucaaaggcugcugcccaccccucugcagaucccacccagcaugugcuccacuccacauugcugucucaccuuccacacacuugggcucacuguccaggguccgggucuugcagcgcaguccuucuccaguaccaucgauccagauauacauggccuggacuuucucacccugaggcagggacauguacaccugcuugaugccuuuauuuaagugggaacuugcugagguggucaugguggaagguguucuggagaagaaaaaaagaauaacauuguuaacgcccacuccaaacugauccccugcaaaaauggcucaagaaggacgacugaaucaaaagucagaguguaagugccaacuccuucccuuguggaagucaacacacaaaaaguuauguuuacucacucuuucagggggauuaguuuuauaguaggcaaaaaucuccuuuauaauaggcuguaaaacugaucaccaccuuuugaaacaauuaacacagaugccugcuaaagaaaagaucaggcccuugguaguaacucaaugccucugcaucccugagcucacaggcuuaaguuccacagcuacugcagaacccaggcuuccaagcuagaacuuauacuugugaggacuaaggucuauuccuucaguguagcugagguuaacacuaaacuauccaaauacuaaacuaucagaggaaacaaaucaaaaccaauacacaaauuuacaaaacauagaacuucuuccaauauaaguaaaauccagccacagaacaggcuuggcuuccacaguuuguuuuucucuuugucuuucauccuagcuguggucuuaacucaaacccaccgccccuccccaccaaaagaaaacucauuacacauuuagauuugaggaugaaacaagguuacaauauauuuuuuuagaaggcuagcaguuuccuacacaaaagcugauucaagccagauucuaaggggaaugcugccauaauuuccauaggucucaugcaaagucucacuuaagauagugggcaagaaucacaacauuauggaauucuacaagacuugucaaguaauuaggaaauuuccacuucuaaaucaaaaagaucuggaaauuuaaaagccaugaggcauacuaauaacugccagccacuaccacaaaaccuccgaaagaagagaaacucucaagccacaacagccgaagaggaaacauucucucucucccuccucccuccguggaccaggguggcuagaaagggaacacauuguucuccuccaacgacuagggcaacguucugaaguacaguggcaaaguuucuacgggcaaccguccauguuugcccagcugaaaacauaacugcuucucccucagccucaccacccuuccccuuggggaagaccaacaccccaauauugccucuagaagacucagccggccaaauccuacuucccaccuccaucccagaacccuuuagcucccgcuaaaagcuacaacccaccgaagcgggcagaucaccugagguacaaaguucgagaccagccuggccaacacgaugaaacucccgucucuacuaaaaauacaaaaauuagccgggcgugguugugcacgccuguaaucccagcuacucgggaggcugacacaggagaaucgccugaaccccagaggcagagguugcagugagccgggagauugcaccacugcacuccaaccuggguaacagauagagacucugucggaaaacaaaaaaaaaaaaccuacaacccaauuucucggcuguccucuccaacauguuacaccaccaauaucaugcacacuuuguccuaagccucaguuucggaucucuugcucuuuuccgugagccgaguugcaugccagcagccuagugccacucuaucaacugcugcugcugcggugccaaguuuacgugggggaaauggauucugaaguuuucagcaguuucugcagcucccaccaacuccggggucguccucccugcccccucacucaccccagccacagaaagucaagcguaucguuaggguugcccucuuuaacccuucucuuuuuggaguggcguucgcgccucuccucuuucucagacucuagcugguccaagcaccggagcuuucugggagagggcgauggagaaggggacagacagcggccggcccgggggguguccgaacaggcagguugguggguuaaggucuuaaucuugacucgagaucucuccccggaguucacagaguaggcgacgaagccgaagcagcuggagcgcgacccggaggagucugacuucucguugucuucauaauuuucauucguugcuuucuucguggacuugcggcugggggaggauccccgcuucccgcccccgagggaguuauaauuauccacuuugagagcagccccuucccacugaaaugucccuaaagugggcgcccugccccucgggcccccguccgaaucucagggccucacggagguggccauacccugccgccgagggguugggggguccgggggagggugggggcgcaggccguagggacugcgcgcugcugcugccuccgcccggaccggcuucuccacugacugcgccgaggcccgggcucuccauuguucggucacauuggaaggcccccgggaccccgaggcgggagccggccgcccaaacaacgcucaccguuacacgccgcaaucgaggcgucucaaccaucgccagaaccaggacgauugcuccgaaggccccaccacgaggaaggcagccaggcgcccgcgccaaccaagcgccuuguuugcgcuccacaggggaccgcaccgccacuccauccacagcgcaaacaaaccacugcgagccccagggcgcaggccggcccaacggccuccaggggcggcgcuucggccgcaaguagugaaaagaagaucaaaacaacucaccccgcccuucccagagccuggccaagggcgcgccccaccagcgccagccccgacggguccaagccaccagcggcggaagcacgcgggaggagcacucaugccggaucucaggcaugggccggagaggccgcagcguagggcugggacuggaggggcaggcagccgaaaaaagaggcugggcggcgcgccucgcgggguagcaggggcggcgcgccucgcuugcgugacaccgggccguccgggggcuuaccuggucgccgagcaggcgggcggguaaagcuaggccgcgagagcgagguuaggagaggagaggaggccgcaguacugcucacacgcuccgcucuucucccacucucgacucugcagagccgccagcagccccgcacccuuuauccgcggcccggggccgcccccggugcccugauuggcucccagcggccaggagcccgggccgaucagcugaugcggucccgggccccgcggccauugggcgaggagcccggcgggcgccgcuggggugggggcaagcgaacugggaaagaaagaaagaaagagaaaggggcgugggggaggggcagggcggcgugggggaagggagcggagccgggagggcugagggcagaggggcgaguugccgccaggccgggaagccucggcucgccgcccacccgccagcucgccaggugccgccccacggcccccaacccggggucccgaggcucccagcaaagcccgcccuggaccucugcccugccgccuucacggggaauaguuuuacgaggagagcucccuggggaaaugcggaaccagggaaaccgaauuuagccuuuuguugcgagggagccuccgagccccgcuuccugcgggcagggguuagcuugagagggagcgcggggcgcgggacccgagggaacuuugggcgggccugggcuagggcgggugccgcgcgggccuggggacaggccgggguucccaaggccuggaagagccgcccgcuccggcucucuugggucuggggaaauaaacagaacucugccauuucacauuugaaaucaacgugcuguuucucuaauuuuacagagaggauucuggagggcgguagaaacuaagucuggagaccu

SEQ ID NO: 12908 - RNA, 5526 nt, Homo sapiens
uguuacacauaguuuucucauuauuuaugaaacuuaaccauacagaaugauauaacuccugugcaaugaaggugauaacaguaaaagaaggcaggggaaacuuacguuggaugacauuuaugagggucagucccacauaccucuuucaggagacaacuugcaccaguuugaccuuuucuuuucuuuguuuuuauuuuaagccaaaguuucauugcuaacuucuuaaguugcugcugcuuuagaguccugagcauaucucucauaacaaggaaucccacacuucacaccaccggcugaauuucauggaagagguucugauaauuuuuuuaacuuuuuaaggaacagauguggaauacacuggcccauauuucaaccuuaacagcugaagcuaugccuuauuaugcauccacauguauggucccuguagcgugaccuuuacuagcucugaaucagaagacagagcuauuucagaggcucugugugcccucacuagauaguuuuucuucuggguucaaccacuuuagccagaauuugaucaaauuaaaagucugucauggggaaacuauauuuuugagcacauggaacaaauuauacuuccucauucauauuauguugauacaaaagaccuuggcagccauuucucccagcaguuuuaaaggaugaacauuggauuucaugccaucccauagaaaaccuguuuuaaaauuuuagggaucuuuacuuggucauacaugaaaaguacacugcuuagaaauuauagacuauuaugaucuguccacagugcccauugucacuucuuugucucauuucuucccuuuguuccuuagucauccaaauaagccugaaaaccauaagagauauuacuuuauugaauaugguuggcauuaaauuuagcauuucauuaucuaacaaaauuaauauaaauuccaggacaugguaaaauguguuuuaauaacccccagacccaaaugaaaauuucaaagucaauaccagcagauucaugaaaguaaauuuaguccuauaauuuucagcuuaauuauaaacaaaggaacaaauaaguggaagggcagcuauuaccauucgcuuagucaaaacauucgguuacugcccuuuaauacacuccuaucaucagcacuuccaccauguauuacaagucuugacccaucccugucguaacuccaguaaaaguuacuguuacuagaaaauuuuuaucaauuaacugacaaauaguuucuuuuuaaaguaguuucuuccaucuuuauucugacuagcuuccaaaauguguucccuuuuugaaucgagguuuuuuuguuuuguuuuguuuucugaaaaaaucauacaacuuugugcuucuauugcuuuuuuguguuuuguuaagcaugucccuuggcccaaauggaagaggaaauguuuaauuaaugcuuuuuaguuuaaauaaauugaaucauuuauaauaaucaguguuaacaauuuagugacccuugguagguuaaagguugcauuauuuauacuugagauuuuuuuccccuaacuauucuguuuuuuguacuuuaaaacuaugggggaaauaucacuggucugucaagaaacagcaguaauuauuacugaguuaaauugaaaaguccaguggaccaggcauuucuuauauaaauaaaauuggugguacuaauguguauccagagacauuugaauuauuaacuuuauucuuuauuagugaaucucuaugauggcacacauaaaaucuuacaguugacuucugcuguuugaauuccccaguguuuuuacauuaauguauccuauggccaguuuagucuuucuucaacuguuacaguucuaggcccuaaucggucuuauucuuucacauaugaugcaaugauagauguaauccuuuucugaaguguuugucggauuggcauagucuauucaaaaauaaggcuuauguaacuuucagcuugcuaugugacagaaguuuaaauguguauuuaaguacacagcuuuauguuccucuuaaagcuguaaagagaaaagaggacuuuuccucaucaagagagcuugggagacaaagcauacauuuaauuuuuuucuuucaaaaaaggcaaugugcacuuuccucuccuaaauuuuauaugcccuagcaguugcgaauguuguguccaccuuacaauuugauuggaggcucccauacacugaaacucucaauagaauucuuaaaaaugaacaucagcugggcgcaguggcucacgucuguaaucccagcacuuugggaggccaaggugggcagaucacgagcucaggaguucgagaccagccugaccaacauggugaaaccccgucucuacuaaaaauacaaaaauuagcugggcgugguggcgcaugccuguaaucccagcuacucaggagacugaggcaggagaauugcuuaaaccugggaagcagagguugcagugagacuagaucaugccacugcacuccacugccacugccugggcaacagagcaagacuccaucucaaaaacaaacaaaaaaaaucacagacucauuuuaaaggagcagcaaccuaaccaaauacaaacuucauuugauuuuagguuuagaaauucuaguuuuauuuuggagaaucacucaguuuuuaauaucaauuaaaauaguccucaaaggaaugaagaggaagucuaaauaaaugaauaaaacucauuuuucauuuuaugguaguauagaaagcauugauguguguagagaaauuaaaagacaagagugguuuacugucuaugcacaaaugagugccuauauuuaaggcugccuauaccauuacaguggcguaauuggugauuucauagcauacagagaaacaaugaaaucaaagauuaaaucauuagguuaugauggucauuuguaagauuggaaaguagucaaaaacccaugugcaacuuuuuuucagcacucuaccauuaggcuccuuaggcaagcugcuuaacuuccgucagaagcaaaggugugggagaacaccauucaccucaguaguaacuuauaaaaaccguuuaaagaaggaaaaugggccccagccccuaggaucccugacuuccugauauucuaaacaugagaguucugugacuuuaacugagcucuuuaccagaaguaacguguugauguauauuaucuuuccaccaugcuuugaccaaaguacauucacaguaacuagagaaagcagaucauccauuucuggauaggugaacuacggcaagguaagaacagaaaaaaguaaaguaguauugagucaugcagguaucagauuaacagacauucauugaagauaagugaaauaacuuuggagauagcagagaagagcaagaagauguuggacguuggcaguaagccgcagcaaggcaguuaggaaaguacgugagccugaugacgcgaaggugaugccuccaucuguccgcuuagugguuauuaaauugcugggaaagaccugccuuuauuuuccuaucaucuuuuccccauuacuuugcauuauucaggaaauaauuauuuauucccaaaugcaguuuucuaagcagugaccacaaaaauuucuuauucuaaggaaaauaauuaagaaaauaacccuaucuguggcauuguuuuaaaaugugggauacaaaucugguaagcagauuucaggucauuauuguuuucuuuuaaugguuuacaugaaauuuuccucucaaaaaacaaguaccucuuacuguauaacauuugaguuuuuaaaauugagauagcuucugagagaaaaaaagaaaguugaauuuguagcucucucaacuacaaaaucaccacacuuuucucaaaucuaauaggaauucagugucauuacagauacggucucuagugaccaggugaagacaauugaagcuuugguagaacuucugcaaaaguuagguaaagaagaauaaauccaauuuaucagcuuuguucauauucuuuuucugagugaucuaaauuuuucuugcuugugaucauuagcuaagacaaggaguguuaaagguuuucuaaaugcaaacacauacguuucugcauuucagaagucagucuugauaguaaauccuacaaacucucaacuuucugcauuguauuuuaagucuauacaauguuagagcacaugguaaugugggacagaguugauuauaugauagcaugagaaauuugcacugguugguguuacaaaccaaugaucuaaccagcauacucuccaaauaugaaaaaguaaaaacaucucauuagguuuggaagagccuaagguaguccauacaggaaguuugccugagaacagagaggagccuguugauuggcauggcucaugaugccuuucuuguaugaauuaucaaaacugauacugaguugccccuagaaaacagccuuccagaauauguuugcuuauuuaugguggaagaggaagugagaacaagaugagaguuucccuuaaagugaggagaaucauuauacaacuuugcaacugaaguauguuuccuuguagcaaaccuuugguuuauuuuaucgucaaaucaaagccacccucaguuuuuuguauggugccaucaaccuaaggaggacaaucaaauaaccuauuguuugccuuggauucaguauaucuacuaaguacacagucucguauaccuucaaaccaguuacuugacuaaacuuccaccauauuaccuuaguucuuccuaugcccuuuccucugugccaccacaaaucagagggaaagacugcaguacuucuagaaaguuguggacuucuaagaaagagccaggcuuccaucucacuaucccuugaucauuaucucugaagucccuaccugcacuucccugauugcccuguagcaacaccagcauggugggaauuggagggaaagauuguggaaaaucccuaaagggucauuguucaugacguuauuuugaauuguaaaauugugagccacucacauuucaauuacaaaaagaacagaacucuuaaucacguugugaagauuaauuucuugccauuuucuggauuagcacagaagcuuguaucaaugaagaguauuuaggaggggaauagggggaaaauuguauuuuucuguucaaacucucuccuucuauuuguguuuccuucaccccucucccuccaccacacuguguuggucaaaugauacuauucuaugaaacccugagcuauaguugucaaaaguaacuauggauugugauuaguccucugugggugcuuccuucccucuuuuuucucccucacucucuuucucagucuccacucugguaaauggaaaaggugaugucgaagaauugaugcuugcuuggacucauguuguaucugugacuaugcuauuagcugucuccuuuuuccuuccuauauggguagaauucuuaugacuuaugaaguucccuucuugauaaguagguuaaaugcacaaugugguacuguuuuauaguuucuagaugguuguauaaagcaaaaaguuaaugugguuauguguuuuuaaagaaaauaagugau

SEQ ID NO: 12909 - RNA, 45236 nt, Homo sapiens
acggcaacugcccgccaacccagcacaccccacagugaagaggggcuucugauccaugaguagggccccucaaaugauguuccccuuuagauggucauggucaucagcaggggugggugcaucgauccuguggggucuugguggucgcagaccaagcgucccucuucucacaucuaauucacaacgucucaucgcuccgcgggagcccaggaacugcccuacaacagccgaaauccgggucgucuauuccaacggacuccucuuccguuggauacgggggccgugagaggccaaacaaccuccgcgaggcuacccccgcagcgaccgcucggcgggcgcuccauuccuuuaccggacuguacaccucgccuccuggggccugaggcgggaacccgggucgcgcugcuccgaggccucggcggaccgcgaaaggauggcucaccacccggccagggccagccccugcaacaagcucagccccgcccgcucccgcgcccaggagcggccggcggggcgggguggcugggccggccucgggggcgggggcucgggggcgggggcucaggggcggggccacguggcuccuccuugcgggcggaggcaggcggugccgcggcgccgggacccgacucauccggugcuugcgugugguggugagcgcagcgccgaggaugaggaggugcaacagcggcuccgggccgccgccgucgcugcugcugcugcugcuguggcugcucgcgguucccggcgcuaacgcggccccgcggucggcgcucuauucgccuuccgacccgcugacgcugcugcaggcggacacggugcgcggcgcggugcugggcucccgcagcgccugggccguggaguucuucgccuccuggugcggccacugcaucgccuucgccccgacguggaaggcgcuggccgaagacgucaaaggugagaagcgggggcggcccgcucccccgugccccgccgcccggaccccuccaccugcccggugggcagccuccuacuccgggagcgcgucccucuuccagucaccuccgcccaccucuuccucuccgcgcaucccacgcccaccaccuucauguuucucagcuccauuuuugccucccgcucccuugccuuuuccucuuggcccucaucccgagcuucuuucccucuccgcggccugggcccccagaccugcccugcucgcccgguucgucccccgccagguuacugccuccuucccugcgagaggucuccuuuguuccuuccuccgcaugguccgcugacaccuuaccguuuccugggccagccuuguggcaguccucuuccucucguccagggacccaugucaucuuccugccagguucccuagcugcugugggucagugcuggggagaaaagggaacggacauccauuuugccucccugccaccuuucuccacucccucgacugguugaccaggugguacauagacuuccuuucucauuuuugucuuugauguggguauguccaccuggcaguuuuccuaucucuguuccgggccucuccugaccugccgccuccagcuccuuagcuucugggccacauccuucucucucuucccccgcucagacccuuauauuuuaaacccaugcacccagaggccuuuggugcguguuuggcucuugcuccauguucccaaucccugguuggggcaccaaaacuauauuuccugaauuccaagacaccaucaacugugagacacacuguucauuuuaugacagcccaagggguagaaggauaggaaaaaaccacuacauguauaaagauuugaaggugaacucuauuacagaaaugcuaaaauuuugaaacacuuaagacuuagagucgaggaaauaugguaauaauaguaauuaauauuuacggagcaccuaucauuucaggcaccuuacuaaguacucggcauacauugucucauaguuuccuuuccacaauuuaaagauuccuguggugucacacauccaccuaauccagguaguggguauuuggcgggcaggagugguauagugauagugauuuguuccugacuugcugccucugaauggaguuacuuccugacucuggugcuaggucgcuagcacggccuccuacccugaaauggucauugaaugagaacugugggcaucuuuggaaauaggccuuuuucuagagaaaggggaacuggaaccauuguuccacuguugguauuucuugauaaauucaacucuuugugguagaacagugccuuuguagauguuaguuuucagacucacccuccucuuuuccugagcagcuugcagauugguuucugaagaggcgagauggaaccauguguacaucuuuuagccauaugguccuggaaaauuauuuuuaaaugaaacuuauaagcuguuuugaccuccaguuuacacuugccuacaugccucacuggucccauuagcugaacgugccuuucugagcagugcuucacaccauuucaacacauuuggucaggggaggagugaugucaacacaucuggucaggggaggagggaggaagaacauggaucauggaacuggaacaccuaagauaagguaaucucaggggacauugugggcaugaacaucauaaaaauucccagaucgcuuuccacuuugagguuauaagagguguucaguggcugcagauggacuuauucuagaauuucuuccuucuugagagugcuggggggaaagauuagcuuccagcugacucacauguuuggccucuugcaaugcagaguuuuuaguuuuccuaugaguugcaugucuagauacugacccauucugcuccuggaugaggguuaccacuuccaaacaggauuccccagugcauggagccuuucucuaaaauaagaaagcgaaaucagaauuuaaccucugaaaaggaaauggaaggaucaaagucugugggggugagccaggguaaaugggaggugggagauuucaguggaaacuggaggucuccugugagccauuggugugagucaguccuugagccagaucguguugggagggcacuggcagaaucugcugucagccugcaaugaagaauguccuccacucuaacccaaagggguguucccuggugaggcccugcugagaagcuaggguuggucucgcuucaucucuguguccugagguuucuugagaaagguugguugugggcccgcagagggcugugcucaucccacccugggcugugugaguacugcccaugcucucugcugaggacaccuguaucuugaggcaggaacagagacagagugaaggucacagggagagagaagaauuuugcagccauauuuggcuggcuucaggcauuuaaucugacugaauaggguucauuucuucagugacuagggcaguagauucucuaggcaccugcugccccggggcagagcauguguuucugagaaccugguuuauccccuuucuauuccagagcagcuccgguugucucacuguauguuuuggaaacugguuguauccaauuuagaccuucauugcuauucacuggcuaaucaaucagcaaauauuuguugagugauaagcauuguuugcauugcaguuggggaaaugagcuacucauagaaggaaaauuggcaacuguuacaaagcuguguuugaaaaaggccaaaggagugguucagccauuucuuaugggaacccaggggaggggaaagucacagagggcuaaucugaucaccagaggccuucaugccaguaguuauuuauuacacgcuugccuuaugccagcacuuugcuaagggccuucacaggccauuauuaugacaauccuuacccgggaaaauaucuguacuauggauauugucuuccucuuuuuuuaaaacagguaaguaacuuuccagguuuacacagaugcuggagaaggucauugacuccagcucuuuuuggcuuucuggagccugggcagguagagagguggguggaggaggaaggauacuccagguggaaaaacagcaugugccgagcuauggaggugagguucguaaggcguguguuugagugacagugagcaguguugguuuugccccccuucucuuccacggcacaggccacaucugcuauguguaccugugauucccagcacagagccuggugcagaguaggagcccacugcacguucaugguggccaguggccugagccucacaggauuccaaaugacagcgugaguguagaaccuucugcuggugccguggauccucuugacucagaccgggggugucagccaggugugagggguagagaaggcauuuuguccauccagugacgucacugcccagaaacugucagcaaggaggaaggaaggcaugaguuggugaccgcauagugcugacuagcuggacagggcauaaacuaacucucugugucaggagagcuccugaauucuucgguguagaguccagagcugagggucaguagauucuagucacuagaccaccaggucugacuggcucuuggugguuuggguaaaucugugccucugucuucauggaaguccagacccacuuaacacucggaggcugcauguuucuuguuaagaguuguuugccauccagcaccucaacgguugucagagcuagaaggggcauuagagaucauucauccuggcccucgcugauccaggaggaagcagagguccagagagacauguggagcucacggugcugcagccaguuaaacuccaagcaaggcuuccugcuccacccagugcccucccugcacuugugaguggggcaggggacgcugcccuugacuccagaccaagcccccagugggggcucagcagaauccccacaacacccccuaccagagggcauccccucacccaucaauccaagauuuacagcuguccaacuucucuugccucgccacccuuccccucuccauuaguccauuuauucugugguugguagaaaaauuacgcuguucagagcaauaauugcaccaggaaaggguuuucuccccaguaguagagcuagacugauacuacugaucauuuugguguuaggcauuuaagacaccugacacuucaaaaagccucugucacccagcucugcauugcguugacaguaaagcuuaaaugcagcuuugcuuuaacaauggagcacucacauaaggaccuucucuauuccaucuccuguuacuugucaaaagacaaaauuacaccacauucaaaaaucuuaacuggcuucuauuugugauucuggaaucggacaacaccacauucugucuuacagaaugaguauucugaugagcugagcagaggaguuuggcuuuauagacagaaaaaggcugaagaaaguagaaacagaucaaaaaucugauugguuauuucggucccuuuuaaagguuaaagcagaggagacuucuguauguuggcugaaacuggcuuguuugaagauuugacuguuaacucacucucuccugaucuuggaaggucagaucgacagcuuaguuuuggcuugguggcguggaacuucagcuugagggacuccaucuugguuuggucucuugggccuugugcaggagcucagucccaaccaauggccuccuagaaauauuauuuaacaguucuccccuuuuggucagguucucaccuaggugagaguuacuaaaacagggcaucagcacuacucucaguaaucaucguuuuggguuuucggucuuaacacaucauuuauagguuaagguguccucauuaucaugcguuucuuggaguuuuaucauuccagcuggagagagaccauuuagcauucagcagagggcugcauauagauauuuaagacucuuugagaggauacaguguaacagggaaacuacuguaaugacucuccccaggauaauacuaagaguuuacaauaugacgcuuagccagggacccaugaaccaaaccaacuaaaauugaagagaucaaagaaugagccagaugaggaauuuacccuuuuuaagcaaguacuauuuguucauuuuuuugcaacugagucucaauacacuaugugucuauccaugugcaacagaaagugucagcaauugcacagauucccuguucgcuaguagguagcaguucuauuaucuaguaucccaugacuggguuaaauuaaagcaggaagugagaacacaugggucuaaaagucugacucuauaaaagggaccacuaguacaguuugaacaacaguuguguuagggauguugcugaaguuacccacugggcagacuaaaggaucccuuuggucauguaaagaucuggguuuagcgugacaaauccaacaguuugugaaguuacccacagaagccacugauugugaaauucuaacuacagcauuauccugccagacaaaaaaagguagauguaaucaaggauaaaguggaagucuuauuccaaugaaacucuuguucagaaguuuugggaaagcaugaaguugucaacuucuuguccugguuugcaguuugauugucucugguuauggcauugggcauuuuggugaacucuuuguguagcguacacgucaggcaugagacuugucccuugaaauguauaucaaguuguucagcuucuguuuauagggcuuuaggcacagaacaguuccuguucuuaguuggagaauuguagcuaguuauuggaagaaacuggaagaauucagaauucaauccaucuuauagguagaugauaaaaacuugaaaaugaucaacaaggcuacaaucuaauaacagauguacuauaguuuuucuuuaggaacauauuuuuucucucuauagucacccccauuucuaccaaagauaaucaggguaagugggaggcagaggucacagugagccgagauugcaccacugcacuccagccuggaugacagagcaagacuccaucuaaaauaaaauaaaauaaaauaaauaaaauaaaauucagacuaauuugcuugcagaaaauauuuagucacaucagacuuggccuaauuauuuacauaaguguggcaagaauagugauugaccacguaggcucuucuuaaguuugcuuugcuagaacuuaucgauaaggaaucucagauuggacuuuuaacaacuucucaaggcuaggaagucaacccaagcccaacuucagauuucaccugcaguaccuauagauucaucauagguauauucucaaguauggcaucacacucaaaaccuugguaauaugaccaguguuuccuauuguauccuguuguaaagagagcagauacuuauugaacuuaugcaaauaacaguauugccauaaaaauaggaauauucacaaauaguuucugaauuccagagaggucuuguagggagaaaauguuuccauuuuuguucacaagaguauacuuaccaaauugcuguaaacuauagauagcuuaaaagaaaauaaguuuucuuaaaucuggacaacaaaacauuaaaaagaaccagcaacguuucaaauuuaaaaaccagaaaaacccauaauucuucauuaguucauuuagucucauguaauuaauucuuguugugcuugaucuugguuaucaguuuugcagacccaucaguuuuuuucauuagaguucuggaaauucuuucccaguccaaucguauuaucucgaaguuaucagaaaugguacuuaucagagacguuuccguggaucuccuugaagaugaagcacuucaggauuauaguugcuuagaaaaaagcuuuuagaaaaacaucagaauaaagcaauuaacuguagacaauaagacuuaaaaugguugugguuaaagaucugaugagaguucauaguaauaaugacacaauugacaaggaaaucugguuauugcugugcauacaacauuuuaaccuaauaaccaaaauuaaggcugauaauguaucauauuucuaggaauaucauauaauuuuggggauacaccuuaauagcaaguauaaacauacaucaauaaauauaacucaaagaagauuaaacaucauuucuuguuugacaaugcuucccauauaauuaauacaucaaaugagccuaacuaguuuaguaucuccccuuugcagaaucuuugagauguuccagggcccccugaaauguuccaaaguuacuucaaguucagaaagccuuaauuuagaauuugauuuugggaaguuuguacaaaaugucaaagguuuaaaauuaaaacacuuaaucagccugggcaugguggcucaugacgguaaucccaacacuuugggaggccgaggcaggaggauaccuugagccuagggguucgagaccagucugggcaacauaggaagaccccauuucuauauuaaaauuuuaaaaaauuagccaggugugguggugugcaccugugguaccagcuacuuaagcagcugaggugggagaauuacuugagcccaggagauugaggacaggugagccacgaucgcaccacugcacuccagccuggaugacauagugagaccuuaucucaaaacaaaaacaaaaaagcaaaacaaaaaaaaucacuugaucaaaauaggaucacaggucacugugaagucacagucauucaucuaaccagaaugauaauuaaaagacuucaaaaugaaaauauagaauguuacauuguugcagaaaaaacagcucuuuuauagagaggacuccauuuucuuaaguaaucaaggaccuaguaaagacaacaugaagcacagggaaucaucuugaugaaacaaaggaucuuucuuuaggagaauuaccuaaaagguacagaaaaaccuuucacuguuuccuuuuaagaacagaucaauacuucaagaaaaccuuguuuuaacagagaggaccaaauucugauuuuucaucaguguacuuuugauauuaaggcucaucaaaaaaaaaaaaacacaaaaacuauaaguuagcccauucgaccacacuugaaguucuuuucucuucacaacuuccuuguauccauugguuuguccuguacuguuccucuuucucauugugaaauaaccagucacucuacuuuagaacaaaaugacucucuuuuucccuuaauuaaaauacauccuuacauuuuaugacuuccuuuauaaaccgugccauacuucccuugcauacagaauuaugucccuuauuauuuuuaguuuuaguugcuuauauuaauuaguuuuuacuccuuaguaaucuuaauuucuagugaaaacuagcaagcauugugaacugucuucuauuaacauucaccauuucauaauuucuagaaacauguuuccucagcuuuucaugcuuauuacagacccaauuauauucucuaugccauacaaaaacaagaugccaaagcauauauacuuuagacuuauguucagcaauuaauguuucaguauuuuaauuuacuuagaaaugauauuuuaugaauaucuaugacuuaauuuaacguaaaauaaccguaagaggaggcuggauauguggacaggggccaaaugaagaacugccuucugguuguagauuuucuucuaaagucaguuagagcccccagagaauguugaauagagauugacauaaucagauccacagaaagaaaagaucauuugguggcuagagagggcagugagggguggagcacauuagaaccucaccaggagagaaauaauauguugauguuucucuggaagcccugccaugagaaccuguacuagcucaugggacacggaggguagguuggaggugaggucaguaaaaaaccagaucacggguucaugccaaccuaggacaggcaugaagagauggagguuugggugagggaagagacuucagaggagaguggacaggauguggaggcagguggggaucagcaauccccugguaggggcagagggauugcauccugggccuggcaugcaacaggcccugaccauaccugccuuugugcaggcugccuugcaggugagguuuaaagccaaaggaugcaccccagcuugcagauacuuggauaggcucaaguugcuauccuugugugcuaagggagucaagaaggcuccccaaaaagugugugguggggggguguugaggagguuggggaaauggcaucauaggauguagcucaccucacucugcuaaauacuuuugacgucugacucugguaaauaccuccaucuacuuccucuucccaaccccccacccaccucccuccuucgaggaguccagaagcuacaaugccaaaagcagacuaccagcaagaaaggugggggaaagaagggggugguguggccacaggccuuccucccagcucgcagagcccccucccuuguaucagccccaagaagggccagcuuaguugccuucuuuccagggaugcgucagggugugccaggcucuuccugcaucugucucguggaggugaggguaacacuccuuccccaggcguaacguguucuuaggagcucugauaccuucugaaauuguguucuucugagacgucguaaggaguaaguucuaggguggaguauuaggguguuuuugcauugauaaaaguaaguaccugaggcuagguaauuuauaaagaaaagagguuuaauuggcucaggguucuggaggcuguacacagcaucugcuuagcuucuggggaggccucagggagcuuuuacucaugacagaaggcaaagcaggagaggaagcaggaggggguugggaagugccacccuauuuuaagcaaucagaucuuaugagaacucagagugagaacucacucguuaucaagggggcagugccgagcuguucaugagggaucugcccccaagaucuaauaccuuucacuaccuaaucuaauaccuuucaccucgucuaacauuggagaucacauuucaacaugagauuuggaggggacaagauccagaccauaucagguggggucagagguccugcuaaaacugugacuaucagggauguuauucagauauuaguguucuguacuuaaugggugcugggugggcugccuguguaaauuccacucccugccccuggggcaugagcuucaaaugggaauugugccugccaccaggcaggccuccuccuccucucaucugcuucagagacgcauguggguccagcugccauggacgucauccugagcuguccaggcagacacucccagucuggucucuucuugcucccuucuauucuggcucccaugccucccaaaaacccuccucuccaggcagccugguuucugccaguccucuccuccuccaccuugcucaggcaguucccugcccacuggaccgacggucuagguucaacucuguuuccaccuuuccugcugagcccaugccuuggucugcagggccgaccucuccaaacuugagaguucugugccacaugauuuggccccugccacugcccucucacggcuugugugucuuccucugugcgcaccuuggcuuccagcuggagcagccuccauguggguggaacuuugguggaugcucacggggcaccugaccuggaaccugagcucaggagagcugccugguauaugagcuuguuucuucucaguuccugggcuguggcccagaauggugccauuauucucucugccaauguuucagcggccagcagccuuguggcccggggccugaugcaggggccagacucuggccucaaggcuucuuuccccgcaguuccuggauuccagaugcuccuguuucugucuggggacccaguuccugauacccuuuaccccagucacucaagcucugcccacuaccaguaucucuggccccaggaaacuucccuaaggguccccuggggaauuccagauccccuaaggcauguucuccacccucuggaacugaucccauuuagagccccagggacaaaggcaauaccagggcuuuuccugggggguggggggcuggggggauggcgaggagcagggcaaacuccuucaacaucucucagcccccaucccuggccccgauuaguaauggagaaacagauaccauuaugaggcaguaugacuuaugcuaaucauccaaaacacagguucccuuuugugagacgcuagaaaugcagaccaacuggaauaucucagagguccuuuuccaaggaaggugugaccuuugucauaagagcuuugggaucaggugcuuugagguuggcaggggugaggcauugcauuaggggagaugggcgggcagaggggguaccagccccucuuauuuaccccuggguuuuuuguccuuucagccuggaggccggcccuguaucucgccgcccuggacugugcugaggagaccaacagugcagucugcagagacuucaacaucccuggcuucccgacugugagggugugugacugacaggaggggaaggcaggcugggccugcuuuguuucccuuuauaagggaaagggaccaugugggaugugucgggaugggcagauuucagcugcucugauuugagcugggaggugaucaucacuugggcuggugagagcucccaccucccaagguccucuucaauugcucucccucuugaccuccaagccuuaagaggucugaucuaacucuauaaaaccaggauucaggcucugacccaccugugggcagggucagacucuagaagccuaguggucccccacaaagggaccccagacacucuggcaagccucagccuccucaggcaaaaaugccuugaaccacagguagcuaagaagggaccugucaggguagccucaccccacugucagaaugucagugccucaggcagcagggauccccggcacgggaguuaucacacccaaggcaugagggcuuugucacccccgcucugguggaaaguggcacgagaucucugaugaugccuuaccugccagccugcccagugcagggcaucaacagcuuaauuaacgucugaacagcuuccaaggcucucaaauaggaggcccuggauagcccagggcagcaaggcugcugcaguuauggugagggcccuccccugggcucaggccuggcuccaauccaauuaguuuucuuccagauuagagaagccaaauucaaaucucugucucuguagcaccagcuauaaauaauauguacccucccaccagaauggcaucuagaaaaccaguuucuucuguagccauuaaggauuauuaggaaaugccuuugaaagcugaaaugccaagcauugucccuggaacaagauaccucugagcuggggguaggggcagccaaguuucaagcagaacugugagccagaacucagcuuaauuaccccagcagcauccauccgggaaguaaggccguggcuccaccaggaacauccagcucuaacuccaugugaccuuucuguuccucgagcccagugcaacccccacuggauucaggguuuccacaccuaauagaagucccuuccuaaacuguuaccacauagggucagggccccccaggccccagguuuagcugagaccagguuggucuccugauagcgaaccaacagcuacugccgugucauugaaaaguggcagcagagagucugcaugucaaucaucccuuugaaaugaaaggccuuccuggcagggacauggugcuaucuuuggcccuaagguguguaauugagaauauucaaacagggcacucuguuccuuuggcugaaccagggugaguggcccugagugggaagcugugggcaaguuaguguggcacaaggaaccaucauucacaggcugauauuuuucucccagugagcaugagccgcaggggugcagccacugcccagcccccaggggagggguugacacugguacagcagccagggcaagacaaccgauuggaguucuguagggccugacaccugagcuuucugacucugccugggagaggcugggcacagcagggaugaaggaggcggccuaggcccaggaggucagaggcuccucagcgccaccccaugucacgcagcgcacgcagccuggaugccucaggugagucaccaucuccugaacugccuggcuggcugugggaggggcacugggagggcccucgcugggcuccucagcccuccccugccuccagacgggcagcaccuggcagggccagucugguagucaucuguccacagaccaacacgguggccucccccggcaaagccuuuccugccucuccugaggaaccuguggcucaguuuuggccagggggaggcacccagugcccaguccauaggccaaguggcuugagcuggcaggucucugcucugagguccuaugcagcggcucucaaauaguuucuuacugugaccaacuguaagcaauacacauuuuuacauugugaucccaaaguugguauguaucuauuaucauuaaaccagaaguuucauaaaacaagauucuuacuaagugcaguuaaacugugauauuuucuguucuauuuuuuuuuuuaaauccggcugugauuaaauacauugauuugacagcucauuacaagguuguuucuaguguuuggaaaacacuacucaaacagauuccaauauccagagauucggggccaugaagaaccugugugcccuuggcagaggcugaccuggagacugcuggugggccagagacauagcccuguugcccugccugcugcccucugggggcuggagccuguccuugcacucuguccaugaagagcugaaaagcgagggcccaugcgaagcagggggaggagagagugcuuuugguaugauggggacaggcccacacacaagucuggccucccugaguggcaugugugacuguccuuuucuucugucuccagccccuugucacuaugagcaaacagugagcuucuaccagcccagccuguuuagcaaacaccugggcccugaagggcgggccagcugugucagguccccaucagguuggagccagagcccagcuggaaggaaacaaaggcgugggagagggaggggcugguuggcugcagguucuggcuggagcuuggcaaccuagaggcuggaacuuccgggucaaggggcuucuccgugggccucaggagugcccuucagugggaauagaaugggacuuuuuauggccgaaggccuggccggagcaagggguacacagcacagcagcauagggguggggaagggcaggucuucucucuucgaggcucugaggagaucagugaugugguuucaaauccaggccucucugcuuacuguguguggcuuggaaagucacuuaucagugccccagccgugggccccaguuuccuugucuguaaacaugggaugauaacauccaccuaagaggaccguugccaagugugaagugaggucucccauaugcaagugccaccaugcuagugugauuuggacuucaguaaaaguuaguuugcuuccuucccguugucccaucucacuccugggccacccguggggcugcugguagcugguguguggcugcugcuggacuguguggcaguccauccaucugucagcagccacugcgggccuacuugcugggugcccagcaccgcacucaccacugcaggcguggccaggagcgugagauccccagagcccauggccagugagaggcggccagggauagguacccaggguaugccacaggaguuugcugggcucacggagcucuuucacuggucagagaggaguguguguaggaggggacuucuacuugguguugaaggacagaugggguuuggcugggagagaggaggaaugugggcgggccuuauaggcaggcgagaaggugagagccaaggcccucugugggcagggcgagguggcguguugaggagacucguccagcugggcagaggcucauguugagggaugaggcagagcugggggaggagggagcccagaaauggcagguccuugaaugcagguuuggaagcagggacgcccugugaggguacagagucugggcuguuaccuucuguggcuuuugcuagaaggugagaugucagggaggaagacaggacuccaggaugucuccugucucucucuggaaaaaggaggugggccccuuucucagcagucagcugcuguuuuugaggucuucuccauggauaauccacgguguuggaagugguuaagguaauggauccucaugggcuuaccauaaaaauaucuggaggcuggaccauuuuccuuaaaacguuauaaaagcuggaauugaaugccaucggugucaccccugggaagugugcuuucucuugagcucuuuuggccccaagauagcagucacuccauaguuucgugaagaccagccugguguugccugguuuucugccauuagggagcagcuagaggucuuccaguagcuccuguguaaagugaugaaagaaaagggcugggugcugacugcuccuggagaaaagcaacacacucccagagucuuaauugccugcuuccagggagcuguggugguuucccuugggcagggcacacgccccagugguugacuuaauaaggauacauuuuaaucagaggacaaaaaugugcccugacuugauuuccgcaugggcuuccagcauggucaaagggcagagauucucuguucagcugaacagaugucuauugagagaugccagacacuguggagcuugcagagauaaauaaaaugucguccugcuuccuggucagaggugggugcaugggugagugguggauucagguugaaguucauugcagcuggaguggcgggaguggagggcaaugugaggugaguuuggguuuggagccuggaaggccuugaaugcagugaguuuggacauuauucauugacaguggggagucauggaagagauuugaggaggagcaaaauguucagaccagaacugugccuuagaaaacuaaccuuaguagcagugaggaagauagcuggaguaugaaaagauugagcauacuaaaacuucugagagcaugaaagguggggacugaugcagugacccaaaaauacgucaucaucugucgggccuggucuagacaaggcagguggagaaggagaggacuuuugaagagguaacacggaggucaaauucauaggacuugucagcuaacuggaugacggguuuuugaagagggggaugguguggguggcagggagggggacugguugcugggugagguaaacacaaguggcaaagcagguugagagaggggugauucagucuuggggauggugggggaggggcaguauccagacaccugaguggaggccaucaggaagaaccaggagucuaggacaggugaggucugagaugcagaggguucagauggcaaaucauuuggacaaagucauuggcuuuggcaagggagaaaugauagguuuguucauugaucccuuuauccacucaucauuuagaagcaagauugagcaacuucuuugugacagugccuucaacagcuuuuuaaacagaagagugucaggaccugacaugugucuguaggagagaccgggguaggagauggggguggacagugggcacaggagagcagucgaaagugaagcuaggaccagggcaagggggccaaguaaggcuggucagugucaagccaaccaggggaggguggcaacgugaaagcaacaaaggagagcaaccacaaaauguggcacgaaaguugacaaaugcucgccaugggaagacaaagcaggcaguaauaacaucuguaccagagagaggccaggagggcggggagagaucacuggaguggcugaagagaaggucaccaaggagcuucccuagaacggcuucaacugaggguuguggggauggccagagagcagucugaggagcaagggcagacgcuguuccaggaacauuggcagcauggggacacgggaaggaaaugcgguuacucgagaaggaaggagggccucucuucauccccauccuccuucccuucccauccuuuccuuuuuuaaggguuagacuagaaggauucgaaucuaucuguaggccuaguugggcggcuguaguagaaaagaggaaugaugagagauggcuaggaagaaguuccugaagagcgugaggcgugggagccagaacucggaggagacauuggccugggaggugggugcgaagcuucugaggacagaagggaacagcugaggugcagcagggccuucccuucagccugcauccuggggagaggcucuuggggucccugcaucccccugggccacucuggcugaccgagguuccuggucagacuccaagcugcuuguggcugcagggaucuugagggguugccuuuuuaaaauuuuuuuauuuuuugagacagagucucucucugucgcccaggcuggagugcaguggcaugaucucggcucacuguaaccuccaccucccagguucaagcaauucuccugccucagucuccugaguaguugggauacaggugcaugucaccaaauuuggcuaauuuuuauauuuuuaguagagacgggguuuuacccuguuggccaggcuggucucaaacuccugaccucaagugauccgcccaccucggccucccaaagugcugggauuaccggcaugagccacugcacccguccuggagaggcugccuuuugguagaaguaaugcaagccucuuuuaauaugggcaccugcucagaugugggugaccugaugguugaugacaaaaaaaugaccauauuacuuuucagaggugaaaauaacagcuguagcugugggaaagccacccaucucaaggcuucaugaugucaguguuguucucauauauguagaaaccagucaaaguguaaccugucuguaaauaaacaagagcaccaucaccaugaauaacugcagcgcaacaucacccucggguuucuuuuuuguuuuuaaauuuuauuuauuuuuaauuuuuaacuuuuuguagagauggggccucacuguguugccuaggguggucuugaacuccaggguucaagugauccucccuccuaggucucccaaagugcugggauuacaggugcgagccacugcaccugaccugguuuauuauuugucggcaaaccaaaccccaaauagauguaucuucaauuuuguucaugaaaaagugucaguccauaaaugccguaacuuacauuaucaauacgaucuccuaaucaaggaaauuuaugaucauuuucuuaaguauuaggauaacauaauuuuaauaggccaauaaaauuaaauaacuguaaagaacgcuauuuaaauaugugugguauguauaaguggaugguuuucauccacaauaaaaguuuauauuaauguuuugaaaagagagaguaaagcagugagcaggaguaagggcccgggggaggucacagggagcagaagguugcagauggggagagacagguggcuucucugcagccuuuguuccucaugugggagaggguagcagguggcuuccagauuuucugccuacaaaugucuguaacaaacaaguccuagcugaucaugguuccuaguguuuaaaagguaugaaggagggaaggggaugcugguggugggugaugaugguacaguuaacauguaccaguuccuugauguaugcacuagguaccaugcuaagcacuuuagauguauggucauggaauccucacaagucuucaagguagauggugucauccucauuucaaagaugagaacacaaagguucggagcaguugaugcguugcccaaggucacacagcaagagcaaagcagaaccaguccuugaacgaggucugccagagcccggggccuguucucagcugccagcuugggauaaggccaaacagcucuaucccaaggagggagaaggaaaccaguguuuggcuguuggaggcagaaguccaagguagugaaaaguggccccgaggcuagagucccacaggaagaagccucuucccagccugcaggcucuccccuaggcaguucaguggccggcuuccaggacaacucaacuguguucccuccugaaucggaagagcgcaggcaaaagccuuggcagcugucuugccgccugggcagaagcccagauugccaggagucaggcucuguucggucuguccucuugccccaaggaggugacagacuaggcuuggggugucauguacaugggaaaagaggacaaaguggugaguuaaaucagcuagucuguagcaaggcauguuuccccagggacucagguccccgcuucaagagaaccuguucuggagaccccuuccuugacugugucugcugugcugggcugggacuuaguggacagagacagcagccuguaagccccuuuucccaaguaaggagcaagggcacauugacauagaagcaagcugacauuucccaagggacguaggaagugccugcacuucauguuuucagaugagucugcaaaggaaaacagcagugguacuucaucacucauccauucgauaaauauugguuaguaauuacaugcuagguacugugcugcauagaaauggcccucgaggaggaaaguguaugaacugcugcccacaggauccauggaugcuucugaggggugugggaggguaacaggggagggagccaguguccagcuccuagagcaaccuccccccaacuccccccaauucaccauuuuacagaugaagaaacaggcucggccaggcgccuauaauccugacacuuugggaggcugaggcgggcagaucacaggucaggaguucgagaucagccuugccaacacagugaaaccccaucucuacuaaaaauacacacaaaaaaaauuagucgagugugguggugggcgccuguagucccagcuaccugggaagcugaggcaggagagucccuugaaccugggaggcagagcuugcagugagccgagaucgcgccacugcacuccagccugagcgacagagcgagacucugucucaaaaaaaaaaaaagaaagaaagaaaaaagaaacaggcucaacaacauuaagugauuugcccagccaccgcauugaauaaguaggcagauuuucagagcaggccugcguggcugcacucuuggccacuaucuauuacugaugcccaccuguguguuugcuuccaguucuucaaggccuuuaccaagaacggcucgggagcaguauuuccaggugggugcccagcucugguuguccuguuagcaucuuccucccccaaccucccucuucaccuggguuucuauugggguggagaaagcccuggcagucggcagggucgagggugaggcgguccccacgggaagccuaacuugugucuucccaaaacuauccucccagucagcuuuagggaaaggcaggaugaagaagcccuucagguuggacauauccagggcccuagggucggggcaggggcaccauguucccagaagagcucuucugucacaaugggguuggcgcccagagagcagaccagagcccuuggggaaaguccugacgacucccaguucugagggauucuuuccugucugagggauggguguccuugcacuacuuggggccacaggaggacuacucaagccccauucuucuagcacagggaaggacugacgccucgucugucucugucagagcuggcugugcccucggcccuuuguuucugggagugaagguggccagugugcuguggaagcagcucugcucuccugacacuccgcucacgccuguuuucauuuacaguggcuggugcugacgugcagacacugcgggagaggcucauugacgcccuggagucccaucaugacacguggcccccagccugucccccacuggagccugccaaguacuuugggcuggggcaggcuuagugcauugugggccaggaucccaggccugggagugagaggguggugggaacagcagggcggggaccccaguuuauuuuccuugcugccuuugccuguggggcucacacaccagucugcuggagcuacuccagaaccaaguggcagcugauggcugguggugggcuuccuaucgcacagguccugcugaagagcccuguuuuucuggggcugacugauggugcaaggguccaucccaccaggugggaaggaaaagauggauggggcuucuccagguuguaccugcugcuguuucuugcuaccuucccucaaaauguuugcgggacgcagcaggauuucacaugcucuauccccgggaaggccacugagagucagaauggcaugaggaggaaaaaggagaucaaauauuuugagggaaauuggggggagguggagagaagguggucaugccuggggcauggggguggccccuggcucucuguauggcagagcaucaggugcaguggccggugcucuguaucugucagccaggcaagcuucccagcuugccucuuuuccaggaaaaugaagacaguaaggugcauggucuugcccauacuuucccaaagaagagacagcuagauuaaaaacacuaggccccccacuucuggaucagaacucaagauaggauaaugcccaccucggaggacucuugccaagaaggaacaaauccauguaccagcaggagcugcuagagggagcccagccuuguacacaguggaggccccaggugcuaagaaggccucacaaggccgcuguuggugcgcagaggcucucuuaaaaguuugugugcaggugcucucagagacauggcccugcugagagauuguguuuccaagugucaguugggguugaauccaacucacaaugacuccuuugucaucuuucccaauuuuccauccuccagagggccuccaggggacccuggauacagcauagucuuuaugugguuugggguuccacagccagacccugucucuccagaaaacacccaugucagccugugcccugguccuugcugcuucuauuucucaaugacuguguuuccaucucccuccuuacacacacacguacauccucauggcacauuuucagcccugggguaucucaaaagcaacagcucaagcaauccugccaaggucucucaaagugauccuuuuuuuuuuuuuuuuuuggaagacagaaucucgcucuguugcccaggcugggagugcagcggcacgaucuuggcucacugcaaccuccaccuccuggguucaagcaauucugccgccucagccucccgaguagcugggacuacaggcgccugccaccaagccuggcuaauuuuuuguauuuuuaguagagaugggguuucaccauguugcccaggguggucucaaacaccucagcucaggcaaucggccugccuuggccucccaaaguacugggauuacaggcauaagccacugcacccagcccaaagcaauccuuuuaaagaacuuuaggaaggagguagagaugugugaugaaaggugagcugccucuucugaagucugagggugggaguggggaaagggguacuggcccccauguagguugugcucuucugccagccuagggaagacccagggaagaggucugagaggcuggccaccugaugccacccuaaaggcucaacaccucuuuuccuccaccccagcggggugcacucuggcccucaccugucuagcauauccauuuggacugucacuggcugggcuccagcaucaauaccauguuuuuguuuguuuuguuuuguuuuggauauguuuuguuuuguuuuggaaacugggccucaguuuccucaucuuaaaauaaggagauuggguuagagauauagauggcuucuaaggucuccugaacccaaggcuuucugauucuuucauugcuuuuuaaugccugcucuagggaggaaggagcacaucucccccuuggucgugacuugucacaguuccagacuuauagcuguuggguucuaauaccccccagcucucaggggaccaauaaaaaccacauccagucagccugggccugccccagcacauggagacaacuggucucaaagcagcccuucccagucccccuccccacacggccuccuacccacuuccgacucuuuuuguuuguuuguuuguuuuuuggagacggaguuuugcucuuguagcccaggcuggagugcaauggugcaaucccagcucacugcaaccuccacuccccggguucaagugauucuccugccucagcugggauuacaggugcccgccaccacacccagcuaaauuuuguauuuuuaguagagacgggcuuucaccauguuggccaggcuggucucgaacuccagaccucaggugauccacccgccucagccucccaaaguguugggauuacaggcgugagccaccgcacccggcccacuccugacuuuuaaaaagagacaggaagcaaaaacaaaaccaagcacccaagguaggucagaugaagagccaggguuagauaacaagagcaacauccuuugagacuaaagguuugguugacucccuuggagggcccuguguggaagcggaggagggcgggauggccauaccugcagcacugcaucaccagcgucuggcguugccagcgguuuugucuuauuucugcuggcugugcagagugacugccagaauugucucuugcaggcuggaggagauugauggauucuuugcgagaaauaacgaagaguaccuggcucugaucuuugaaaagggaggcuccuaccuggguagagaggugagcugcccugaaguucccugcaauucuuggauagccauggagagagagccccaguuugggagcagggcuuuuccugccaauucuagggucuuggcugccugggucuuuuagccuggcauuggccugaccccugcugggagccaugggaagugcaggagcuggaccuuugcguuucaaaaccuugcuguuuauucuuaucuccuucacggaaaucaaauauaacaccugcuguuauugagcauuggaccagauugcugacacacguagcugcuaauccccaaaauuaaugaaggugaucaaauagcaugcccaagaucacacagcuaguaaguugguagaagagggcuuugaaccagguccgucuggcuccaaagccaauguuguuuccacagugucccacuccaugggacuggagugaaauauuugggagggagggaacauuagcgacgcccuagccccaccggaggaaaugggguccuuuacccagaugccggucugucucauguggggcauccgugagccagcuccccagcgcuuccagcugcagugcccugucuagaaagcagggaugauuacguuucuccguaguauuguugggaaggucaaaugcagcaguuuauguaaagggccuggauugcagcugacacauaguaggugcuuuauaaggauccauuccccucgccuaaugcagagagcucaccauucugccauugguucauggacuucuccauagaccaguugugagcuuuucccagcugcaaaggugggacgugccagugcacgggagauacuccaagucagugcagggagacaggcaugagaguaggcaugaaauuaaacugcacugucagccugagugauuuuccugcugaaacucaacaagcacagcugagagucugagcugaagccagaugcugucuccaggccucucagcccugagagaggaggcacagggguuggggaggggaaagacagcuuggcuuaaggagugccugacccucuggggucccaguucaugccuggggucaugccuguuauguagaggugauaaauggugauuggaaucaggucuuuucccuccccucccaccacaguccuugaguaccaaggggcuggggucccagugguuggagccaagugccccaugcccaugcaguggugcuuagcgugggaccaguggcuaagggcccagguucuggagccacacuaagcugggauuuguagcacaguucaggcauaugcaagcugugugaucuggaggcaugauuucacuucuaagccucaguuucuccagcuacaagauaggagcuuuauauuuauuuauuuauuuugauuuuugugagacggaguuucacucuuguugcccaggcuggagugcaauggcacugucuuggcucgcugcaaccuccaccucccagguucaagcauuucuccuuccucagccucccaauuagcugggauuacaggcaugcaccaccaugccuggcuaauuuuguauuuucaguagagacgugguuucaccauuuuggucaggcuggucucaaacuccugaccucaggagauccgcccaccucagccucccauaaugcugggauuacagacgugagccacugcgcccaaccaggaacuuuauuuuuauuauuuugagauggagucucgcucugucgcccaggcgggagugcaguggcacaaucuuggcucacugcaagcuccaccugucagguucaugccauucuccugccucagccuccugaguagcugggacuacaggcgcccgccaccacaccaggcuaauuuuuuuauauuuuuaguagagacgggguuucaccauguugguaaggauggucuugaucuccugaccuugugaucugaccaccuuggccucccaaaaugcuggaauuacaggugugagccaccacgcccggccugggagcuuuauuuuuaaguaaacacuuauguaccuacuaugugcuagucacuguuauggcauuuuaauaacauuaaccccuucaguucucagaacagccccccugaaguuggugguauuauuauuauuguuguuauuauuauuuugcaaguaaggaaauuuggucagggaaagguuuggugcaguggggccaggauuccaaugcaggcaacuguaguguacggugccgcaucucuuagucuccugagaauagcugcuauuucaguguuucucugaagauaaaugaggcaaucuguguggacacuacauaauaccuaugcaauacagguuagcuagugcuuucucuuuauuucuuucuaaaaaaaauaaugaugacugauguauauuuuucugauucggagucuagauaggaagcuuuauaaauauaagaaaaaaggcuagggggcgccaccugcuccauggugaagagugagacgucaguaacagaaguccgugccugccauuugcagauggccuguccgauuaugcucagaacuucucuucccauuucuaauguggggacauugucaucucaacaaggccucuuguugccuucagagagccccacguuaagaaacguuuucagaucuucuuauaacuauacacauugaccaaagggccccucugacuacugcacauacugggcucagaguuagccugcuguuuagaaguuuacccaauuccaaagguuuauuuuguuuguauccuacccaugaaauuuguuaccauauguauuugaacgcaauaaaaucacaguucuuuaaacaucugugacucaagcuuccauaaggaagacugcucuugcccccaacaauugauauuucaaacaaacaauaauuaguaauuucuaaagggaucuuuucccuuuagaaaaauguuaugagaaggcccuggggaauccuggacaucagagagcagucuuggggugugaaggucuuaaagacaagaacgugcuggcucagugcaaaaaacaaacgagaauuaaaaugaaaccacauuuuauugugcucuuuacaaauugcuuucauuagaaagaaaaugcuacccaguugggacugucguaagaaauuaaagcguguguggcaugcacagcuccaaggccucuccuccugggcagugauuggcacuugcuaccuacugguuagcugcuguugauggcgaguaucucuugcgcaucagugugguccacucuuuguggguuuagagucuggaaggagcacagcugccaucugggugccuucacaggucaccgagcugggacccagcccuggcucccuccacccgguggccuggcccccagauguucugcugucccugcagguggcucuggaccugucccagcacaaaggcguggcggugcgcagggugcugaacacagaggccaauguggugagaaaguuuggugucaccgacuuccccucuugcuaccugcuguuccggaauggcucugucucccgaguccccgugugaguauccugucuccuggcguccccucucgucccucccugugcucauccuuccuucuugcccagaggggcugcccgccuuucacaguggccaacauguucuuucugaagagcccccucaggagaagcugcagucugcugucugcggggccagcgccuccaccgucaggagccugggccugaaacgcuaacccuguuccgcagcucagagaccucaaaggccucagccccccgcacccagugucgccugcacccucauuacguccccaccacagcccuggcccucuucuccacccucuucuguucgcaggcagacucauuggcaggcuacaggccuggcaagcacucguauaugccugacccucccucccuuugguuuucuaauugcagaaaaguucauuagcagccagacaauagccaguuccaaaaugccgagagaaaacaaucaggccagccucagccccucugccaggcuccugcugcugaauggcccguuaauggcaccagauggugccuuggugcccucccugggcagaugauugaugucagccaggccccgcaggcaggagcauugggccagggaggcaaggcuugccuguggugccuggugagcugcuccucggggcccucagugccgacccacacggcgccgggcaggguggccacuuggccucacccuggcccagaucaccugcuagagggcccaggaggugcgaugccaccaaggacagggaggcacucgcuuuccgggcaggcccagaaagugccagugaugguggggagagaaggcauugucuccucucuccgaguugguggaggggaaaauuguuugugacgaugcugccucccgagccaucugcucaccgagaaacccaggaugguggaguggaaugaagccgugcgucccaugccagcucccccggggcagcccucacgcugcugcuggacccggcgucucucucugcaggugcccuggcugugggugagagggaauaugcacucaggagguaucccgugcccuggaggacuccucccugucggaaaaaagaaagaaaccaaaaagaccguaaaaagauuuagagaauucuggaggcucuuugucauuguugcuaccuguuuuuugaaaaaucccauaucaaacucccuggacuucuuaggggguaaugucacuuauaguaccucagggcgagcuuauggaugggcagcugccauauugaaucucgggguccuuggggaagggagucacacuccgccguuccugucugugggcaccgggcugucccgugccuuuccaugcccugccuggagccagagggccacugggggaauucuugggcccaauugccuuaccaggugagguuugacaucaggcuggugucagagaggcuuuccagagcaugugcagugauuagaaggguuacagcgaggccugggugccgucuucuggccucacagaggacaagauggaaucucguucacauauuuaauaaaccuuccuguccgaugagccacccuucuuccucuucugacauugguuagcucuaaucuuguucucugcacuuacugccucuccucccugguucugugcccucacaggcucauggaauccagguccuucuauaccgcuuaccugcagagacucucugggcucaccagggaggcugcccagaccacaguugcaccaaccacugcuaacaagauagcucccacuguuuggaaauuggcagaucgguaaggcuacgccugguucuccucacuucuucuccuuccucugaucacagaccaccacaccuucacacccacgcccucuugcucauucuucuuccuugucauaugauuaguguguacauucugagccaggcugucccccacccuggggucuggccaugcucagggaccuucaaugugugggagcggcauuuagcugcggugccucuggugucuguugcggggccggggcugacuggggaaugaacaccuuccaugcccacgcuccuucagcuuaacucugcucacaaauggggaaucugcgugcaaggacacucugaggccuccagaccaacuucccacccaagcaauuauuugugcagucaauauuuuugaguacucacuaugugcuaggcacuguggcagcagauauguacaggcagaugcauucucugcuugugcagacccuacagcaucccuucuaggaaggcacccaaccucacuugaaugccuguggugucagugaguucacugccuuuucaggucaccuguguguguguccacagucguaagcaugagagagcugcucuucucucugaggcucguugccuuuucuguugugguugggcagugagacagagcuguagaccuccugcacugguaccagcugcauaccagguggaaaugucugaccagggagcucagagcuggccaggacggugccccucacaaggggaugcacgagacagugggggaaaggugauugcaagaaggacuuugcauccuagcaugagggacuuuaaggguggaaagugccaaauggagagacuuuuaguagaucaagggagaaggaaagagagagugaggggugguguaaucauuaugaucauuccgucauuaugaaugaucaucauaaucauucgaucauuacaguuaugcaaaccauugacguucuuguaauagcuugggcugguguaugugccaggcucugugcugggcaccuucccuguguuaccucauucagucauggggccacuucuggaggcagggcacaggaauggagagguaaacugaggcccaaggacagcaaaguggaacacagaggagaccuugcccugaggaggagcauaggcagccacaaugcguaccccauuaguugaccuuauuggcucuuuccaaccucaggagguugucauggaggggucaggagcaagucauguguuuuacaggugagcugacugaggcccaggaaagucaacugaguugcccaagcucacaaacuagcucacagucaaacugaggucagaacccaggucucaagagacaggggaagaggcacccaacuuuccuggccccugccaucagaacccugagccuggaccccagcaugaugggccuggggccagcauggagccuccggcccuuccaugagggcugcggagaggugugagaugggcccaccuaagaugugagguccggcagcugugagcacaucagcccugaaagaaauacaggcccugcuuccccuccugcccccagucgccauuucccagacuuggugggcagcuaaacccuggucuuucagagagggcccaguuuuuccagagccaugucguguguaugaaccugcuggucugauuaugucuaguggucuuggcucggagcuggccugauuagugaguugcaggagggguggcugugggccuggagagagaaaacuccuacucccugccaggagcugcugagaguuuuuuacauuugugcuuuuauuugauccucucagcaacuuaccugugagcaauguguuauucauaucuuacagaugaggaauugaggcucagagaaauuagguaauuuacccaaggucacacagcacauuucuggcagaagccagugguaacuuacaagacucugugaccaucagcagugccccuucucuucucucccuuuagcccuggaugcuccuugcagccccugcaccaugguuaauacuucuuucucucucuaucucccucuggguccucagcuccaagaucuacauggcugaccuggaaucugcacugcacuacauccugcggauagaagugggcagguucccgguccuggaagggcagcgccugguggcccugaaaaaguuuguggcagugcuggccaaggugagcagggccauggcuucccuugucugugcaauucuacggauggucagugugcguuccuguaaggcugggcaccccgucagccccucccuccagaagcccauggucuggcuggacaccuggacccacagcucucccuguccaccauaggugauacccuccagccucagccauaccccacaccagccccacacugccagggacaacccugccccaugcagcagugugggugggacacagggcccgugccccccaccuggggauauuuccagcugauucagugacuguggcucugccugccugaguccucagucagagccccaguguggcuucccaccccuuucuguggucacugggaaagcaggaccccuaggacacccuggcgaaggagaggaugcucuucugauacuccuugcuucccucccagucugacccgaucccuggcccuggccaugccuuccuuauuccuuuauaguuuccccgggaagguggcuacuccacgaaggguagcuccuauuuauugaggacuugauguuugucuaggauuuaauccuuuuaacuacucugcgaggugggugguuuauuuuguccuccccgauuuaagaggcccagggagcucaagugccaugccuucguucugccagccugaaaguguuguggucaggccuugagccugugcuccuuccucucugaaggugagagguggcugccauucccucucugcgcccuucccuuugguuccagauccuggccauugcgucccugcuggaaacccuggacucugcugcucaguacugcugagucagauguggcucugggcgcuucggguuuggccgcuggcucagccucccuuggcccuggggcccggaucugagcccacccuccucagugugggucugcaggaagcuggggcugcccucgggugauuugugccucuccuugggaacuuccugccagccugaucccuccuucccaccucccuguccuggcccccuggcuuggucacaugaaugcguggugacacugagagggccugacagggacauuucagccuaaggcaggacagucguuggccccucacugaagucccaugcaaaaugagcccuuguucuucaguccauugccauaauagagaccuuuccuccaaggcugagagcuguuugguccucacagugcagaggccugggguugacaaccuagagacuuagaggggaaaaauccagaacugacccacguacagucccuccuccugacccaugagggagagcacccagcaugcuuucccggcaugccucagacaccccaccacccuaguccaguacucuccaaaggagucaccccaggaagaucggcuugugugucacucgcaucucucagcugugaucaaaccugcuauuuucuuuguccccaguggggcuguuugcagccgguaugggggaaaagaaugagauacagaaaagucccugagcugggcagaggcaucacccccucugugccugcugagucucugccuucagcaagggcugggaaugagcuugagaugaaggugccugcccugccagagccagggcccucgggguagggcuggcagugggguggaggacagagggaagccagguaugccccgcaguagcagcagaggcaucgggggcaugggccuggagacccucuguuuggguuuugcccgcacauccccuggggucuguagaguauucuggcccuugccuugcuuggguagcuucuuccugaauaguaguauccuagcagcuaucauuucuucagcccugccggugccugcaguguucuuuguauauuagcuccucauucuguuucucagagaagauuccacagcauggcuucuaguaugaucuccguuucauagaaggugaaacaaagccccagagaacuaaagcaccuugccagggucuuccagcuagugaggggcugggcagggagccacacccacucgcauccagcccaugcccauuaccaccaagugcauggugcucacaggcccgaaccccuaagggugccaguggacacugcuggcucccccuggcuagcugccagcccugcaggugcccggucagucaggaggcccucugcauguccugccggugccuucccacccggccucucccagccugugcucccuccugugagcagcugguaggaguggccacuggguggcgugugggcaccaggguuuccuugcucccaguuguccagagcuccuuaauucauccauccuucuggcacugucgccuuagaaggcggaaguuucuaagucaggaugauggcaaaggucagugagaaaugcugacuucaagcuguaaauuugugugugaguuccagaggcccgugugggcucaccaggagggcacgugucaaagcguggucuuuuccggccauuucucacucugggggaagguguccagcccaacguuugauaggaauauuuaauggcuuucucagaggaauggaucuguuagcagguuuuccuguucaguuaccauucgugucuccaguauccuucuccucucaaauguuugucuuugcuuucuuugcugugauuuucucaggguccucauccccucggccagccucuuugugguuuuaucugaucagccugcugcugugucccucuuucuccugcccuccgccccuugugcugugcacgugcacacacgcacacacacacacauacacacauauguccuccucccuggaguccuugugguuuuaaagugcugauacuaaucggauuugaguugacuuauugucagaguagcuuuucaugcuccucagauaccacugggaguuaccaucaagaucuggaucuuggcugugagccccuggccuggcugguccucacuggcagcccauggaauccaaaugaaaggucucgugcccaccuaacccagcuggccagucaguuggcaagucagcucuauccgaggaccacccaaagacaggacuguguggcccagggcucccagcagcccuggcaaggggcacaagugcuccagccuuccucccagugguggcacauggucggggggugcugcacaggagccugaggucugagagagggagacuuccaggaccccaccccauuuagagcgagcaccuucccuacccugucuucuagccuuaccaggugucccagagcaaagguaguacagaagucauauuugugucuuaguuagaauguuuuccuggugguuuuggaacuuugcacaaccuccuccccacugccccccgccccccgccccccgccuucuucugcauagcuuccuaccaucugcaggacggggaacuuggggaauugcuuuucacucuccagcuuccgcuuguuccuccccacaguauuucccuggccggcccuuaguccagaacuuccugcacuccgugaaugaauggcucaagaggcagaagagaaauaaaauucccuacaguuucuuuaaaacugcccuggacgacaggaaagaggugagucugggaagcaaauaaagaucucuccauccuccguauuuaugagagugcaagggguuaacccugucauuucugaccuucuucgccaguuugcaccagggagucagugaucuucguuggguccuaacaauaaucaauaaaugacuauugauugagcucucuaugcgcacaucucauuuaauccucauaauguuaguggaagguagauauucuccccauuuagcagaugaagaaacaguacuuugaaaagguuaagcaacuugucuggguucauggagccaguaaguguuugggcugggaugaaaacuuggugagaccccagaguuuuuaacaacuacccugugcugccucuuaguuuguggugcugcucagcauggccucccuggcccucuccagggcaccuucugggcuccugcucaugcugcuauuugcaaaagugggucacugcagccagcagagguguaaaacccuguagacuuguagggugucaaaucucgaagggaccucagagauaacccccuuguguuacagcuggggaaguugaggcuggaacgggaugcagcuugaucugggucacagcuuuuuaggucugcugcugcuucaguggguggaacuggugaaagggaaaugccaccuucgaggugauagacugagggaccucauuugucuuagggcugucuccuagaagcuucugucucugccucucccauccuuuuccuucuccauaugugcacucacacucaugugucccucagggugccguucuugccaagaaggugaacuggauuggcugccaggggagugagccgcauuuccggggcuuucccugcucccuguggguccucuuccacuucuugacugugcaggcagcucggcaaaauguagaccacucacaggaagcagguacguccaggacccguucaccccacugugccuccaacccugcucuguucggcccuccaaggggagagggggcagggaagcucccuugaauugccccacuggcucccagcugccagaagauggggagagucagccuuggggcucuggcuggauugcucuaucugcagguagccccacacggccagaauagaaccaaucccaggagggagcagacuuuaggaauucaaccaguccuguuuucggccccgggagcucuggggcugaggcuucucccugucuuucuccgggcuuauaguuugcuuugcuuucagucuucaugaaaaaauugugauucuauuuuuuuauacucuuaacaaagaaaaaaacguguauuuuacaguuuacauagcugauacauagcaggugcuuugagcaauuuuauugcacuucccacugaaaaacaauuuccugggggaaguuggggaaacacguuuccccugcugccucggauuguccacaaacugcaccaccauguucuccggccacgcugccccacaccugcuuuugaagacugaaaggaugcgcauccaauucaguccacacugauugaggaaccagguuuauaccaggcugcggcuuggcuuggaggauagauacaugggugaaaagggcgacagugcccgcucuugguggaccucuagugugaggcagggggacagagaggccugcagugcaucagggcuagggccgugguggagagaaagauguggggugaagagagggcaggcucgacgccauugggaaggggcccgaggccuuacggggugaguugaggggugaugggugaguagggauuccgccaggagaggagcaucccagcagagggagcagccuguguggagccccgugaaucagaggaacugccaggcaguggugugggaagccaguguguauggagcaucuccaccaugccauguggcgcugcaggugccggggacacagcagcauaugagacaggucccugcccccacagggccaguaucugaguggcaggagacagacacagagggauggcuucagccaugaugacgaaugcugaggaagacaaagcaaagcagugccggagcgggugcugucuggagaggggucugggaaaggcuucccuguggagggcccggugcugggacccauguggagaggagaaggcagugugggacgucugggaagagagucucccaggcuguguugguguccuugggcugcacucacaaaugucaggcuggggcucagccaguagacgucuguugucugaguucuggaggcugaagugcaagguggaggugucugugcugguuucuucgagccucuccuuggcugggcgguggucgucuucuccuugugucuccgugcaguugucccucucccaauccauguccaaauuuccucuuccugcaaggacaccaguccuauuggauuagggcccacccuaaugaccuuauuuuaccuucauuaccucuuuaaagacccugucuccaaauacggccacauucugagaggcuggggauuagggcuucaacauaggaauuuggggggacauaauucagcccauagcacaggcuggagaccagcaggugcaaaggacaagccuggugugugggcagcacugaaagaaggcugcuguggccggagggagggaggugaggcugcagagacaggccgggggcggaggugagcgcucaugggcucagaggccuuggcgagggcaggguuuggagguugguguuggcauuuugagaagccacuggagaggcuaacggaagugacaguugguuaacacuuuagaaagguggaggaugggcuacugcaggcagggggaggcagggcagcugaggagcaagcugcaugcucgcccagcaguggugguugggccuggacuaggguugucagugugccccuggaggaaguggucagauuuggggauauguuaaaggcagagcugagggacuuacugauagauuggaggaaggguaugugggaagcaggacucggguggacuccaggguuguggggccugagccucugguggaugauggucccauaagcugaggagucaggggcucggguugggaugguggaaucaauggcccgcuuugugucaauagaccucccaauggaggugugcacaguugagucuggaguuccagggagagguggggaauagagagauuagcuuuauagucauuaguagcaucagagcucaagcugugggacuggaugagcucccuggcagggagguagagaagagugcugaggacugaauccugagcaucaaaccaccagcaaaggaggcugaacgggggaggccauggugauuucaagggggccccagaguccaguguuucaagauagagguguagucacuggggccagugcagcuggagguggcgcaagaugaggacaucucuagcaagggcugugucgguggaguaguggagguaauggccuuguuggauucggcugaagagagaccaggaggcaagauucuggagauaaugagcaggaacuggggcaugacuggguuagagggaacuucuuuaugaucauccuuuuccccaguuggaaugaucccuuaucaggggauaaauggaugacgcaguaaagaaaaaacacuaacgggagugaaauccuggaggugaggagugggguaacccgagcagcagcggagacagaggcugagcaacgccagggccguguggugaggccuugugguggggaggugggcaccugugcugggugcagaagaacaagcugagaaggcagaggagagagagagaggcaggugugggcugcugcgggucucaccuugccaggagugaggagaguagggugccaacguccugcugcguggagggguaaaagcaggagauuggcuucuaaaggccugggagguuugcgguaggaaggagcgagcuuggaggcaagcaccagcagcccuggagccugagggugaagggcuuaggaggggcguguuggauuaggagugguguccucagcggggagccugguuucaguuagagcaagaaaguggggcugguuaacaggucuuugcugaugccaguccagaggguccagugggugggaggggguggggggaauggaaggggagagcgaggagagauggagacagauuaggaagggcaugugcaggccagguccaggcccgagggaggugacgcaugguggaagcaagucggacaggcagcaugagugggcaggggaggaagggccaggggcuagggcgguggcccucuggccccugcugaccucucucaccaugucacaaagagccugaguuuccugccaaggaguguggacuuuguccugggugugagugacaggcacccagguuaguggcagggaaggggauccagguuuaggaguuuuggggggauggggucuccuguaaagugaccauggcagguagagaaguagacaaggggacacugggccucugcuggcauaggcugggguguguggcaccugugcagggguggccacggcaggauggggggcggcaggguggccuggggaggcaacggcuguggggcuggcagccugaagggcuggugcguggcaucuccucugcccuguagccaaggccaaggagguccucccagccauccgaggcuacgugcacuacuucuucggcugccgagacugcgcuagccacuucgagcagauggcugcugccuccaugcaccggguggggagucccaacgccgcuguccucuggcucuggucuagccacaacagggucaaugcucgccuugcagguaaggaaggaccauccccaaggcuggagucacuugugggggacgagggggugaggauacuugggagucuuaggccaaaauuuggggaagggacacucauuguccccucagucacagcccaggccuguuaaccaaugccaguaucaucagccccauuuuugacaugaggaagccaaggcuuugacacuguaagacccuggucuucccaugccguugcucacuuuuucccugcucuagggccccucucuagccuacuggggucccucucccgccuccccugcuccgucuucuggcuguuggccccuuacucaaacugcuagggcagagggagcugggguucucucucccugggaagggucugaugagagaaggggcuggaggagaccaggucguuccuggaaauaccaggcaccggcucccaggagggagccuugcccucugcguucccucauuauggugcuuccuuuuccucaucaggagucugauggcucuaacaggcaaacacauuaaacuccagggagcugggucgggagggagccaucuguggacaggaggcgguuugugugucgggagggagcggugcacguggcugugacagccucccgggggggggagaccagggcggagccgagguuaaaggagcugaauggagcaggugguggugcaggcgccugcacuuggucguggucuccuggggccuccuaucgaacuuugaaaggaagacaugugccugucuucuccuucccccaccccgccccugccaccaaaugcuccauuugacccuucagccccuugaccucggcaggcucccagcugcugcuggagggccaggagccugggccugucccugagaggccagaagcagggugguucccuccccucucuggugggguccuuucagaagaaacucaaaauuaccaggcacaagcugagagcccccuccacaaggccugaucacuaugacucaugacuggacccuugacucugcuuguuguccccuccccaaaguaaccauucugacuugcaugccacuugcuguugcugcuccugcuuccuuguagucaacaacuugucccccuauuaaaaccuuuaggagaagugcuucuacagaagggaugggcugaugcauucccugggcaacacugcgugaggggcugguggccguggcucacccucugggacucauccagaggcugccuagagggcugggcccaccugggguaccaacagccugcagccccagcagcauccugacucuuccaaguaccccucaggucuccccccaacuaucccuuggagcccaccccuaccccagagggcugcugcuggguaaaagcaaggauugccaugagcagcugccucuugcuugaaaacgcauuuucccuugaauugacaaaguaaccuauuugugcaguuuguauaauuuggaaaaugucagaaaaaugcaaaaaaagacaaacacgagcagaccgaccaaagacugcaaaacagaucaaaaugaguauucuugcccuuucccaugucugguacugggguaaaggcugguuguaaaguccacauagcaggacagugggucuggccaacaccgggaaaugacugagauggcgcucuucacgcuucccuggaaaaccacggagggccggggcugagggguagguggaucugccuccuccuccaugcugccaucuguugagcucccacugugggcuaguguuuguaaucuguauuuucuaauuacccauccucuggaagggcaguggcgagcccuuucugcagacaaggaagcuggcguucugaguggaggaguguggucuggguuuuugggugggacugaugucaccaccagccuguguaugcuucccucuguaggugcccccagcgaggacccccaguuccccaaggugcaguggccaccccgugaacuuuguucugccugccacaaugaacgccuggaugugcccgugugggacguggaagccacccucaacuuccucaaggcccacuucuccccaagcaacaucauccuggacuucccugcagcugggucagcugcccggagggaugugcagaauguggcagccgccccagagcuggcgaugggagcccuggagcuggaaagccggaauucaacucuggacccugggaagccugagaugaugaagucccccacaaacaccaccccacaugugccggcugagggaccugaggcaagucgacccccgaagcugcacccuggccucagagcugcaccaggccaggagccuccugagcacauggcagagcuucagaggaaugagcaggagcagccgcuugggcaguggcacuugagcaagcgagacacaggggcugcauugcuggcugaguccagggcugagaagaaccgccucuggggcccuuuggaggucaggcgcgugggccgcagcuccaagcagcuggucgacaucccugagggccagcuggaggcccgagcuggacggggccgaggccaguggcugcaggugcugggagggggcuucucuuaccuggacaucagccucuguguggggcucuauucccuguccuucaugggccugcuggccauguacaccuacuuccaggccaagauaagggcccugaagggccaugcuggccacccugcagccugaaccaccuggggaggaggcgggagagggagcugccaucucuaggcaccucaagcccccugaccccauucccuccccucccaccccuugcuccuugucuggccuagaagugugggaaauucaggaaaacgaguugcuccagugaagcuucuugggguugcuaggacagagagcuccuuugacacaaaagacaggagcaggguccagguuccccugcugugcagggagggcagccccgggcagugggcauagggcagcucagucccuggccucuuagcaccacauuccuguuuuucagcuuauuugaaguccugccucauucucacuggagccucagucucuccugcuuggucuuggcccucaacuggggcaagugaagccagaggagggucccccagcugggugggcuggaauggaacuccucacuagcugcuggggcuccgcccacccugcucccuuccggacaaugaagaagccuuugcacccugggaggaaggaccaccccgggcccucuaugccuggccagccuccagcuccucagaccuccugggugggguuuggcuucagggugggguuuggaagcuucuggaagucgugcuggucucccaggugaggcaagccaugguugcugggcuguagggugaguggcuugcuuggugggaccugacgaguugguggcaugggaaggaugugggucucuagugccuugcccuggcuuagcugcaggagaagauggcugcuuucacuuccccccauugagcucugcucccucugagccuggucuuuuguccuuuuuuauuuuggucuccaagaugaaugcucaucuuuggagggugccagguagaagcuagggaggggagugucuucucucuccagguuucaccuuccagugugcagaaguuagaagggucuggcgggggcagugccuuacacaugcuugauucccacgcuacccccugccuugggagguguguggaauaaauuauuuuuguuaaggcaagcauugguguguucuuuaacuugcuacuuggagaccuaguguccagucuggacagaaugcacagagaccagccucaccuggaaugcagccagacucgaugucccucagcacacacagcuccuggccacagacugcccauagaacugucugcacccaaaccccauggccuuuucaugcacggagacaggccucuggaugugcagccuugccacccccugccccaauccucccugagagcuccugccucagugcccugggcuggugagggagaagccugucugcaccugccuaauuccagcuccuccaggaagcaagggcuuguuugucagagcugcaggguuggccacucgguggggaggagucagccaggauuagagagccugccccuaauccggccugcuggguuuuacaaggaucagagcugcugauaaugaaccucauuaagggggagcaggagccucaauccgauuugguuuucucuuugacaucuucacucugcucagauggccugggugcuauguggagcaggugggaugccaaggccacuccugcuauggggcagcuggggcuggggagggauggcagucucccugcauguuucccucgaccucuuuagcugcagcgccuugcugggcuccuggguuggacucccucucugugccccugcuccaggcacccauuggcuccauccuccugguugugcucugcacccccugcucccuugggcuggcccuggcugggggccugagagacagacaggaacccacaaucaggaggcaacccuggccugcaagaggaagacagaggcucccagggccggugcccugugugcccacugcaccaaggccgcugaauaagccugcccuucacccccuaagggcuccuugcccaaugccaagugcuggggauuucugucagcaagcccuguggcuccagugacgguauuucuaaagccaaacuuaguuaccuagaauuagcgccauguuggaaacacugucgcagcagcccgggcugcacaguguguagcccagccuccagguccacggagugguguggaccucccaccucacagcugccucuggcagccaagccucuuuucgcccggccccagccccucugguugauaaacgggugggccuccucagcagcguggcugccuuucaccuugauuuccccagggcucucggcaacaucgauaaaccagccucgcccaccagcugggcccucccccacccagucugccaggcugggagcuggagcuugcugagucuugaaugcccuucuagauggcuucucuagaggcucuccuggcaagagagggucccaaggggagcccugcaaagcaaaggcuccuugucuggggcgggauagagaaucucgccucugucugguguguuaccuacugggggcacaggaacaauuuccucaaggagacagu

SEQ ID NO: 12910 - RNA, 1776 nt, Homo sapiens
uacgccugaucgccagaugaagaagggacacuucuccgggcagcaaaggcuagagguaucuuaccucugcaggcuagaggagggguggaggaggcgggaggacacuggcacguaaggaaggaaauuccgucuucagcaggcacuggugggacccgaaaccuagguccccgaaaagccucagaacccagggagguuccccgagggggacgccaagcagggccaagacucuccgcgcccggccccgccucucuugccgccaccggggacccgggaccgcggacagagacaguugaggcugagcgagacuccgcggucccagccagguccuacaggagcucaccugagagugucgccuccgcccucggcuaccacggugcaucccgcggagccuggcggagggugcagugacgccgccccgaccggccccagggcugcccggccuggccuccccgcuccggggacgcaccgggugcccuccucgcaccggcuccggggauccgccgguccgcugggaaggaagacaaggcggaaaggcugccuccccucccucagggcaagccaccccccgagcugcggcucccugcaguucucucuggcgcaggucuggccccgcuccccggcccgggagucacuucgucaggggcggcccagucgccauuacagcccaacaacugacacggaggaggagcggcgccagcggcagcggcuguggcggcggcgcgaggcagggcgggagcagucgggcccaggcaaaccucgcgagaacugucccgagacagugccacaggcaugccaaccuucgguuagggccauguugaguguggccgaaaggugggagcgaaauaaaacaaggagcagaaccgcgaagaagccauguuuggugcgucgaaguuuaaacucguaggacuugggaggagccaagguauauccgcagaagagaccaccccugcccuuucgcuuugacgcucauugggccuuuuggcugcgcauuucaccccgggcugagaaaacaagcuggggauucgacaagaaugaacucaaagucuggaaacggcagcuucugagaguuuacaauguuucaccaacugucguccaaauaagucgucaccccugucagaguaguugcagcucugccguuacccacugcugucacuguggccguuuuauucgcgaggguuacaguucuguuuagcaugcaucuaaugacuuaagacuccacgcaaguaaaacggaguuuccucccauuaaguauuggcuuugcuuuaacagugcuuugagaggcucucuguggccaacauaucuucucauaucuuuguccucguuucccaaucuccgcguggugaaaucaucuaucaagacuuggcuuaaaggaccucucuucugcaaauaaugccaucuuccgcuaggugcucacugcacacagacucgccgcccaccacuucuguccaccuucugaacuccgauaguuauuuacccagagacuguuucucaucuuuaagugucgugaagacuuuaagaucuguuuuaucucucuauaccccaaaauggccuagcacaguaacuaggacauuguaggugcucaauaaauguuugucgaauaucaaugacagcaggaggcaguaaauggucccucuuuguagggccuacagcugugccugaguaggauguacagaaguccugcauacgugugaagugucuccaggaagcugcacuggaggggacaggaaauguggguaaucguauggugcaagugguagcaaaaaagacaacauaagg

SEQ ID NO: 12911 - RNA, 454 nt, Homo sapiens
uuuucuuauagauuuuuuuuuuuuuucucagccaggcgugcuuuauggacaaugcgcuccucaggccuugaccgcguacuuccccagcggguacagccgcuccuuccgcugcugcuucuuggucuucggguucuccucaugcuuguugagccggcggcgcauggcgcgugucuucuuaggccgcagguccaggggcuuguaguuccugcccuuguagaauuuccugagguuuucuuucugagucuaguuaauaacagugagaacacaggcaauggauuugcggacgacucggaucuuagagagcuuggaggccgcaccgccugucacuuuggcgacgcgcagcugggacagcuccaccuucaggucguccagcuguuucagcagcuccuccuucuucccgcgaagaucucgagccuugaucuuggccauugcugcacaggccgccgacgccgcc

SEQ ID NO: 12912 - RNA, 20485 nt, Homo sapiens
caaauucaauuugaaauaacuuuuauucaauggaagaagcauuuucuauuggcaaaacuagagguuucucccuaauuuucugucuguauuuuuauaaauaaaaugcauuauuuggcugaaauuuuaaaaauauuuuuuucacuagacguuagagcaaucuuagauuuuaaauaaauuguuaaguaucuugaacauguuauuuaugauuuaaaauauagcuaagauuugcuuuacauuguggcaaauauuuacauuuuagaaaacaaacuuuguauuuagucaacauaauuuuuaaaauaacuagguuguggauacacauaauuuucugcaguaauugacgacagaugaaacuacauuuauagguucccuuuuauaguuacgguaaaauucauuuuaaaaacuuucuguguagaaauaaauugugccaaguaauauacauguaacauuuacauuuuuaagagcugaaaaguacaaaguucugugucauuuaaauuggcgagugucucucuucagucaauaggcuugaucaucaucugaacugcucuuaaggaguaugacccgccucuguauucggcccagaaaauuccaucuuggugcuugcuucuguaauggccuccucuguaccauacuccauuuagguuagaaugugcacaggcauuguaccaccagccuccuuuaugaaagugggcgcaguuuccuuugaggaaaaaauacagauauaaauguaaaaguuucuucuaggugugguacucugcaaucauaaaaaacuuauucuaccuuuaauuugaacuucccuuacuaaucccaguuaccuuuaucucagcaguuuuaaaugccuucacuuacuugauggcuguugcaucaacugcuugaaaaaucacuugaauugccuuuuuuuaacucuuugcuugcuuacaauguacuuuuuuaaaaagggggauuuaauuuucuaguuagcagaguagaugcaagcaguguuuauaugugaaagaguuacagagggagaaauugggaaggaaagauacagaagaagauaaaagucugaggaaaauugaauugucaaaauaaaauagcaaaaaauaauacaaaguaaaauaaaaccagcagucaaauggguuucuguaaauaagacauauguuauggucuaucucuccucuuuucucguuuaccaguguaaaauugguuaaaauagagaccugugugcuguuugccaaaauacagcuggagagaaaaaccaguuugggacagggaugggggagaauuguuggguggaggggaggaggggaucucuguaucaggacgagaagaaaccuggguuaaaaagucaaaagcauaugaaaacuaaauuugaaauuauguggauggucuaguuguuucuuucuaaugaaaauauuaauuuccccuuugaaucaagcuuuuuuguuauuccuaugccacaugucacagucaucuugguuuucccccucaaagaaaugcucuuacaccauguauccaaauggcuugcauccuucauuucuugcgacucuuuauucaaauguugcuuucucacagcagauuuuccuggcgaacccauauaaaauagcugccaucccaggccuugcugcccaccacuuucuauuuucuuacucaguuuuauuuuugagaguacuuauucccaccuaacaaauuguuuugucucuccuccagugaguaagcuccaaagggcgggaacuuuguucacuguuauaucccuagcaccuacaacagugccuggcacgugguagguguucaguuaguauuuguuaugaauuguaggcacuugcauuuuauuuccagauuaauguguuucuguuuugcuuuguguuuuuuucccagaacuuuguuuuucacauagaucacacuuugggauugccuuauagaagaaauccuaaaagcuauuucuuucaguagguugguuguauuuccugccacagugaccaaaacugaccuuuuugaaaagacuuuaguagcauauauauuaguagauucuauuuaaugcauagaaggugaugauucuacaaagaaugaaaguuuuucauacuuaccugcauacauaucuuuaucucuguccaguguggugaauuguuuaccauuaugccacaucauagaauccccugcauuucccugguaaguucccaggcgcagucuauagaauucacuuucagguuccagacgaaagcugcuguauucugcauagacuuuuuuaucacuccagucuucuaauucaaucaauaacuuguaauuaucuugauugcuaagcauauagauauuuuccaguccaagccaguauucuccgucaauguuuccaaacccuuucuguuaauaagugaagaaacaugagugcauaaauaaguauagagauaguaaacauuuuuacagagcaguguuaaacauucgauagcauaaagauacuggccauuuaagugguaaugugagcuuccauuuuaguuggucacuugcguuuuauaagccacacauugucauucucuuuuuguuuguuuguuuuuugcuucugauaugucaguauucauuugcauagcuagcuucaaauccuacaaauaagacaaugcaaaugagaauaaaauuuauccauagcuacuaaaaauauuagcuaguauacuacccagauccuuaaaaaggguuccuggucucucucauauucaucuaaagagcccaacauuuuuuuccuaauaguaaucuuuguaaaguaguaaguauaagucauccagacugaaagggaucauuuaaaaguauaucuucuguuuccuuuuugcaauuuaauuuugacuuuaaaaccagagaugagaaucauuuuuuugacagauguagauaaugaaaaaacauauggauaguuauuuuuaacugugugucuuauuuauugcauagcaucuuguuucuugcauuauugcaagaauggauuuguuuuacuucccuuaggucugcaucacugauuuaccuuauaauuuucccaauuucugaagaaguugacagagccgucuguucuuuucugaauaacaguccaacccccaggguccaaacuguuuucacaccauaacugcauugguccauugcuguuuucagguuuaaucauauaaaucccacugaccgaaugcccagcuucuuuugcuugcugacagucuuugaaugguccuauaauuuaaauaucauuuauuaucagcaaacuuaauaugagaagagacauguuaaaaguuuuuaaucaagauuuuuaccuuugugucuuuguuuacaguuaccauuguuuaucauauauacaauauuauaaaauauaacuaaauaaaagggugacuccaguucuaucuggaacauuaauuuguuucguuuucaucuguucuuuucuuuuccauauauguauuuuuuauauuguuauaauccuaauacauguagaaaauuggauucugucuuaacauuuucaugcagcuauagucuccauucuagcugcauaauaauccuugacauugauauauuuuuauccuucuaucauuggacauugagguuuuauggauuuuugcuauuauaaaaacacugcacaaagugucuucauucuuauugaauucauuuuuuaauauuauaaaaaugcugagggaucgaucuacuggaucagaggauaucaguuuauucauaguccuacauaauacccaaguuacaguuuuggaaauuugauuucaguggaacauacuaguaccuugagauacucauugcaaauggggucagucaaauaaguuuuagaaaugcaaaauauuauguuucccuuuuggaaauucucaauguacauucacauauuaaagacugaaaagcccugaaauaaaccagaugcccaaacucauagaaucuuaaauuucccccaacaacacuuacuaacagcccaugagaauacauuucaggaauguuagcauaaaugaguaucuaaagaguuguaucaaucuguaugacuaauaguaauuuucucauuuaaccuacaguuaccuggugauaguugauagauguucuagagauagaacgauuaacuaaggucauguaucacagaagaugguaaacccuagauagacauaaauccuugucuaaucccagagucccugcucugaacugcuguguugcaugcauuugcccucauguuauuucauaauuuuagguauucuccauuuuuaauccacuaauaauuucuucaaauuuuacaagugacaacacauuuugugaaauuacuuuuagggugucugacucuugaacuugagauuuccacauuuuuggaucaggugaauaucauccuucuccaguguuucgagccuuuuuuauaaacaugcaaaauauauuaauggauuuagaaaaaagaauuacccuaaagaucucuuagaacaaaaaauguauaaaaauucugauugucaaauuuuauauuuuacuagaaauaugugagaguuuagucaaguaaaguucuuaacaagaauuucuguacuauaaggauaauaggauuguugaaauuuugagaaauguguuaucuauacuuugccagauauguacaguauuccuuuugggucuuacugggauagaauuaaucucauuagguaguuacacaacuauaacaauagaagggauucuuagagacuaugaucucuuccuuguagauuguuccgugaggacagagacuuuuuuuuuuuuuuuuuacuucauaucaucaguguuuaaacccuuaggaaacugucuauaauuuuuuguugauuaaauuucucauuuuaaauacaaggaaauugaaaaguacacgcaaaaaucaagaggacaucaguuucucuaguccaaauguuuauuauaguucauugauauuuuucucuuaaauuuuuaaaaauuauaaugcaauauccauaaguaguacagacuaguaaaaauuugagaaacuggaaagccuuauuuauggugucuuuccugcguuauauuuauuuuagguauuguauuuuuuaguucuagaguugcaauuugauuuuuuauaguuuuuauuucucuuuugagaugcccuaucuuugcauucguuauaaacauauuuuccuuuaagacauugaaaauagcuacaaccacuacuuuaaaauuauuguccuuucaguuccaaguuugcugagaguuuuuaucaugaauggauuuuggauuuuuucaaaggcuuuuaaaaucuuuucuuuuuuaauuucuuuucuaacuagacacaucacaggaaucaaaggcuuuuuaucugccuauugagaugaugauaggguuuuucuuuuuguuguuuguuaauacacgaauuacauugaauauauauacauuuuauauauaauaucuaauauaagaacaaaaaaguaauauauauaagaacaaaauauauauauuagaacaaagaauguauaaaaauucugauugucaaauuuuauauuuuacuagaaauaugugagaguuuagucaaguaaaaguucuguacgauaaggauaauaguuuuauccuuauaagaauuucuguacuauaaggagaauaggauuguugaaauuuugagaacuguguuaccuguacuuuuccagagagagagagauauauauauauauauauauauauauauauaugguuuuggguuuuguuuuuuuuggagccuguuucccaggcuggagugcagugguguagucauagcucaccacagccucgaacuucugggcucaagugauccucccaccucagccucccaaguagcuaggacuacaggcaagugccacccugccuggcuaauuuuuuuuuuuuuuuuuuuuuuuuuuuuuuuugagagaugaggucuugguacauugcccaggguggucuugaacuccaggucucaagugaacuccaggucucaagucggacuucagacucccaaaguguugggauugcaggcaugagccacuccacccagccuuuacauugauuguauuuugaauguuaaaccaacuuugugcuucugggauagacucaacuuagugaacguauucagagcccuuaacacuauacccaacaaaguagucaucaucgguaauuguuaguuauuucguuucuccuuuauuccucaucuuaacacauaauuguagcuuauuuaauaaaguagcuuauuuaaugucugcuuauuuaauaaauuuaauauagcucaucaaagaugaauguacagucauuucuacugcagauaaauauuacugaaaaaccucauguucugcaaauucaugcguuaaaaauaguagccaauuuuagcucuuaacauaauuuguauucagcugcaguuaccuguggcacaaaacauuaaugugcuuggaaaaaaucccauguaaaccaguauaaccucucuguuuugcuaccacuauucuccuuuucacuagucacauaugggcuacuucacauuauagaaacaugcauuguagucaaguaggaaggaaggguaaagagccuauauuucagaaaagaugaaauuuacagaauuuuaauuucuuaugugggagugagauggaaggaaaaguaaauuaugacucccagguucauacuuagauuauugcguguaaugcagguaguauauuuguauacuuacaguauucauaggcaaggacuuuaucuuucaguauguauccacaguuugagcccacuuaggaauucagauauguagauaugaaacuaugugauuccuaguaggcaugguucccagaauucccuuaguucugcauuauucuuucaagaaaugucuuuucugcaucuacuacaggcuaaggacuguuuuaggcucaagggauaaagaaacaaccuuagagucaaguggggggugggagaagucacaagaaagagagaauuccacuauaauaugacaaguacuuugauggaguuauguagcgcacaugguagcaaagucuaagaacuagcugagauaucugaggagcauugcucuuacuuuaaaaccuauuaguauuauaguuaaugcacacaugaaaguaguuuuguuacaacauauauauauuuaucucauuuuauaaauuugcauauucuguaaauguuaugcuuauugcuuauucuaugaauaucauuuucguaaauguuuacucugcauucauuugaguauaguuuugacaguuuacauuuaaguauauauucaaagguuggacuuuuauuagguuauuugcuuugcugcagaauauuuagaaacaucaguguucugaauguugacagaauauuugucaaguaucauuuguuccauagagcuauacucauuuuuugcuauuuaauagacacucagauguuuaaagcaaaauagagaguucugguuuucugaauccagcuuugauuucauaagacuucaauuaugcaaauuuaagauuaucuucagcuuuaauuuucaacccauguuuugcagugggcuuuguguuuacaguuggauaucuguuagacuuagggaaauguaguugaaguucuuuuccagaacauauggauaaaauuuagcagugccuaaagcuauuuuuuucuccucaguaaagauauuagauaucagaauucaauauuuauuuguauuuauuuuuauaaacauaccauuaaccugucuuaguccaguguauauuguugauccuagcagaaauauuuucucauuauuacuugaaaaucuuauuuacuuucugcccuaaaauuagauucucuauugucccuaucuuaaauguuuucacugcuuuuucuguaccauaaagaacauugcuugaaagaaauuaaugacaaauagaaaauuuuaagcuuuauucuugagaagccagauuuaauucacagguuugcauauuuucagaaauaaauugauugaucugugaaucaggaauuuguucaugaugauucaaaagguauaaacuggaauuaccuuucuuuuaaacuaagcauaguaucaacuauuuuuugcaagagucuucucaaagcaggcaacuggaauucuguacauugaauuugaagaaccagucucucuguuccucaauuuaugugaggauuaaaguuuacauagggcuaaugaaaccauauuaauaccucugauuuauagaaagaaaaauguugaccagucaugccacauuauuucccaagguguauuuauuaagaacccauauuuugaauagaacagugaguuaaaaaagaaaaaaggauuucacacuuugaauagcagcuuuacugggagccaucuguaacauauguguucuuuuucuguaaaaagagcuuuuacaaagagaauuacagauuacaaagagaauccuuuuuaugacaggagaaacaguaaaccaauucagagcuuucaaauuauugguuaccaaguaggaucuuuugagagguaaacuuuucaguuggguugugcauuaacuuucaguuaaauauauucaacauuucuggagugggaaguuugagacaaauacuuucugaagugacaguagggucuuucuguaauaauaugaauuacuuaguuuauuaaucuguauguuuaaacuguauuuagcaacccaaacuuuuaauuauuaaagaauuuaucaauuacguucucauaacuggcuaauacagucauuuuccaacagcaccuuggcuuaacuaguuuuuuuguuuuguauuaaauguuaguauaaguauuccauugaaaccaauuauaccuaaaaaguauauuaagaagcauuauaaauaauuugaaaaauguaaauauuuggugauuuaaaauaagccuaccacuaaaaagcauauuuuuaguuucuaaugacuacuuuccaaguuuaacuuuuuuuuuuuuuuuuuuuuugagacggagucucgcucugucgccaggcuggagugcagugucacgaucucggcucacugcaaccuccgccucccgaguucaagcaauuuuccugccucagccucccaaguagcugggauuacaggcgcccgccacuacgaaguuuuaacuuuuuaagcuuaccauuuauguccucauauaccuaauaugacaaggaaagacacauaaagggaaguguacaaaauaugcaaugauuaaugguggucaaaccaugccacaucauacacgaagcacuuuuuuuuuuuuuuuuuuuuugagacggagucucgcucugucgccaggcuggagugcagugucgcgaucucggcucacugcaagcucugccucccggguucaugccauucuccugccucugcccgcccccccccccccaaccgcccaaguagcugggacuacaggcgcccgccaccacgccuggcuaauuuuuuuguauuuuugguagagacgggguuucgccauguuagccaggauggucucgaucuccugaccucgugauccacccgucucggcuacacaaagcacuucuaccuguacccccucauuuaaucaucacaacaauuuauuuuacaaaagaggcaacuggaccccagaaagcuuugccagaauccaaguuuacugauacucagaucuaugcuuuuacacauggugaaggaacuuucuccacucagcucuccuacaaggaauaaacuuguuuuuauaaauacgcuauuuguaaaagaguaauuuuuuuuaauaaaagacuaacccaaaaugcaggcaccaaauaacauuaauaguuaagaauuucauugauugcagcuugucagguguauuauuacauucucaaacauuuuguuuuuaagguagagaagaagguaauguguuugaaaaauguuuuuuaucuaaauacuauuuuuuauaacuucauggguuuuuugagguagauuuuucuuauaaccauuuuuaaagaaaauaaaagauugucauaacaucuuuuauaaaaugugauaugcauaauuacugucuucaccauuuuuaaauguacaguuuauuggcauuaagaacauuuauauuguacagccaucaccaccauccuucuccagaacucuucaucuugcaaaacuguaacuauuaaauaaccauuaaacaacuccccauucacccuccgccuaacaucuggcagccacaauucuacuuucugucuaugaauuugaccacucuaaauacuucauauaaguagagucucauacaguguuuaucuuuuguaacuggcuaaacaccucuuaaaauauacauuguuguauauuuucaccuuaugcauguggagacuuuagaaugaccauguaccuccauguaaaguacaguaauaggaauuucuuggugccagagcauacauaaguacaccaguagccauccaucuuuacccuuuuugugcaagcaccuaaacagccugagacauuuuuuuccagacagauguaaaaauaacauaagugaauaauugagcacauuguguaaggaaaauagccagccuauuuguuguugcuuguaguaauuuaauuuaguaagcaucacagaauauuagaauuugaaaaggauauuagaauaauccaguccagcacucucauuauacaaaugagaaaacacaaacuggcagugacuuacccaaggucacauaacaaagguagugguagaaccagguguucuuaauuccaugcucuuucccuuauauguucauuaauguacuaauuaguauaguaauucuuauggucuagcagauuaucccuuugaauuuaagagauccacauuuauagaauaaaauaaguaaaaaguuaauguuuacauaaaacaaauaaugaauaacagaaaaaguuaucugcccuuaauuuuuguguuaaagaaaguuucacuggggauagguacaccauguuuucauuaaaacaaaauguguuuaagaggacuuuugacauacuaaaucccuaauaugagguuuaauucuguagcauucguggguuuuuuuuuuuguacuaaugcuaaguguauaauaaaacauagaauugguauguuucauuuuguauaaacauuuucuuagaaaaguuugucaguguuuaaaaaugugaauagugauuucugcuagaauugguuauaccauccacucaagcuucagggaucacauagaauacuccauggcaguugucuucauacuuacauaauuguauaccucaucaguuaaaaaaauucacacagcucaauuauguuuauuuauaacuuacguauacaaacuacugauaaauuauauaaaagcuuacauaaaacaaaauuuuuaaaggauaucaaaagcaauuuuuuuucuguuuuuuauuucuauacccagugggucacuuuauacacugcauuuuccuuuggaaaucaaagggauugagguuuguuuguuguuguuguaguuguuguuguuguuugagucucacucuguugcccaggcuggagugcaguggugcgaucucggcucacugcaaccuccgccccccagguucaagugauucuccugccucagccuccugaauagcuaggauuacaggcacgcaccaccaugcccaauacuuuuuuguauuuuuaguagagacgggguuucaccauguuggccaggcuggucucaaacuccugaccucaagugauccgucugccucggccuccgaaaguguugagauuacaggcaugagccaccaugcccggcgaggauauuaauaaugauaaucauuuacuuaauuuaaugauacucuggccuauugcuacuguaacuuagaacaguauaaaaugaacaaauccaauaugauauaacguauuaaauuacuuucaugagggucuuuggaaugacaauuuuaagaagcucuauaaaaaugucaccaaaucaacuaacacauauuuagcaacugcagguaagacacuguaaccaucuaccaggaaggagcuuauaauauaguuggaaagccucuuaguuagauguauucugaguguauguaaagauaauugauaauuuaagagggacuauacaaaaugucuuauguauguuacagagaguagagguauucauggagaggaacgaucacuucaaaccuguaggcgucaacaagggccucaaggaggaguugcauuuuuuuuauuuauuuauuuauuuauuuauuuauuuauuuauuugguugguugguugguugguuuggcuugagccuuauucuuugaguaggcagaaagcaugaaaauauuuaggggaaaaugagugaauuuguuuuauuggaacagaugguuuuugugaaggaaacuaguggaagguccgcuaggaaaguaggcuucauucuuuaggaggacauuauucuuagccagacuaagcaaauuggacuuuuucuguuugcagaagcagauaugugaguaguuuaagaagaugaaucugcuggcaauguaaauauauuuugauggagagagaaaacagaguuacaccaguuggcaagcuauuacacaguucauaguaagaacuaacauuugagugccaggcacuguucuaagcacucuucaauuguuaaaucuuaugcaguaaauacuguuauucccauuucacagguaaggaaacugaggcacagauaauuuucuuuccccuaagaucacacagcugguagccuauggagucucugucuucuagcugcugcuguggaucauuugaaucuaaacaagaguucuggcucugaauagaaaugagggacaugcacacaagagaccaaaaaggggacaugaguagaauucaguggacuguguauggggcagcuggggaaguaucaaagaugagccaagcuuauuuggaaauggaugacaacauuaaucaaaacagagauguugagaucaaauggugaaaagacaguuaacugucuuccagaagcauucagaccagcaaggagacagacauaaauaaauaacuucaguguaauaucauauagaaaacauguuuaagaaauagucagugauuuggggaaaaagccaccuagguguguuuguuugaaucuaggaagucauaacaucagagguauuauuugaguuaagccuugagaucugcuaaauugacgacagauaagcugaaagaagguguuucaguaaagaaagcaguagcaugugagguaauggugaaauauccaaaugcaaacgucuagcuuugguuaaaucaggagggagagcuacauucaggaaucaucugagcaguggugauacuugaagccaaaauacucuaaaguagaauaucuugaagaaagacuuuaaggcauagaaggaagaagaugccagugaaggaccuaaagaaauaggaagugaaggaagaauauuaaaauguagaaggccaggaaagcagggcugugaauagcgaagugguauucacugacagagagaugaaaccacuucaugauauauuucuuucuagucuuuagucuguguuuuuauuguuauuguuuaaaauuauuucauaguauauguuuuauguccugccuuuucaauaagugaaugagcugcaauuuauuuacucguugcuuuggggcauuuggguuuucccuuccacucuaaggaagcaaaucagcuuguaaaggauucuggggaaugaguugugagaaaauggaugcaaguguaaaauaaacauaaaauacugaauucagaaaguuagcaguggguuuaguaaacugaaacaaagaugaauuauucaucuuugcuuucuggacaccuagaucagugacugacauugaaugcaugaagagagaaagaaaugaaauuuaaaaguagaguuuggaaucaugcaugaucaaugcaauaguuuuuuuuuauaauaaugaacauuuauauuucuuaggauacacaguacuaauuguuuagccuuggaaaauaggagggauaccuuuucuugaggcugacggcaagaaggcauggcuuuuguacagaugcuuucaagauaagaaagaacaaaacccaggaccugauuagacuuacucaguauaguaguaguugagucaucugcugagaguggagauaaugagguguaauuacagcuugaagagagugaaagcaaaauuuuacauguuucuuuugaagaagaugauguacaagcagcaggaaguaaauaaaagaauugucggguagcagcgacgaccuagcuagaagcugauaggaugguuauggugcacaggagugguucggaguggagcauguacuuauuccugucucaagaauaguagccccucgaucauaagaauuuggauggaagacugguuuuuuucacagaauacauuaaguuuuuauaaacuccuggaacuucagagcuggaagaggagauguauuuaaguucaauucuugauauuaauaaaaaacaauagaaauuuuaauguacauauauaacaucgcaaaaugaauaagcauuuauuaugagcauuguuucauaaggcauaaaaauauaaaccucauacucccacuuuuuacaguaagagguaacucaccuucauugaugaaaguuaccggugguaucuugaaagggcuuuuggugggagaaguugccagaucaggugguggcauuaaaucucugggauaaccuggaucccucugaaucucguuaccucccagcagaccaggaguauacuguuggcuguuaggaauauguuguggcaccaccuggacaagugggggagacacaugggugucuugucgggaaaauauccucaagcacuguucuuccaacaaagugaucaucacagauugguuauugacaagaucagucaaggaagcguauuucaccucuaguucccuguaucuuguugccaucuucaacauuucuguggugacauugaggauuuuguuuuccaguugggaaaguucaagugaauuaucccucuuacggauaaucucauguaauaauugcauauagaguugaguaacacgagaguucauguuacggcuuuccuuucucagcagcuuuaccucauucacaauguuuccaucuacauccaccaccaguugcagaacaucuaucucccgcuucugccuggagagcacauccuucagguuuucaagguccauccuggugaucaugucuuuaaugguacuugcaucuugccccuugguguugacacagauuggcccuguuauucuuuguucagguaccaggaauguguaugcacauuucuuugcuuccucuuuaccaucuguggcacgaggguaucuucucugguuuauuuuuuuaauuuugaauuguccaccucugcaauguccaguguccacuaguaggaagaauagcacaccuaggguccagguaaaagucuucauuuugaaaugagguuguaaaaugaugucuuuugaaaaacaaaucagugaaggagaaaaagcaaaaagaauucauauuaaucuauguuaaagucaguaaucuuaaaaacuaucugagggaaaaacugaauauuuauugguguuaauagauuaggcuagaauuaacuuuauuaauuucuuaaauuuaauauuaaguuguaauacuuuggcauuuguuuaaagauuagguuucagagaauaacucuuccagcuaccaccuuauuguaauccuuuuuguuccccaguuuauugagcagauuuuggucagugucuacucugugcaaagauacgcugcuagugcuguugaggcuuuugagacccugauaagauagcuuucuuaccuuuaaaaagcucacugccuuaagacuaugaaaaugguacacaguguuuguaaggcauuaauuaaaacauucuugccuaacuaguauuaaaauuaccaggugacuuuacuagccaauguuuuagauucauaccaugcaauuccaauuaaauugauccucuguaauaaauuaugucaucuucauuaaaauguucaauaaaguuaaagauuuuagggaaaucuaaacccagauaguuuuagcaucacaugcuuuuuauuuuuauagcaucuccuuuugggauuagugacagguuuuagaaugauagaaugcucacagucauuguggguaauuauauuuccugaacuguaauuauauguacucugagcuuauagauaauucagcagguuuguucuucuaacagaaguccuacugaacuguauuuuaguaaaauguuaguaauuuucuacaaccauuaccaaggaaagaaacuugucuguaauugaauaugaaugucagaguuggaaaugccuuagagacccugucauucaagaaccucuuuguacucugugcauguugaaggcuaaggccacacaaggauuagaaccaggucuagaucggauucucugacccauagucaguauuuauagaagcagcaccuauacuaaaauaugugcuuagaauguuucguuuuugcuguagcagaugagaaauacuucuuuauaguacaaauucuucugaggaaacaguuucaagagccaagacuuuuuccuuucucucuaguuaccucccacaagaguagcagaaguagaauggguaagguauguucacucugucagaucuacuaacgagcuggucuauuacaggccaccuuuucacucuugcgaacuucauaccuaucugccauuuuugaaggauggcaguggauacccuaagacagagcuuuucuguccaaauuuccacauaaguaccuguuucuugauuuaagaaaccagcuccuaaguuguuuaugccuguuguuaauaacaacacaauaacaguaauuaauauuuauugagugcuuguucaguguuaggcacuguuuuaagccauuuucauguuuuacuuaucaccacaacccuaugaaguagauuauuaugauccccacuuucagauggaaaacuuggcauccaaaaguuaaguaccuuauuaucaagagucacacagguucauagugauggagcgagaauuugaauccaggcugaagacuucagaguucauguuuucaauccccuguauuuauguagcuuaacacauguuaacuauuugcauuuauaacacugaaguaaugcuguaucauuuuauaaaggaggaaaauccuugagaagcuaaaucacucaaaugggauucaaaccuucuacuccuaacuuuucuagaccuaugauuuuuacccuagucaugucauaaccacagaggagucuuaaguuuauguuucuuguuuuucgcugccuuuuccugguuuaugucccuuuucauugaccgguuacuuaauuaugcaaaaguauuuauggauaauuuuugguagaauuuguguccacguucugccagaucauuuuuuuacaucucagacucuucugcggcaauuucuuuccuucuguauguauucugucagcugauaguuauauaucuaaccuaugauuauggaccccucccgaaaacaaaggucaugucaaugaaauauaacucuuaugcugucgucaugaagacuacugcuacuuucacuuucuaaaaccauguuccuuuuuugguauuuuucaauugaauagugucuucaaaauggguagauaaugaaaauaaggcaaauauagauggaguauggagaauuauuauuauuuuacuaacaagagagggaaugaaaacaaaagauagggaggacauaacaaucuguauuucuaucgaggccuucuuuugcugacugauagccaaagcacacauggguauuuuuuuuagcuuuuuauguuuucauaccuugcuuucugacauauauagaaaauuuagaaacagucaucuauuuuauuuuuaaaaauagacuuuuacuauguaggaguuaccuauaccaaaaaccaauaaaacauuuauuauaucuccagauucguggaauuuagauauggguuauuuuaaaaacuagggacaagaaauaaaagccaucauccuccugggcacaugcauaucauuuuuccuauauauuuaauuuaacuuaccacugcuaaaguccauucauuuuaauacuagaauggaaacucugagaucauaaaauuauuuuacuuaaauaauauuuacuaugaaauaaacuaccaaaacaaggaaaaugcaggaaguaauauaaaacucuaaaacaaauagaauuuuaugagcaauauucugauugaacagcuuguauuaauaccagacacagauuuuuauaaaacagcuaaaagcgcaucauccaagacugcuguuaggacuuugcaucaguguugucauugaagaacaaaaaacaccaaaaugcuaaucuaaauuaaaacaaaaacagcuuccuuguguguauucugccuuggcucauugugguuccuauaagauuaaaucauaagauaaaucacuguuuaccauaagagaaaguggucuaaauuagcauuuaaaggaggcaacuaaaaguuuaguuuuuaaauaaauauaauuuuuuuuuaauaaauacaaaaguauuggcuucacugucacuuaaagcagggcaaggagccacauuucuuaaguaguagacuagcuacgucaggaguaaagaacugguuuuaaaaauacauuuacuguuauguuuucugaaaacauucucuuauuuaauauuuucucacauauguucaguuuugaagcaaaagauccauaaaucuauguuaccucauaaaacuuucuguauauguuaaaauuuuccuaggccccaagagaauguuauaaauuaguuauagaauacuuacguuuaaauuuaagucuuuacuuaguuguuuuuagaagagaaaaaaaagucuucuaugcguuggguuaauuuuauuaguagcuuuucucuucauaguugcuauauugccagcuaguagagagaagaaacgaaagucaggauuugccuccuuucagaugguaaacucacagaggcauuuaacuggcugugucaugcacugaaaacagcaugaggcaaugaaguuaaauuuaugaagcauucaggauauguuagauaaagaauuucuagauugugaaauauguucugggaagagacuugagaacaaucuaauccccuggauauauuuaagaaaaggauaaauaguuaucuguguaauuugggguucagauuaaaugccugccuuaagacagcgucaguaagaacugaggcuuaaugaaguccugcacuucccauagcaugcaacaacaaaaaagagagaugacaguauuucagauccacuguugcuuggaaauuuuguuagaauuucuuguaaaauauguguuuaacagaaauccugccagcauuuacaguuuuaaaucuuuaaggaaaggacacaaaagcaaaguuggaaaaaauuuuagcuuuaccauuauuugcuuguucaagauucuuaaccauuaauaucuuuaauuuuuacaaggcuaaaggagccccaaaucuaacaaacuuaagugucuuugguuuaaggcauacuauugguaacgaguaauuuuaucuuuaauaguuuuuauaaugcauguaaaaaaagcucccagauagaauauugaaggaaaccucuuaugugugcuuaacaaaauuauuucuaccuaaaauauuacauauuuuuggccuuuuagucaugaauuuaauuacaucuucuggguucuuauuuucuauuguuaauaccacuuacauaaugcuuuuguguguauaucaauaacuuagcuuuuccaagugauuccauuuguagcaaguuuaauuucugucauccaaauuaaauuacuauuacauguaagccuggaaagcuauuuaaaauuuugaguuggaacaagaaaugccauagauuaaucuuaaaucuguacaagaauuucugcuuaauauuugguuauacuguaauugagauuuuguugcaaagacuuucaacuauuuuuguaucuuagcuuuguuuuaugacuacacugagaaauccaacaguuuauguauaucuucagcacacacacuguggcugcaggaagagaaacuaauuguguucacgacuauuuaguuuguauuccuuuguuuuuaaucauugugcuguaagccuuauacauuuaaucuguuacuuguuaaaauuucuuucuacugucacuaaagcacuuguuuucagaaacccagcauggcaugcauguaucagucuguaaucauauacacuaaacaucauuaaauugaaccucaaauaaugcauuaaccauugcacaguacuuaauguuuuuaugucaaguugcaagauaaaaccuuuuucagaugagauaaacuguaguauauuccaaaggucuuuguuuaguaaaagauucugaaauuucuacuacaaauauaaaauaguuaugcauuugcuauacauaauauuuuuaaauaaaagaaauauuaaauaccuuuuugugucuguugauucagugaauccagaaacuugcugcccuuauucuugauuuuaaaaaucaguguagaaguuuguucaucugugacuuuaauggcagcugcauuuuuguuuuggaccguugaauccaagcuguaagaaggaacuucuuuuuccuuuuacaauacuaaucaauugaauuugacaagccaccuauguaauuuuaaguaguauaguggaaguucuggucugugggccgucuuuaauccagcagagaaagcguuguggcuuugcucugucugccacauggagaaaugcaguaaccagcugcagcugacccagauuguauauacaguaccccugaauagugauucccucuuucu

SEQ ID NO: 12913 - RNA, 2011 nt, Homo sapiens
cccaauuucugucauuugcuccuuaagucaaggguaguacccugcguaacaucuuacaaaggccuacuucuaacacuucccgaaucuuaaugugugaggauguugaucaccauaauuuaugaccuuaucuaagacaguggggugacucuccacauugggagcccccucauuuguccucagugacuucuaaaaacaccgcuggcgugggcuggauauuugaucuuggggccaagugcuuccagacuuuguucucuggccuuaaaggugaagagcccggcgcugaaggccacagacaucacggcggauuucacagagggccgcguuccgggagcggguggccaggcgguggcggacgccccaccuguccauccuccuaccccuucccccccccguuguuuggccggugggagccccuccuuucagcaggcgccgggcggugggguugcggauggcugcgcgcgcugcgggcaccgaucaccggcggcaguugggcuccgcggggccgaaaagcugcgggcgggaagcgcgagguuaagacccugacggcugcagcucucagagcccccgcgagcgcgcuccguuggugcgcgcgcgcgcgcggcuccgccccgcccgcuuggcgcgcgcccccgccagguccgcucucgucccccaccccuggcgcggacggggugguuccagcucacucuccucccccgagcggcagcggcggcggcggcggcggcugcugcgggcgcugaaugagagacggugacuguucgggucgacgagugcuacucuaggcggcggcggccguggcggugaagcgugaggccggcaucgucuuuccguccucugaggcgacggccgcggcugcacaggucggugggcucaggccgcggggcggugcgggggagggagggagggaggguggguacgcggcgccccccgggcggcgcggggaauggcggcggcggcgcugcggaguguggcucucccggccgcgggccccggggcugcucgcccugcgcgcagggagggggcugcggagcuggggcugaggcugagggagaagggcgcugggcggcgcgccucccucggccgcggguucucagagucggagcggccgugggguccccgcucgggggcgccguccugaagccgggggcgcugcgaccccuugaacccgccucgcucucccucuuggguggcggaagcccccagccuccgcccgcucuguucuggcgcccagcggcgccucagucuuccuucaggugagcccgaucccggaccucggagccaggaccagcagaagccgggccacacccccuccccuggcccuggcggcugcgcccagaagccuggccgcagaguuggccgcccgcgaacccgcggagucgcggucagggugaccuguugcagagcggcccgcagcccgagcggcccccgccagccccggccccggaggggcugcguccugugcuggccucgggccgggcgcgcgggccggguguggggcaggggccgcagccccaggucggcuugcucuacggccuggaaccgggcucuagaaaaaaaaggagauuccgaacguaucucaucaaacacuugcaaagccgggagaucugucugcaaauauccggaauuccauugcaguaucggauuagguaggcucauaaacaccgugcuuuugaggugauuuggaagaaacgcgagccacgagcgaggaacuaguuucuggaaaauagccguaaaccugugcggagcgaauuauuaaccccccgccccagcuccccccucgaagcucuuuuccuguagcuguguguuguguagacgcaagccaguuucaguguacgugggcguguuugggaagaagcugcgagcugauaggagguaccuaguacaaauguuaauuuguuugaguugggagggguaagggaggaggaagaaagggcacugauguuagcuguggaggaggggcaauugaaauacuaaauuucuguuaaaaaaaaaaaaccccaaaagaaauauc

SEQ ID NO: 12914 - RNA, 1841 nt, Homo sapiens
guaaauaguugccuuccuaccccuuaccugggggccgauaauuugagauacuuuguuuuuucaaugcgucaguugaaggauuuaguuucuuaaaagcaagaaauguuggaguguugaauuuuuaaauagaaucucuuuucauguuugaaugauuguuauuaguucuagaagcauucucuuugucaugacccgauuauguauacucuuggguuuaggaaggacaaaagugaugaaauuugcaugagauagaauaaauaucuuaggaggagugaaagaaccugaggaagagacacgacccuaagggaaugaaugcauaagcagucuucucaguagcccagaguuuccaggaaacaggaauauuuauaucccuugcccacucuuaaaauacauagauacauaaaaaggcagucucuguagacaacacaugcacacacccacacaaaacauaauuccuggggcuuccuuuuucugaauguuaauccauuuuaucgagcagugauucccaaacuuugagauuuucagauuuuaugcucucgucuguuagauuuuaugacauucuaucauccuaaaaaauguacuauauguguuauauguauauauaaguuaaagcaacuugaaauugacuugguuuggcauugucucaagaacccuagauaucauuauugauaccauggggaaucauagaaauaaaguugaauaucauugaucugagaguaggauccagaaauaaguaguuucaguuccugaucaguuaagccucaaguguuugaguaaccaacacagcaagacuugggaaaugcagugagcacccgaggaaaggaaagugguagucuuugccugcauuucagcaugcauuuuccuuuccuacucaguugcuaucuuccacuuaaauacccucauuugacccuaggaaguuuuuuguuuuuuuuuuuaguuugagacuuaaaaccagauuuauuuguuguuguagagagauuuccacagaaguuguguuuuagggaccuccaucaucuuuguggggguacagauauuuauguguaaauaucauuuuaugugauuuccaaauuuucgagggaaacauuucaauucccaguucaacaaaagguuaaauacuaauugacucaaugaccaccuucaggaaaguuaaauaguaaauuagguuaaauuuugacuggugcuuagacauuuccuaguuauauuaacuuaagcagacagcagcacauuaaccugaguuacaccugugaggaaaugaccuucuaaauuugauuuuguuuuucaucuccagggccuuaauaagaguguguuaacacacgacuauuuuacaaugauagcucuaaauaauuuauuuuuuauuucaagaaagagaaauacaccuuagaaaaacaaaacccaagauuuuauuuuauuuuuaaagccauauuuuugugcuaguagcauuuagauuauuccguaugugagauccguaucagcauuucauuaccuggguuuguucuaaagaagauuuauuuuuguucugugaauaauuuuugacaguucuuguacauguacagauauagauacguuugaggucuuuuauugauauuccuacaaagaauacaaauaaacuuuaacuuuaaacauuucagacuaaaguugcuacuauauuugacauauugcugucuucuagcaugcaccugggugacuaggacacuugaagagaaacaagaaaggaaauguaugccggaauauucuucuaaaaauauauuuuaacauuaagaacagucuguccuagaauuucccaacuuccauguaauaagauuucaauuuaggaaaaauaacuagcauuagcauguauugugaua

SEQ ID NO: 12915 - RNA, 2297 nt, Homo sapiens
cuuucuuucaggaucuuuuauuaacguauagaaaauguguuuaaaaaaggaacuauacagaggcuaaaagcaaccaggacuaaaaauacuaguuaacaaugguuaacaagcagagauuccagucuuugagcuacagugccaugaaaggaucagagaaguugguuuuuccucucccuuccucuguacauuuuuauuuuuauuuuagcuaauuaaagugugcaucgucugaggaguauguacuccauuuucuuuuuuuuuucuuccuuccagucuuucuuuuaaguaagcgcuuuuucaagcucauuguagcuacaaagucaauaaauuggucuuuguuauuuuuaccugaaaaggcuguuaaagguuaaaaugacaaacucaaauucaaagggauuggaggauuugguguuuaugauuucucagaacaacaaucuagagaccaccaggguggguuucagcugcucggagccccaguuaaugacccccucagugucacagugauuugcuuaggguacuugggcauccccaugggccuggggaguauucgagguuggaaucauuagauguguguguuugugcaugugcaccuguguaugugugcaugcaugugugugugugcaugugugugugugugugugugugugugugugugugaaugauuggaaggaggagccuguguguuaaccaaaauagacucacauagauucuaaaccuugagucugugggaccauggugugagucugggccuccgcaguugguaaaggagcacuuaguuggccgacauuuuugcaggaauugaagugucuauugcaucuaaugcacaggugucacugcugcccaagcagcccccacacuggaauggaaccaguguucugggguucuuucuuggggagaucuauuccuuuauauauaaacaucauucaauuaaagggaagggguuuaugucuggaguuuuggccuggcagcuaaaaauaccagguugccaaguacugauuuccuucuaaauuccccaaaguagcagagaaagcugauauuguagccaacugucuucugaugccuucccacccacuagggauguggggcagguaaggaguggggaaaagaaaccagggggauaaguaaacugaauguaucuccugccuucuagccucauuccccaaauauuuccacugauguacucccgcaggggacugugaagguguuuguaccccugggagucuggaaggagguagccuaaaucagucuacaaccugcuggaguuagccucaaaauuuauaggauaucugcauuugugcuauccauacugguuugaauacacuaauaauauaauccuuucuucccaaauucuggaguaaaauugaugcucugagaacaugugccauguuuauucuguggcuucuccuuccucaauccuggcuacacugccugcuccagcuugaaaaaaaugacuggauaucccacucuucuaauguugggauguucccaaaagaguggggugggggguauuggguuuauguucugguucuuaucuucccccucucauucuguuggggacccucucccucgucuaccaaauuuaaaaagaaagaaaaggaaagagaugucagaauguuucuuauuccccaugaugaugagauugaggguccccuggaguacauggcaaaaauaaugcaagaauuuccuuuucuuaaaagucagaagaaguggcaucaaagcccccuuguaagaauauuaguaaaauccaagaugguggucacucagcuaaauaaauauaaagagcagccucaugaaguggaaaaaucaagggcuucaaaauuagacaaagguucagauuauggcucuauuuaguagcugugugacuuugagcauguuacuuaaccuuccuggcccucccuucccucuucuauaaaaugguuaaaccugacuuaaaguuuauggugaggauuuaguaaaguaauauauguaaagcccuuugcacaguaucugguaaauaguggguaugcaauaaaugcuauuuaucuuaguguucauuuguggagaaucaaauuaaaaagccuauaccagacccgaacucagcucuguuacuaauugccugugugaaugugagcaaauugccuaaacuuucuugcccuugguuuccuugagaggaaauaaaaugagaggauuauauuagaugaucuugagucccauccagcucugaaaguguauuuccaacauuugccuguuggaggcaguguugagcauauuagugcuccaugucagaauauuaaagagcaacacagggucucccuaggggc

SEQ ID NO: 12916 - RNA, 11773 nt, Homo sapiens
uguaugaaguauucuuaauuauuggaauccugucaauacauuguuugccuuggguuauggugggguuuuucuuguccuauaaacauuuuuauguaguuaaaauugaucaauaguuuuauuuauuucuucuagguuuuaagucacauauaaugucguuuuccuccauuuucuucuaguauuuguaugcuuuacuuuuuacaauuagaucgucaggcggcuuggaauauaucuauaugccuauuuucaguuaucuuaguaucauuaaaaacccaucuuuaccccacuuuuaccauauucuguaacuuucauaugcauugugucugcuauucuguucaugugucaaccccaauuacagaggcauaauguguuucaguauuuacuuauagcuauccuauacauaaacuguuucuguauuuuaaauccuaccacuucuuccaaauucccauauuaauuguagcuuuaguuuaguuuacccuucuggauuuuuccugugugucuaacggcuuuuuuuuuuuuuuuuuuuuuaaugagacagguucucaaucuguuacccaagcugcaguacaguggcaucaucauagcucacugcagccuuaaacuccugggcugaagugauccuccagccuuaguagcugggauuacgggcgccagccuucaugccuggcuucaauugcuuucucugaucuaacuguguuggcuaauaccuccaggaaaauaaaguaauggagaucacaggcacugguccugacuucagggggaauaggaguaauuccuacuaaaagccugauuuuucugacauacuccuagacaaauaaaucauaaaacuguucuaaugaagaaaaacuuaacuuuauugagcauaggaauagacgggcuuucaaauuauuuuuugcuuuaugguuauuacuuuuauaaaccaucugauccacggcaaaacuaacugguaccauacaaagauaugucuauuauugucauguuuagauuuucuauuccacauucauugacaaauauauuuaaaucuagauagaaacaccugugauugaauuagugcaugguaaugcauggcauauacauugcuuaaggugguaauaaggggucagaugcucuacagcaaccuucaagcacaggcaccgauuugcauuuuaugcaaaacuucagguuuuacucaauuuuuacacugguggaagcugaugucaguaacuuaaaaggcaagcaaauacuuuuccaauucuuagcugaacaaaaaauacacacaauguagcguuuuuauugggcaagacuugcuuuuuauauuucacgugagaaugcaauauaacccuuccuugaacaaaaugaccaggguacuaauaaaaccaucuuugcaggaguguuuaauaagcauauuuuauuuaaauaaauccuccaguaggaaauggagaauucauugccuuuacuuagaaggcuauguaaauagcuaucugucaaauuuauauaugcagcucaccaauauucccuuacuggaaacaucaguauuuccacaucacaucacaguucccaaaacgacuuuaaagucucaaaauuccgugucuccuuuggcuugcuucucucuugauuccacccaggcuuuauuaaugguucgcuucauaucaucgucuccaucuucauaaauuuucuuuagaacauucaucaaucccucacuaggaucuguuucagugucauaggagggcuuccuuuaaaaagaaaacauauacaacaauggggaaacgaaagcaccggaagauacuaucauucagguuguuaacacuggcaggaaguagagggauaagaaggaagacagaguacccaaagauauuuacaaucaaaacggcacgcacaaauucaucuuaaugaaaacaacacacacguaucaagcaugcacacacuuggugcacgaaagaggucaucaaaauaguuaggggcuauuuuuaggcacagggauuucccaugauuuuuuuuuuuuuuuuuuuuuugagacaguccugcucuguugcccaggcuggagugcaguggcgcaucucgguucacugcaaccuccgccucccagguucaaacaauucugucugccucagccucccgaguagcugggauuacaggcacaugccaccaugcccggcuaauuuuuguauuuuuaguagagacagaguuucaccauguuggccaggcuggucucaaacuccugaccucaggugauccgcccgccucagccucccaaagugcuaggauuacaggcgugagccaccccaccuggccuccugugauuuuugacagguaaaauaagaauuugauuuucuaacuuguuuucauuuuuuaaaagcauguuuccucauaauuugaaaaaaaacacuugagggaaaaucauaaacauuacacauggauguacccugaagcucauguauuuuuuaauuagaaaaacucuccucuuaagccugagauacacagaucugggccugggucuugaauuaauuuagucaguaccuuuagaagaugaacugaccuagaacgcaaguaucauugaauacacauuuuuaaaaggucauuauuaagaaggauaaaaauauuuuaucuuuuucacuauaaaccagugacaaugaaaacuacgcaucagaagcaucugagaaauuuaaaacauacagggguaccuaagccccucucaaacuaccgaaacagaguaucugggaaugggcacaguuauuuguauagaagcacaacugcgccuaggguuaagaaccacacuaaagagccaacccuuaacuacaaagaccuuaaaaagcaacuugcuggacgugcccucuucagguaguuugacaguugaaagcagaaauacauuauccauaaagacaaacuauuaaaaauccaugaucucaaacaauacacuaaaauucuuuaaaaaaauggaaguagacucacucuuuuucuuugcacuccuuuucaaccugggucagguaaucccaccuuguguuuuccacuuucuuucuacacaauauaagaacuguaucagucuugaccuggaagaaaagcaggaaaacaaauacagcuuagaagacauggagauaagcaugaauauuuauaaaacaauuaucuauucaauugaucaagucccuaguauguauagacuuauuuugggugccaguaauacuuguaugaauaggccaaaaucugaacauucauggugugaaaagaccauaaauaaguaaaacuugaauacccugauauccuggaaagugcuaucaagacaaagcggguguuaauggggggugggggcaggaacuucauuaggaaggccucucugaggcaaaucugagccgaagccuaaggucaggagaaggcaguuggcagagcaugcagaauggcuccaagaugggaucaucuugguguguuugaggagcaggaggaguggcuggauuuuagugacugaaaaagacaguaauauaauaagaggggucggggauaggcaagaaaccaagucguauaaggcaguauggggcaaggugaggcauuugaaagugagaaagaagggcaauguacaggucuuuuaaacaaugaucaauacuagggaucuuuugguacucuaccuaugggacuagcggaugcagaagggugcaguaagacagcgaauccaacuauauuugaguaucaccuguaagcuguuaaguaauuauguauuauaaaaacagauggcagaaugucaugucuauauaccuaacgcauuaaacuucauuuauucacauuaggcagaaaacagggacuaucugauuuaguaaaaauuacaaagaguaguuuuuaaaagacaguuuccuuauuuuuauagcugcuucuaacuccaaggaggcuaagugcuuaagaccuccuuuuauguauacgaguauuaugcacaaugcuaacacuagcauuaauuuaagcacuuuacauaaugguauugcacuucaguguaucauuucaacuuugugaaauaaauuauuacuaucgcauaaaugcagaaacugaggcacagagugauuaagcugccaaaggucacaaacaauaagcuguaaaccuggcauaaaacucaagucucacucuuaacuaccuucaaacguuuacuuccucccugauuuuaauggaauauucuuacaauagccuauucuacaaaaggaguuggcaaauguucucugucgagggccgcauaguaaauauuuuagguuucauuuagggccauauggucugcuguagccacuuaacucugccauuguagcacaaaagcauccacaaacaacacaugaacaaauaagccuggcuaugucccaauaaaacauucacaaaacaggcgguggucccuguuacagaggacaaauucauuccaguucaucucaguucuaaaucagccagguucaauuugguaagguuucacaauauuacaaucaaaaaaagcacacucacuuuuuuugaacugccuuccacagagauggguuucaagagauuguucacaaucauggaguaacucuucccauuuagauucuuuaccaaaagaucaaaugaccugcaacacaauggugaauacaucaucuuucuaguucuaugaaagguacccuuacuccauaguucuugugggaaaaaagcugcuggcuuuauuucagggugugcauuuggccaguuaacgcucaccucuucaaaguaguuguaaaggauaauuaauucuaaauuuaagaauuuuaaaaacugcaaagaagagagucucaagauaaggcaauguugacuguuaauucacugucuuucccauuauaaugagaacucaccucucugugaaaugcaccugcacauucucagugggaacuugaugaacuccaguuaagguaauguagauuuucacaaacuuaucugacugaucccauccuggcaacgacaacaaaagaugggacguaaguaagccucugaaacuaucuuuagaacagcaaaugcacauggcucauaagucaggaaaguaaaauuaugaaaauccagucauauaaacaugaaaaaauuugaaauauaagaaauuuucuagguugagaaauggagccucaaagcaguuaaguacucuacccaaagcuaggcaucuaacaagugguagaauucagauucaaauccagguuucugaauacaaaaccuaugcucuuuuuaucccucagaauaaaaauaugaucacuaaauacauucuuuaagauuaguucauuuacagcuuuuauggaaacaauuuuguccgacaucuaaauauugguaguucuccacuaagcuggauggcuaaguaucaauacuaauuccauaaccauuucuacuucuguaaguagucaaacaaauggaauccuagcucucuuaauuccuuuccagggcaaaguagaauguaaaagacuccaauucuucauccaaaucugacaaaccuacugguaucuguuaaaugccauuucaguauguauuaucaaacuaccagcacgucucugaccuagaagaacucugucaacauaaaagacauauauauaaauacuucacaaaauaccaucacauuuguagaaaauaaaaaacuucacaaaaaagcaucuucuguuuaucaagaauauauacauacauaucccugacuauugcucacuuaguccuauagaauagaaacaugccccauccuccaugacguuuuucacauugcaugccuauaucaaacaucucauguaccccauaaauauauacaccuacuauguacccucgaaaauuaaaaagaaacaguguugaugaaaaaaugcccuagugggguccagagaacuucauuuauuaauaguuucuucccauucagucaguccauccuccggauugacaaguuucucccucaacacaaaucuauguuccugguuaaaauaccauaauccucaacaccuucagaccaguuuccuauacucaacugaguacacggugcaauuuccuauauuacuauauaguacaucucuuaagcacgacauacacaugcuuuucacuauuaacaauauucaaaauagaucaugccuuccaacucucuauucacauucucugcucaugcuguuccccuccuuuuugacuugcugaauguacgacucacccuucacacucaaaucucucuaauucucccuguuccucaccuccagaauuauuucuucagcuauguuaccuauuaugugcuagacauuauuagcacaaagaaaaacaagacuguccuugcuccaaugagagcucaucauucauauucaaguugcgcugccgccaaaacaaaaaacuguauacaccauugaaggaaaacaguauuacuacauuguuauacuacgaguuauacgucaaugucccaaccacaacaugagcaaggacugggucuuagucacuguuguguauccguaagucaaagcacaauagugauacacauuaggugcucaaaaauauuuccugaauuuaacuggauuccucuccucaguuaauuguggugguuggcagagugaaacauaaaacaugauuaaaaaccaccaccaccaccaccaccaccaaagcugugucuuauacugaacaauuucagaauaaguuccuuccuuguuguuacauuuuguagugaaucaccuuacucuuguuaacagcuucuagaacgcauccuuuccuauuuauaucuuaaaaaaguuuuauuaaauaaaaacugaugggucuugcuccaaaccaccaaaaacacagacucaaaacucauuggggaugaauuuguuagaccacuaugaggaauagguugcucggaggcagaacuggcuauagggaagcaagucauaccauaauuacugauuuucaccguauagcccguuguaaugggagcaaccacagcagcugguuuuucauuaucaagaaguucugcuuucuucugugauuucuguugcaucuuguucuugauuucugucucaaucuuggauuuuucagcuguaagggcaucacguacucuuuuccuaguagccuuuuccagcaacaccuuuaccucuucuagaucuuucuguagcuguguuaagacaaaaaauaaguuagcuaugauaaauaaggaaauggcuugauauugugcguaucacucauuucaacuuacugaaauaagcacuaagaauuaagaaguucaucuaaauuuucuaggauugaguugcaacuucaauucuuccaucuggcuuauuaacuguaauuaacucaagcuuccuuuuuuucaaaaggaaaacuuugaacaaucuugaacaaacaauaaauaggucuucaaaccuaaauuuuccaguuuauguuuuaaaauauuuacaagaaacgucugcgaccuaaaaaguaaaacaaagaacuuuuuuuugacaaaggauucauagauuuccuuguaacaucuaauccgagugucauuagauguuagacacuuuuaaaauauuuaagagaugagagaacaugcagugaccaugguaaaaugcuuuuauagcaaacuuaacugagguaaugaaugcuccacuuucugucacugauuggucuucauuaucuucccaccucaaauaccucacauaaaaaaagucuuaauuuuuaagacaaaagauaaaaaaaaaaauuucugcuuuugaggaaaagucuugcucugaagcugggucagucuuacacucagaaguguaggaguugguugcacagaaggugacaaaagaccgaaaaugcaacauacucuuggaaauuaucuuuugaaaaagccaccacguucucauuuucuucucuugccaauccaucaucuauuaaagucuacuacuuucuacuuucuagagauagaggcaacauuuuaugaaauucaagaguuaaagacaauguuagaaaauuauugagccuaaguuuuuuuucccccaauuacccucugacauacugcaaauacacaagaucuuuccaaacagcuguuucacuuuucuuacaauaacuuuacacucuggcuugacacuaccaacuugaccaaaaaaaucuugugucacagcuugauaucaaaagcucaauuuaaaaaagucuuuuagugcuuuauaacucagaauaucagacgcacaacagaguuugaaagccuguuucuuaauagucuuauaaaaugcaauaacagaacuaauucuuuucuuuuacuacaagucuuuuguuaucucauuuaacucagaugcccuaguuuugccuaucuauaacagaugacaugguauaaaaaguucaacucuggccaggugcaguggcucacaccuguaaucccaguacuuugggaggccaaagcggguggaucacuugagguuagggguucgagaccaacaugaccaacacggcgaaagcccgucucuacuuaaaauucaaaaauuugccgggugugguggcacgugccuguaaucccagcuacucgggaagcugaggcagaagaaucgcuugaacccgggaggcaaagguugcagugacccgagaucgcgccauugcacuccagcccgggcaacaagagcaaaacucggucucccaaaaaaaaaaaaaaaucaacucugcccaacccucuuguccacacucucgacccuuccaagaacagcucauauuacuaugacaaaaaaucuugcaaacucaucuuuugagcauagaaccaaaauguuucaguucaaaguaauauuuuuauuguaaugguuucaaaaaaacgcugauucuacaacuccuaauucauaauaaaaauauugaaauguaaaaugaaauauauuaagucuaagcaagagguuuugcuuuuugacugaaauaggaauacuuuaucuagcagaaugagaaagguacuucgaauuaggcaagggauucccccaauggcugaauucccaagcccucuuuauugccaguuuugacucuaaaguacucuuuuuauuaugaaguauccacugaaaaaacuuaaaacugagacaguuccucaguucuguuauuggcagacuugaaaccaacaaaggugauuccuuugaugcuuuuucugcacaaauacuuuaagauguccuaguuuccuaucuaauuuaucauguaauuuuccuugccuucuuggcauguguuuguuuuacguauauaaaaauuuuauuucucuuuuaucccuacccauaaggcauucaagcuuuaucuuccuauuuccuaauuuuucacuaggaggcauuaacaccaaugugccucaaaaaugggcaaaggaauucaacacacauuucuccaaagacacagaaauggacaccaagaacauuaaagaugcucaacaucuucaucauuggguaaacgcauaucaaauucccaagaugccacuucacacccaguaggaugguaucauaaaccgaaaaagaaaaauaaaacaccccagaaaauaacaaauguugauaaugauguggagaaacuuucagaagcuucaaacauuucuuacaggaauaugaugcaaccacucuggaaacagucuaacaguuucucagaaaguuaccauaugaaccaguaauuccacuccuagguauauaccccagagaacugaaaacacauccacacaaaaaacuuggauacaguacucgcagcagcauuauuuaugcuagucacgaaguggaaauaaggccaggcgccauggcucacaccuguaaucccagcacuuucagaggccgaggcgggcgggcggaucacuugagaucaggaguucgagaccagccuggccaacguggugaaaccccgucgcuacuaaaaauacaaaaauuagccgggcaugguggcgcgcgccuguaaucccagcuucucaggaggcuaaggcaggagaauccuuugaacccgggagacggagauugcagugagccgagauugcgccauugcacuccagccugggcgacagagcgagacuccgucucaaacaaagaaguggaaauaaauguccauaaacggaugaaaggauaaacacaaugugccacaugcauauaauagaauauuauuuagccauaaagagcauguguacugauacacgcuacaccauggaugaacuugaaaauguuagugcuaaguugaaggagccaaaaaacaaaaggccacauacagcgugacuccauuuauaugaaaugccuacaauaggcaaauucacagaaaguacaagaugaguaguugucaggggcugagggaggaaugggaagcaauuguuuaaaacacacuacaugguuucuuucuggagugaugaaaauguccugaaacuagacaguggugauggcugcacuacacugugaauauauuuaaacaaaaaacaaauaccugaauuguacacuuuaaaaugguuaaaaacuugaauuuuaucucaaacaaaacaaaaaucaagugcccucaaauguauauuucuaagugccuaaacugagaacgaucucuacuuucaagaggacuaacacugagcuauccaccugcaagacugugaaguuaucuccuaggggcacauaguacccaagaccuaccuuaaaagacuugucacaagauacccagauuaauacuggaacacacaaaccucauaguuuuucuucauuuaaagaaaagauuuugaguuuaaaaaacaaaaacaaaacaaaacaaaagcuugggacuccccaguacuuguuuucauaaagcaaaucuaguuaauacacacccaacacuuaacugugaauaacugucccgucuucaccucccacuuacgccaggaaaugagcaauacaaguacuaucauucccauuuucuaacugagcaaacuaagucuccacaaaauuuaauucuccaacguucagaguuuacagagcuuuaacacaggccauucgcuuucuuacuauuaauuacaacuaacuuuccaaguuauuuauuuuaaaaaucacauacagcagauugcuguuugccaaucacugacuuaaacaccuagaaaucauauuuuuuaacaacccuaugaaauggaugcuacugcgacacagagaagcuaaacaacuugcccagaguaacacagcuccucguguguagagaaaaccugacuaggagaauucaagugcuagcacugagaacucaccuuccaaccgcccucuaccaagaacgacacucauguuugcacccagcuuugcuugaaugaagcuuccuguccacuggcugggaaaccagggcagaaagggccugaggaacacgcgcaaagggccgcucucccagacccacuccccgcaccgccugcacggauaaucgccgcacacccccgcucgagcccagcaggcgaguggggugcgaggucgaguggaagcgcuggggagccgacggcgcagcaaggggcgagugaggugucccccgggaaggcggcgcacugacuggcgcgggaccggguggccgcagggcggcucagcccacggaaacggcgguagggcgggaggcuggcgcugcagcuccagccggggggcauaaggaauauggggccggaccacuuaccucuucugaagccaugggggcugggucaggccgaagucccgagcugcagccgcgcagaaggaggaacaggaaaccccgcgccgagcccucaaaccgagcgcagacgccuacccgcacgagucgcggcgcugcagccugcgcccacaccgacccugcgcaagaucgcggcccgccucccgcacgcgacggaucucgaaccuucgcgaggcagccgccgccaccgcccaccgcgagcacgcacagcccgccaagccuggcuccacccacccuuccucgccucgccgagccuagccccaccccuccccgccccgccgagucuggcuccgcccgccugccg

SEQ ID NO: 12917 - RNA, 551 nt, Homo sapiens
agagcuuuuucacaagauggcgccgaaagcgaagaaggaagcuccugccccuccuaaagccgaagccaaagagaaugcuuuaaaggccaagaaggcaguguugaaagguguccacagccacaaaaaaaaagaagauccgcacaucacccaccuuccggcgguccaagacccugcgacuccagagacagcccaaauauccucggaagagcgcccccaggagaaacaagcuugaccacuaugcuaucaucaaguuuacgcugaccacugagucgccaugaagaagauggaagacaacaacacacuuguguucauuguggauguuaaagucaacaagcaccagauuaaacaggcugugaagaagcucuaugacaaugauguggccaagggcaacacccugauucggccugauggagagaagaagguauauguucgacuggcuccugauuaugaugcuuuggauguugccaacaaaauugggaucaucuaaacugaguccagcugccuaauucuaaauauauauauaucuuuucaccauaaaaaaaaaguauaua

SEQ ID NO: 12918 - RNA, 12296 nt, Homo sapiens
uaauuuguaugauugugcuaacaauaaugcuaauuagaguuugauaaaaauucuuuaaaaucacagguccaguugcguucagaauaggugacugcuagggagauugccaucuuccucccaugauguugaagagcucagccuucagacagucuaugcuggcauccaucauuuacuguuugccagggauguuuccuugggcaaguuucuuaauccaccuggacuuuaguuuccuugucuauaaaaugagaacuguaguaguucugacaucauagugguuuuauaaaacuaaaugaguuuucuauauguaagacaguuagaauagugccuggcccacaguaauuguucaauacuugaucaccauuaugaucuuccacuacauaaauuagccuaaaacaauguagucuguuugaucucaccaucuucauuccauuuguuaggguacacacucuuacauugugcugcagccuggggucguuuggaaacuuugaaagcacugguagaacuggauguugauauagaagcuuugaacuuccgggaagaaagggcucgagauguugcugcuagauauucucagacugaguguguugaauuccuggacugggcagguaaggaagcucacaagggguuagcaaacugacugaugugaugaguuuuucuccuaugaguuacaggauaugucaccuuuuuucacaguguuuuguuuguagauacaaccacagucacaguuggugauaauacaugaaauuucccccucuuucuuuguuuugcuauuggccauaaacauuguauuuauuaggaacugaacauauuggaagcuaguugauuuaccaacuucugucucaccaauaauugucuaugagaaaauaauuucuauaagaagauuauuguauguucaauauguauguucaaggccauuuuuugagagacucaggcaaagugggucauuucuuaaauguuuaaaaaauagcauauuugaguaauacauuugauuccucaaauauaaaagguuguaacaauaauuuuagaaagguuuauuuaggcuaaauuaauuuauagugcuaauagucagaauaguagcuacccuuacggcauggggaacuucugggauguaauguucuuuuucuuaaccugguugcugguacauggguauguuucuuugaaaauucauugagcuguaugcaugguuuuuguacuuuucuguuuguaaguuauacuucaauacgaaguucaaaaaauaguacuauuuugaauuugcuaauauuuugcauauauacuuccacaacccuguaaaguauagcuuaaagagauuucaggaagauguaccuuuguaacuaagcuaguauuuaugaaguuuacagcauuuauuuugcaugguuaucugcauuccuguuuuuagcaagcauuuauugaauucccauugugagcauaguauugcuguagauacaauugguuguuccuacccucuggauauuuguuaggugggagauuauaaguuauggacacauucaacaauuauauaaaaauaucagaaagacugugauuaaagguuaaaauuggcagagcaaguauucugugcuauagagugguggaagaauaggaagucagagcauguugggcuugagcugggccuugaagaauggaugggauuugaauaugcaauagagagggaaagggcaugagcaaaaucuuagagcugugagugaaaguggcauguuggaggauggugacaagauugccuuauugaguaguaggucauaguuuccacagguaggcuauaacauagguagaauaauaaaaggguuaauacaugucuucuugagauugaguuuaaauacuggugucccuacuugaaaccuaugugaccuuggacaaggugcuuaaauucucuauaccucaguuuccuucucugaaaaaggggcaaauaauauaguucccaccuuuuguggauugcugugaaaauuaaaugagaugauauaaagcaguuaccacaauaccuggcauguggucagcacuugaaaaaugcugcugcuuuuauuacaccauacccuuaaaugccaggcuaagguguuuuuauuuuauucugggagccacugaaaauuguuauguagaagaggaagaggaugaaagugaacuugaggaaguuucagcugguagugguaagaugcauguucaucaauaaaaugagaaagggacuagaauaauugauagaaacaaggaacuugaaggaaacacauuugggaagaaagagaugaguugugcuuuguagauuauuuuuauaauuaacuguccacuugaacuaaauauuuucuauaagcaaucuuaugucaauaucuucuauuuuuaugauuagaucuguaaguaaaaggaaaacacaaauagcaaauaauucaauugauuccccccaugaauaguaauuuuaggugaaauucacauuccauaauuuuuuuuuuuuuuuuugagauggaguuucgcucuuguugccccagcuggaguacaaugacgugaucuugacucacugcaaccuaugccucccggguucaagugauucuccugccucagccucccaaguagcugguauuacaggcaugugccacuauggcuggcuaauuuuuauauuuuaaguagagacaggguuucaccauguuggucaggcuggucucgaacuccugaucucgugaucugcccuccuuaaccucccaaagugcugggauuacaggcaugagccaccaugcccagcccacauuccauaauuuaaaauccauuuuugaaaaaugacccauaguacuuaaaaaucacaauucaaggacaaauuuugcuguaacuuuucugaaaaauuuuuuggggcuuauggaugugagguauuauuggcuuccuucuucauaauauccaucuguuuaauuugaguccuuagguucuuggagcaauuauaccgaauaugucuuaguggugaaaagaaaugaaaacuauaaaaagcaaacuaguauuguguuuccagaucaaugauuaaauuaauauuggaguuucauaguaauguagcuguggaaugucagaaacauaaauaacucaacauaaaauuuaacauuuauuuaauucagccuuacuauuuguuuaauucagucuuauucagaauggaguuucauaguaauguagcuguggaaugucagaaacauaaauaacauaaaauuuaacaucuauuuaauucagucuuaucaagaauguaugucacuucuguuucuucuagugauuacaguaggaguuaccuggggagacuuaaaggauucagaaaucccuaccccaaauagucuucugcauucuacugaaaauuccauuauuagagauaaauuucucuggguuuuagagguuuggggauuuuuaaagucuucaacaguucaccauuagaauaaauguauauuaauauucucuuagagggaauuagcuaacauuucagaacucugaaaguaugaaacaaacauuucuagaaaugugaaggugggguugugcuaaggaggaacggagguaaagggagucuggaaaguggaacaaaauaaaccuuucguaauccauaauagcccaagccagguacuauucuuuuccguuacuuauaaaacuguaaaguuuauuacuguuucaaguauuauuuuugaaaaguuuuuuuccuccuuauaaugauggcagauauguuauagauauauuuuuucugggauuuuucaagauacuuuaagucaaaucuucugucccagucucaggccuaucuccuagcuguucuuugaaaaauacgguaaccauaguuuaaaaaauugaauugucuugucaacaaaagucugaaauuaaaaaaacauuaaucuauaaucauuuauuauacugaaaaugaaaacauuuauacuuaaaaauuaauauauucuuuaauauuuccaugcuauuuuagcaaucugaaguaggaaauuaaaagucuuccugugguuauaaaauuuucucaggaagccugggugcaguggcucacaccuguaaucccgggacuuugggagaccaaggcagguggaucaugaggucagaaguucaagacagccuggccaagauggugaaaccccaucuccacuaaaaauacaaaaauuagcugggcacaguggcaggagccuguaauccuaacuacucgggaggcugaggcaggagaaucgcuugaaccaggguggcagagguugcagugagccaagauggagccacuacacuccagccugggugacagagugagacucugucucaaaaaaaaaaaaaaaaaaaauucucaggcaaauaagacaagucacagauauuauuuaucagagauguauugaaacacuaaauuaagcuucuauucuauauauaaucuaacacauuaaaaauaacaaaacacuuaaacauguagcagugauaguauauguugggaacaggugguuggugucacaaaaaucaacacugagacaaaggaucucucagcaaggcuaguuuacuuucugcagaaaggguugcugcucgcuagcagucuugccacaagagcgcacacgaagaaaagagacagggucauuuauaaccugaugcauccacccugcugcuguguccgguuuccauuggcuggaauaggaccucacauucuguacucaaccugauuggcuagcaacuuagaacuucccaaaagaggcaaaggcagaggagaacaaaggaagagaggaauuaaccuguggaaugcugagagaggcaaaaacacuuacaaauaaggaaagagaaacaggcuaugaccucaugcuugcuuggaccucuucaggcaugcccaggcaaauaucuaggcuaaaauguggagcuaagaacagaguauauugauuucuuuauuacagcuagcagaauuuaagaauauuagcacaggucuuugaguaaauuuugcuucuaagagagguuacuaucuauucugaaguagacugggaggaaugucccuuugaagaggaaccucuauuucauuuucuacaauuccccccucuuuuauuuuauaauuccucuuuaaacuuguuuaacaugucuugacucaguugcucuguuuguccuuuuaagagaaguaaucuuucugaauagggugaagaaaaguuaggaauuaacuuuguaagaguggcagagacaaguuuuuguauaaaacuuugaaggcagguaauaauacaacagccuaugagaauaaguacaccaauaacaagagcuaacgaggugagaauugaagugaaaaucccuuuccauccccugaaccaauguucugucuuuuagaaaaaggaucaucuaauccagaauuuuuggcaaguucauuggauagggcuguuaauccuuguagcacucuuguuauaguuccaucagggguaguauuauuaggaauaaagguacaacauugaguuucaaucauuaugcaaacaccuccuuuuucugcuaauaucauaucuaaggcuauucuauuuuuccaggccaucuggcugguaggucuuauuugcucagcuaucccuucgauggagucccuaguauaauuuaugaaucauugcugauuguaauauaguuuauccagucuauauuuuuauuuauagauauguaguuaaccaccagaacaauguagauucaaauccuguagcuauuugauuccaugcuuuaaacuuaucuggcacuccucaugggaccccaauagcaucuauguaaaccugaggaucaaaggacucaaauggaguuucccuuggccugcagugucuuguuuuuacuuucgcagacugacgaaaugccagggugaaggggauagucaauuggauuagagcacaaguaccacuccaauuauaaggcagaguguccaguaaagguccuccacaguaccaucauacagcucggggacugaugaacaagcuucuggaaaggccugagcuccuugcaucuuuuuaugcuuccaaggaacacuaaauucuccccuugccaugagaggcaggaaguaaacuuggcauuuagagguggaagcuggauugcccucugggccugacccucaguguguugaacuucaggaaacagcagagagagcuuggcaugauggauuaucccaagcagugggauucuggaagagagccaccauacaguccaugcuuggucaacgaggagcccauccaaguggaaaggggacagucugggccucuggccuaccgugugcacaagcguaacaaucgcuuuuauuuaaagugcgaauggaauauuuaaucgauuucagccaggcauuugcaucuugauauccuaucucaauggcuaaggucugucuuaagauauuucacuuucacaauagacacccuaguuuuaucauuagguguaggagcaacuggugugggauuuaaaacugaggcuaccgaagaaggggaagacuggggaauaaugcauaucucaaaaaugccuagggggucuuucccauuuacaucaauccccauaccauagaagugaacaagggcaaguuuagaaucaguuaagguggagguggugagagagagaaggacaggguuacacugauaaggcugacagaaauaggugagggauuuuagauuugcacaaaccucuuccguggaagucuaaccuugcuccugaguaguucaaaggacauaguuccagcuacugcaagguugccaggcuguaggagcagacaauuggugucucagcugcaggcgaucacaacuaugagagcuaggaauaacugugucaguuagagggcuggggcauaaauauuugugugaaaaggcuagcugucauugaucuuucacaucuccacaaggugugacagagcaagcauuaaaggcaauggucugaggugagucagacuuaguuacauuaauaacaaaggagcuaguaacagaauaaggaaaggaaaggaagcaauauagaagguauauaaaaauuaagcuuucuuuaacuucaacuugguaggacucaauccugguacagcaacccaugauucugacgaggaagcugcuuucuuaacuagaguaugguggguccauccuuucucagcugugcggacggcagucucggugguuaacagcaccagauaggggccuucccaggugggcucgaguuucccuuccuuccacccuuugaugagaagguggucccuggguuggugcuggugugcuggaaauucuagugguggccugugcuaagagaccuuugaccuuaagagaagaaaagguagaggagagaccaaguauauaauugcucaggaacugauccuuaguuuuaaacacaggaacaucagcuuaggaauguaaauaaggcaauccauauaacauuucauauggagacaggccuauauccuuucagggagcuguccugauccucaauaaggcaaugggaagacauuugguccacaguaaaugaguuucuagaacuaauuugguuaaaugguucuuuaaagucugauucauccuuucuacccucccugaugaagguggaugccaagggguaugauacucccaucuaauguuuaaaaccugggauagcuucuuaaugacaugggcugugagauagguuccauugucugagucaauauucucuauuagcccaaauuugggcacuauauucucaauuaaugcuuuaacuacauuauuagcuguugcauuugaaaaggagguagcuucaaucuagugaguugagcugaucuacuauuaccaacaaauacuugaggcaaacgauuggagucauuucagugcaguucauuugaacacuuuggaauggccuuaguccuggaucccucccccuuggaggugauuucuuuaugacuuguuuguugguuuucuuaacauuuuagacaacuauuuguaacuugcuuggcuaggguauaaauuccuauacacccaugaaggcugagaaccaugguuaagaacucccuuaugagagguuuggauaacaucucccuuugaucugguaguauccauuuuccuucuguguucucuuuagcuucuauuuuuauuaacuuuuccuuuuuuaguggaagagaagauggggacugcaguaggggaaggaaggcaaggaguuaagugaaaggcauuuuagaagaaacagcagcuuguuugguuaucugaucugcaaggucauuugguuauuucccugacuugugaaagaaaaguccuuuaugcccugggacauguacaauagcuaucucuucuggcaacuggagauugucuaggacacgaaaaauuaguucuuuguggacuagaucuuggccuuuacuguuaauaagaccuugcucagcccaaauuuuucuaacuguaugugccacgccaaaggcauacuuagaaucaguauaaacaguuccuucuuuguucugcaaauguuucaaagcuugguugagugcaaacaggacacagguuugggcagacuaauuauugggcagucuuccugacucuacuucuucaagaguuucuccaucaauuacugaauaccuauuauguuuuucuccuuugacuauuuugggggaaccaucuauaaaccagugccguccuguuuuaaaaggggccucuccuagaucuggccugacuuuuguuugguagucagucaaaucuagacacgaguguuuuuuaaauuugggucuccugccaagaaacccgcuggguugagugaauuaucaguagucaaggguaaaucaucuuuuucuagcaaaauagccuuauauuucaagauucuggagucaguaagccaccuuccugcuuuuugauuuaaaauagcucuaacuugguggggcgugcuuacaguuaaucuccccccaaagguuaauuuucuacuuucuucaacuaauauugcuguagccacagguguuuaucuucccugucuuacucgaaacauuuccuaucuugaaguuuugggguggugccugggauaggcccuuucccuggagcuuucaaccccccuugcuccuugcuggagguuucuagcacuccuggauauggcagcggcagggggcuggggguggcucaaccucuccuacuagaggcuucuugcccuuccuuccuuuggaggcuugccaagggccuuuucccauguuggauccuagauaggcccaaucccuugugcuagggaugucucgccuauucuuuucccggcaaggcucaaucccccagauucuucagacuggggaugucuuggcugucccauccuuaaaggcuugugaaaggcucaaucucucacaccagagaugucucgccgauucucuuucccugggagguuaaccuuccuccuuuucccuuucggugguuccuuacacccuuccuguuuguguucaugcacucuguccagcaacagacugguagucguucacacacacacacacacacacucagccuccaaaagcugaccaccaaggaaauacuuugccacccucuugcagcuuuuccuaccuuggcccgugcauggagucaccuggucacugugguccugcaagccucucucuuucccugcguugcugagaauccaacuauauuccuugcuccggguagguccuggcuguccuccaggggcugcuacaaugggcaguggggcaccuccccaugagagaggaccaaagacugucccagaggggaauguuaauccccuacgggccaccaaauuguugggaacgggugcuuaguguugcaaaaaucaacacugagacaaaggaucucucagcaaggcuaguuuacuuucugcagaaagggugcugcuugcuagcagucuugccacacaccaacaaaagagacaggguaauuuauaaccugaugcauccacccuacugcuguguccgguuuccauuggcuggaaugggaccucacauucuguacucaaccugauuggcuagcaacuuagaacuucccaaaagaggcaaaggcagaggagaacaaaggaagagaggaauuaaccuguggaaugcugagagaggcaaaaacacuuacaaauaaggaaagagaaacaggcuaugaccucaugcuugcuuggaccuauucaggcaugccagggcaaauaccuaugcuaaaaugugggagcuaagaacagaguauauugauuucuuuauuacagcuagcagaauuuaagaauauuagcacaggucuuugaguaaauuuugcuucuaagagagguuacuaucuauucugaauuagacugggaggaaugucccuuugaagaggaaccucuauuucauuuucuacaguauacaauuucuucucuaguacuuuaguaaguccggguucuuuuuuaauugaaugggaaguaacauuucaacccaggcuucuuuggaaaauuuuaguaaagauuguggcaaaaaguuuauaaagguuuccaaagaacaauuuuuaauccuuagaugauagauuucuuuugugauaucuauaauugacuaagcuacauuugcauaugcauuuauuuaguaucuucuggcuccuucuucuuuacucuucuucuuuaauuugcagugcuuaauuuucuuagaggaaggauggugagaccugugcucccagaucuuguauaucacugaugcugugguugccacucuguggaguguuuggucaauguuguugaucaaugggcuuucuagaucauuaccagguuuuucuaaggaggcuugcuuuuucagcuaaaaggagaaaaacaauacagauuuuaucuacauaaaacaguagaguucaauacuauaguauaguuaauaauauaguucaaauuaaauuuauguucuaaauauguaaacaaaccuuauuaaaacagcacacaucaauuauuuauacuaaaggaagguuacuauagaaguaagguauaagugcagaggaaauguuaucuauaugccacauguaugauccuuaucaccaucagcaaacaauuaguguguccuauguuuaggguacucucuugggagaaauuauuugauuagcaaaauguauucguuuaugaaagaaccucaagguauaacaccauaaaguaauagucauuuuaaaaauaagaaaacauuuauaaauaucuaauucuucugaaggucaaugagguuuuguuuguuuuuugaucaaagagcuuuuaagguugccucucaaacuauggugucaucuauuggcaaagugggaaauuauguaauaguuuaaaagcuccauuucucagaaaguuguucuaauauuagcaauuaguuuauagcccauauaaaaauuacaugacaccuuuuguacuuagauuucuuagauacaucugaaaggguucuaagagaucucuuguuacagauccuuuuguggaugaggcaacugagauagagcaaaugacuuaccuaaggacccagacagauaacuugauuuuccauacauucuccucaugguagcacacuacuuuuuuugguguguuuuguaacuugaaguagagggggcuagaugauucuaaggaccuucuaauucaauacacauuuguugaacaccuaguaugagcaagauacugugcuagaugcugggaaugaaugggaaguugggggaagguuacaaugaggaauaaaacacgguacccucucucaaagaaacuaguaauauuauguucuaaacccuuagagauuuuguaacuauuacuacuuguaucacgaauucaccuuuuuuugguguuucuuccauuucuuccacagguaaugcacagacaaaacaaauaagacgaagaagacagcuuguaauaaauuauaaaugagauauaaacaacccugaaauauauccauguuagcaaagucgcagcauaguuuauccagaagauaaggcaggcagugagauggagaacccuuaacuuuccaauaauguacuucuucuggaagaaucucccauccaaccuuuguccagacaguuccaucacaaaugcagaaacucuccccgaagaagcagauaaacaacagagaaaaaaucagcgguagucuuugauuagacauccuucuuugucaauugaaaaaaaaguagcuaaaauuuagcuauuuuaaaauagcuaaauuagcuaaauaauaaaauaaaauaacuaaauucccuacgaagggaagcagaaaauaccaggagcuauuaguuaaaauggugcuucaauaaaagcacuucauauaaccuugccagucagcaaaauaugcccagcaaaggauacagugaugaucauuguaacaucaucagucauagugacucagggauaaguucagugacaucauaaauaaccacauuggaacuaaaaggugucaccugaccaaucacauugaguuucuuaaagauacuuuuuuguuguuguuguguuguuguuuugccagaaugguuuga

SEQ ID NO: 12919 - RNA, 12296 nt, Homo sapiens
ucaaaccauucuggcaaaacaacaacacaacaacaacaaaaaaguaucuuuaagaaacucaaugugauuggucaggugacaccuuuuaguuccaaugugguuauuuaugaugucacugaacuuaucccugagucacuaugacugaugauguuacaaugaucaucacuguauccuuugcugggcauauuuugcugacuggcaagguuauaugaagugcuuuuauugaagcaccauuuuaacuaauagcuccugguauuuucugcuucccuucguagggaauuuaguuauuuuauuuuauuauuuagcuaauuuagcuauuuuaaaauagcuaaauuuuagcuacuuuuuuuucaauugacaaagaaggaugucuaaucaaagacuaccgcugauuuuuucucuguuguuuaucugcuucuucggggagaguuucugcauuugugauggaacugucuggacaaagguuggaugggagauucuuccagaagaaguacauuauuggaaaguuaaggguucuccaucucacugccugccuuaucuucuggauaaacuaugcugcgacuuugcuaacauggauauauuucaggguuguuuauaucucauuuauaauuuauuacaagcugucuucuucgucuuauuuguuuugucugugcauuaccuguggaagaaauggaagaaacaccaaaaaaaggugaauucgugauacaaguaguaauaguuacaaaaucucuaaggguuuagaacauaauauuacuaguuucuuugagagaggguaccguguuuuauuccucauuguaaccuucccccaacuucccauucauucccagcaucuagcacaguaucuugcucauacuagguguucaacaaauguguauugaauuagaagguccuuagaaucaucuagcccccucuacuucaaguuacaaaacacaccaaaaaaaguagugugcuaccaugaggagaauguauggaaaaucaaguuaucugucuggguccuuagguaagucauuugcucuaucucaguugccucauccacaaaaggaucuguaacaagagaucucuuagaacccuuucagauguaucuaagaaaucuaaguacaaaaggugucauguaauuuuuauaugggcuauaaacuaauugcuaauauuagaacaacuuucugagaaauggagcuuuuaaacuauuacauaauuucccacuuugccaauagaugacaccauaguuugagaggcaaccuuaaaagcucuuugaucaaaaaacaaacaaaaccucauugaccuucagaagaauuagauauuuauaaauguuuucuuauuuuuaaaaugacuauuacuuuaugguguuauaccuugagguucuuucauaaacgaauacauuuugcuaaucaaauaauuucucccaagagaguacccuaaacauaggacacacuaauuguuugcugauggugauaaggaucauacauguggcauauagauaacauuuccucugcacuuauaccuuacuucuauaguaaccuuccuuuaguauaaauaauugaugugugcuguuuuaauaagguuuguuuacauauuuagaacauaaauuuaauuugaacuauauuauuaacuauacuauaguauugaacucuacuguuuuauguagauaaaaucuguauuguuuuucuccuuuuagcugaaaaagcaagccuccuuagaaaaaccugguaaugaucuagaaagcccauugaucaacaacauugaccaaacacuccacagaguggcaaccacagcaucagugauauacaagaucugggagcacaggucucaccauccuuccucuaagaaaauuaagcacugcaaauuaaagaagaagaguaaagaagaaggagccagaagauacuaaauaaaugcauaugcaaauguagcuuagucaauuauagauaucacaaaagaaaucuaucaucuaaggauuaaaaauuguucuuuggaaaccuuuauaaacuuuuugccacaaucuuuacuaaaauuuuccaaagaagccuggguugaaauguuacuucccauucaauuaaaaaagaacccggacuuacuaaaguacuagagaagaaauuguauacuguagaaaaugaaauagagguuccucuucaaagggacauuccucccagucuaauucagaauagauaguaaccucucuuagaagcaaaauuuacucaaagaccugugcuaauauucuuaaauucugcuagcuguaauaaagaaaucaauauacucuguucuuagcucccacauuuuagcauagguauuugcccuggcaugccugaauagguccaagcaagcaugaggucauagccuguuucucuuuccuuauuuguaaguguuuuugccucucucagcauuccacagguuaauuccucucuuccuuuguucuccucugccuuugccucuuuugggaaguucuaaguugcuagccaaucagguugaguacagaaugugaggucccauuccagccaauggaaaccggacacagcaguaggguggaugcaucagguuauaaauuacccugucucuuuuguugguguguggcaagacugcuagcaagcagcacccuuucugcagaaaguaaacuagccuugcugagagauccuuugucucaguguugauuuuugcaacacuaagcacccguucccaacaauuugguggcccguaggggauuaacauuccccucugggacagucuuugguccucucucauggggaggugccccacugcccauuguagcagccccuggaggacagccaggaccuacccggagcaaggaauauaguuggauucucagcaacgcagggaaagagagaggcuugcaggaccacagugaccaggugacuccaugcacgggccaagguaggaaaagcugcaagaggguggcaaaguauuuccuugguggucagcuuuuggaggcugagugugugugugugugugugugaacgacuaccagucuguugcuggacagagugcaugaacacaaacaggaaggguguaaggaaccaccgaaagggaaaaggaggaagguuaaccucccagggaaagagaaucggcgagacaucucuggugugagagauugagccuuucacaagccuuuaaggaugggacagccaagacauccccagucugaagaaucugggggauugagccuugccgggaaaagaauaggcgagacaucccuagcacaagggauugggccuaucuaggauccaacaugggaaaaggcccuuggcaagccuccaaaggaaggaagggcaagaagccucuaguaggagagguugagccacccccagcccccugccgcugccauauccaggagugcuagaaaccuccagcaaggagcaagggggguugaaagcuccagggaaagggccuaucccaggcaccaccccaaaacuucaagauaggaaauguuucgaguaagacagggaagauaaacaccuguggcuacagcaauauuaguugaagaaaguagaaaauuaaccuuuggggggagauuaacuguaagcacgccccaccaaguuagagcuauuuuaaaucaaaaagcaggaagguggcuuacugacuccagaaucuugaaauauaaggcuauuuugcuagaaaaagaugauuuacccuugacuacugauaauucacucaacccagcggguuucuuggcaggagacccaaauuuaaaaaacacucgugucuagauuugacugacuaccaaacaaaagucaggccagaucuaggagaggccccuuuuaaaacaggacggcacugguuuauagaugguucccccaaaauagucaaaggagaaaaacauaauagguauucaguaauugauggagaaacucuugaagaaguagagucaggaagacugcccaauaauuagucugcccaaaccuguguccuguuugcacucaaccaagcuuugaaacauuugcagaacaaagaaggaacuguuuauacugauucuaaguaugccuuuggcguggcacauacaguuagaaaaauuugggcugagcaaggucuuauuaacaguaaaggccaagaucuaguccacaaagaacuaauuuuucguguccuagacaaucuccaguugccagaagagauagcuauuguacaugucccagggcauaaaggacuuuucuuucacaagucagggaaauaaccaaaugaccuugcagaucagauaaccaaacaagcugcuguuucuucuaaaaugccuuucacuuaacuccuugccuuccuuccccuacugcaguccccaucuucucuuccacuaaaaaaggaaaaguuaauaaaaauagaagcuaaagagaacacagaaggaaaauggauacuaccagaucaaagggagauguuauccaaaccucucauaagggaguucuuaaccaugguucucagccuucauggguguauaggaauuuauacccuagccaagcaaguuacaaauaguugucuaaaauguuaagaaaaccaacaaacaagucauaaagaaaucaccuccaagggggagggauccaggacuaaggccauuccaaaguguucaaaugaacugcacugaaaugacuccaaucguuugccucaaguauuuguugguaauaguagaucagcucaacucacuagauugaagcuaccuccuuuucaaaugcaacagcuaauaauguaguuaaagcauuaauugagaauauagugcccaaauuugggcuaauagagaauauugacucagacaauggaaccuaucucacagcccaugucauuaagaagcuaucccagguuuuaaacauuagaugggaguaucauaccccuuggcauccaccuucaucagggaggguagaaaggaugaaucagacuuuaaagaaccauuuaaccaaauuaguucuagaaacucauuuacuguggaccaaaugucuucccauugccuuauugaggaucaggacagcucccugaaaggauauaggccugucuccauaugaaauguuauauggauugccuuauuuacauuccuaagcugauguuccuguguuuaaaacuaaggaucaguuccugagcaauuauauacuuggucucuccucuaccuuuucuucucuuaaggucaaaggucucuuagcacaggccaccacuagaauuuccagcacaccagcaccaacccagggaccaccuucucaucaaaggguggaaggaagggaaacucgagcccaccugggaaggccccuaucuggugcuguuaaccaccgagacugccguccgcacagcugagaaaggauggacccaccauacucuaguuaagaaagcagcuuccucgucagaaucauggguugcuguaccaggauugaguccuaccaaguugaaguuaaagaaagcuuaauuuuuauauaccuucuauauugcuuccuuuccuuuccuuauucuguuacuagcuccuuuguuauuaauguaacuaagucugacucaccucagaccauugccuuuaaugcuugcucugucacaccuuguggagaugugaaagaucaaugacagcuagccuuuucacacaaauauuuaugccccagcccucuaacugacacaguuauuccuagcucucauaguugugaucgccugcagcugagacaccaauugucugcuccuacagccuggcaaccuugcaguagcuggaacuauguccuuugaacuacucaggagcaagguuagacuuccacggaagagguuugugcaaaucuaaaaucccucaccuauuucugucagccuuaucaguguaacccuguccuucucucucucaccaccuccaccuuaacugauucuaaacuugcccuuguucacuucuaugguauggggauugauguaaaugggaaagacccccuaggcauuuuugagauaugcauuauuccccagucuuccccuucuucgguagccucaguuuuaaaucccacaccaguugcuccuacaccuaaugauaaaacuagggugucuauugugaaagugaaauaucuuaagacagaccuuagccauugagauaggauaucaagaugcaaaugccuggcugaaaucgauuaaauauuccauucgcacuuuaaauaaaagcgauuguuacgcuugugcacacgguaggccagaggcccagacuguccccuuuccacuuggaugggcuccucguugaccaagcauggacuguaugguggcucucuuccagaaucccacugcuugggauaauccaucaugccaagcucucucugcuguuuccugaaguucaacacacugagggucaggcccagagggcaauccagcuuccaccucuaaaugccaaguuuacuuccugccucucauggcaaggggagaauuuaguguuccuuggaagcauaaaaagaugcaaggagcucaggccuuuccagaagcuuguucaucaguccccgagcuguaugaugguacuguggaggaccuuuacuggacacucugccuuauaauuggagugguacuugugcucuaauccaauugacuauccccuucacccuggcauuucgucagucugcgaaaguaaaaacaagacacugcaggccaagggaaacuccauuugaguccuuugauccucagguuuacauagaugcuauuggggucccaugaggagugccagauaaguuuaaagcauggaaucaaauagcuacaggauuugaaucuacauuguucuggugguuaacuacauaucuauaaauaaaaauauagacuggauaaacuauauuacaaucagcaaugauucauaaauuauacuagggacuccaucgaagggauagcugagcaaauaagaccuaccagccagauggccuggaaaaauagaauagccuuagauaugauauuagcagaaaaaggagguguuugcauaaugauugaaacucaauguuguaccuuuauuccuaauaauacuaccccugauggaacuauaacaagagugcuacaaggauuaacagcccuauccaaugaacuugccaaaaauucuggauuagaugauccuuuuucuaaaagacagaacauugguucaggggauggaaagggauuuucacuucaauucucaccucguuagcucuuguuauugguguacuuauucucauaggcuguuguauuauuaccugccuucaaaguuuuauacaaaaacuugucucugccacucuuacaaaguuaauuccuaacuuuucuucacccuauucagaaagauuacuucucuuaaaaggacaaacagagcaacugagucaagacauguuaaacaaguuuaaagaggaauuauaaaauaaaagaggggggaauuguagaaaaugaaauagagguuccucuucaaagggacauuccucccagucuacuucagaauagauaguaaccucucuuagaagcaaaauuuacucaaagaccugugcuaauauucuuaaauucugcuagcuguaauaaagaaaucaauauacucuguucuuagcuccacauuuuagccuagauauuugccugggcaugccugaagagguccaagcaagcaugaggucauagccuguuucucuuuccuuauuuguaaguguuuuugccucucucagcauuccacagguuaauuccucucuuccuuuguucuccucugccuuugccucuuuugggaaguucuaaguugcuagccaaucagguugaguacagaaugugagguccuauuccagccaauggaaaccggacacagcagcaggguggaugcaucagguuauaaaugacccugucucuuuucuucgugugcgcucuuguggcaagacugcuagcgagcagcaacccuuucugcagaaaguaaacuagccuugcugagagauccuuugucucaguguugauuuuugugacaccaaccaccuguucccaacauauacuaucacugcuacauguuuaaguguuuuguuauuuuuaauguguuagauuauauauagaauagaagcuuaauuuaguguuucaauacaucucugauaaauaauaucugugacuugucuuauuugccugagaauuuuuuuuuuuuuuuuuuuugagacagagucucacucugucacccaggcuggaguguaguggcuccaucuuggcucacugcaaccucugccacccugguucaagcgauucuccugccucagccucccgaguaguuaggauuacaggcuccugccacugugcccagcuaauuuuuguauuuuuaguggagaugggguuucaccaucuuggccaggcugucuugaacuucugaccucaugauccaccugccuuggucucccaaagucccgggauuacaggugugagccacugcacccaggcuuccugagaaaauuuuauaaccacaggaagacuuuuaauuuccuacuucagauugcuaaaauagcauggaaauauuaaagaauauauuaauuuuuaaguauaaauguuuucauuuucaguauaauaaaugauuauagauuaauguuuuuuuaauuucagacuuuuguugacaagacaauucaauuuuuuaaacuaugguuaccguauuuuucaaagaacagcuaggagauaggccugagacugggacagaagauuugacuuaaaguaucuugaaaaaucccagaaaaaauauaucuauaacauaucugccaucauuauaaggaggaaaaaaacuuuucaaaaauaauacuugaaacaguaauaaacuuuacaguuuuauaaguaacggaaaagaauaguaccuggcuugggcuauuauggauuacgaaagguuuauuuuguuccacuuuccagacucccuuuaccuccguuccuccuuagcacaaccccaccuucacauuucuagaaauguuuguuucauacuuucagaguucugaaauguuagcuaauucccucuaagagaauauuaauauacauuuauucuaauggugaacuguugaagacuuuaaaaauccccaaaccucuaaaacccagagaaauuuaucucuaauaauggaauuuucaguagaaugcagaagacuauuugggguagggauuucugaauccuuuaagucuccccagguaacuccuacuguaaucacuagaagaaacagaagugacauacauucuugauaagacugaauuaaauagauguuaaauuuuauguuauuuauguuucugacauuccacagcuacauuacuaugaaacuccauucugaauaagacugaauuaaacaaauaguaaggcugaauuaaauaaauguuaaauuuuauguugaguuauuuauguuucugacauuccacagcuacauuacuaugaaacuccaauauuaauuuaaucauugaucuggaaacacaauacuaguuugcuuuuuauaguuuucauuucuuuucaccacuaagacauauucgguauaauugcuccaagaaccuaaggacucaaauuaaacagauggauauuaugaagaaggaagccaauaauaccucacauccauaagccccaaaaaauuuuucagaaaaguuacagcaaaauuuguccuugaauugugauuuuuaaguacuaugggucauuuuucaaaaauggauuuuaaauuauggaaugugggcugggcaugguggcucaugccuguaaucccagcacuuugggagguuaaggagggcagaucacgagaucaggaguucgagaccagccugaccaacauggugaaacccugucucuacuuaaaauauaaaaauuagccagccauaguggcacaugccuguaauaccagcuacuugggaggcugaggcaggagaaucacuugaacccgggaggcauagguugcagugagucaagaucacgucauuguacuccagcuggggcaacaagagcgaaacuccaucucaaaaaaaaaaaaaaaaauuauggaaugugaauuucaccuaaaauuacuauucauggggggaaucaauugaauuauuugcuauuuguguuuuccuuuuacuuacagaucuaaucauaaaaauagaagauauugacauaagauugcuuauagaaaauauuuaguucaaguggacaguuaauuauaaaaauaaucuacaaagcacaacucaucucuuucuucccaaauguguuuccuucaaguuccuuguuucuaucaauuauucuagucccuuucucauuuuauugaugaacaugcaucuuaccacuaccagcugaaacuuccucaaguucacuuucauccucuuccucuucuacauaacaauuuucaguggcucccagaauaaaauaaaaacaccuuagccuggcauuuaaggguaugguguaauaaaagcagcagcauuuuucaagugcugaccacaugccagguauugugguaacugcuuuauaucaucucauuuaauuuucacagcaauccacaaaaggugggaacuauauuauuugccccuuuuucagagaaggaaacugagguauagagaauuuaagcaccuuguccaaggucacauagguuucaaguagggacaccaguauuuaaacucaaucucaagaagacauguauuaacccuuuuauuauucuaccuauguuauagccuaccuguggaaacuaugaccuacuacucaauaaggcaaucuugucaccauccuccaacaugccacuuucacucacagcucuaagauuuugcucaugcccuuucccucucuauugcauauucaaaucccauccauucuucaaggcccagcucaagcccaacaugcucugacuuccuauucuuccaccacucuauagcacagaauacuugcucugccaauuuuaaccuuuaaucacagucuuucugauauuuuuauauaauuguugaauguguccauaacuuauaaucucccaccuaacaaauauccagaggguaggaacaaccaauuguaucuacagcaauacuaugcucacaaugggaauucaauaaaugcuugcuaaaaacaggaaugcagauaaccaugcaaaauaaaugcuguaaacuucauaaauacuagcuuaguuacaaagguacaucuuccugaaaucucuuuaagcuauacuuuacaggguuguggaaguauauaugcaaaauauuagcaaauucaaaauaguacuauuuuuugaacuucguauugaaguauaacuuacaaacagaaaaguacaaaaaccaugcauacagcucaaugaauuuucaaagaaacauacccauguaccagcaaccagguuaagaaaaagaacauuacaucccagaaguuccccaugccguaaggguagcuacuauucugacuauuagcacuauaaauuaauuuagccuaaauaaaccuuucuaaaauuauuguuacaaccuuuuauauuugaggaaucaaauguauuacucaaauaugcuauuuuuuaaacauuuaagaaaugacccacuuugccugagucucucaaaaaauggccuugaacauacauauugaacauacaauaaucuucuuauagaaauuauuuucucauagacaauuauuggugagacagaaguugguaaaucaacuagcuuccaauauguucaguuccuaauaaauacaauguuuauggccaauagcaaaacaaagaaagagggggaaauuucauguauuaucaccaacugugacugugguuguaucuacaaacaaaacacugugaaaaaaggugacauauccuguaacucauaggagaaaaacucaucacaucagucaguuugcuaaccccuugugagcuuccuuaccugcccaguccaggaauucaacacacucagucugagaauaucuagcagcaacaucucgagcccuuucuucccggaaguucaaagcuucuauaucaacauccaguucuaccagugcuuucaaaguuuccaaacgaccccaggcugcagcacaauguaagaguguguacccuaacaaauggaaugaagauggugagaucaaacagacuacauuguuuuaggcuaauuuauguaguggaagaucauaauggugaucaaguauugaacaauuacugugggccaggcacuauucuaacugucuuacauauagaaaacucauuuaguuuuauaaaaccacuaugaugucagaacuacuacaguucucauuuuauagacaaggaaacuaaaguccagguggauuaagaaacuugcccaaggaaacaucccuggcaaacaguaaaugauggaugccagcauagacugucugaaggcugagcucuucaacaucaugggaggaagauggcaaucucccuagcagucaccuauucugaacgcaacuggaccugugauuuuaaagaauuuuuaucaaacucuaauuagcauuauuguuagcacaaucauacaaauua

SEQ ID NO: 12920 - RNA, 3597 nt, Homo sapiens
cuucggcuuccguagaggaaguggcgcggaccuucauuugggguuucgguucccccccuuccccuuccccggggucugggggugacauugcaccgcgccccucguggggucgcguugccaccccacgcggacuccccagcuggcgcgccccucccauuugccuguccuggucaggcccccaccccccuucccaccugaccagccaugggggcugcgguguuuuucggcugcacuuucgucgcguucggcccggccuucgcgcuuuucuugaucacuguggcuggggacccgcuucgcguuaucauccuggucgcagggugaguagagggcccgggagacgcgggagagcgucgaagagagaggugcggaaggggcuggaggaacuggggcaagccugggagccugaauuggggacgauaagucggaggugaaguuugggcggaggugagggguugggucugggagauuuguccuuucccgcaguugguuuccaccuuccaaggaucucacagauuccuccuauauuccucccagcgacgucagagaaggcccaaggccgagacucgugagggggcugugcugaccuaggcaggccgagucaggugccuuaggggaggauccaggaacggauaccucgcccuuccgugcucgcacacucuggcugucaucgcucugaagacucuuuaauuagauuucuccccuuuccagugcguucacuuuucuacagaugagucucuugguggagacaguuacccuaccugguccaugucucccuaaccauccggaaggcuaacuuccacuuuucaagcagcuuuggcugguuucccuccuugauuucucuggcucccacuacuauugcuugucucacugccccugucuuuucucagggcauuuuucuggcuggucucccugcuccuggccucuguggucugguucaucuugguccaugugaccgaccggucagaugcccggcuccaguacggccuccugauuuuuggugcugcugucucuguccuucuacaggagguguuccgcuuugccuacuacaagcugcuuaaguaagaagauggaguggucuggaggggagaggggcaaaggacugcacuaugggaaguggggcagccccugggugcugguuuggaagaggaggcacuaagggaggacauuagagggaaaggagcaucccugcccucccucauguuuccccuaccccaccccaccccaggaaggcagaugagggguuagcaucgcugagugaggacggaagaucacccaucuccauccgccagauggccuauggugagccaagggagagggacuggaggagggaguuggacagcccccuccucuagggaagucucuaaauauccacauguucuaaguggcuucuuacuuuccuucauccgucacuuccaaagaaaguuggucuggagggagaguagaugugaaagaauuguaaccgggaauggggaggggucaguggugaacaggcaauagugugaucucugacauugaugagauccucccuucccccaguuucuggucucuccuucgguaucaucaguggugucuucucuguuaucaauauuuuggcugaugcacuugggccaggugugguugggauccauggagacucacccuauuacuuccugacuucagguaagauccaccuucuaucuagccuuuaccccccauccauccuugucccugaucugauuuauuggccuucccugagagacuucuuuggcucaacaucucaggagccugggagaagaucagggauguaucuccuccccaucucccucccugcagccuuucugacagcagccauuauccugcuccauaccuuuuggggaguuguguucuuugaugccugugagaggagacgguacugggcuuugggccuggugguugggagucaccuacugacaucgggacuggugaguuggagacaggggccugaguuagggagaaaagcauuuaauggugagugggaugugggggaaaggguauccucacuucuuaacauuuuuaacuuaccugggaggaggaggaaaggugagucuuucaaggucucucaccucagcaucauuucuaucaccugcucuggggaggagguugaaaggauuagucaaacuguaaugcagagggccugaggugagcaggagcggcagaaaccuuugaguuucugaggagcugaaaaucaaaaguccccuuaaccacaagauguuggugcucugaagggaaagacuggagaauuugagagagauaucugggagucagaaagguacagagagaauauggggauuaggucgagggagaaucuaaucucuuuccuacucuuacccuccuuccuagacauuccugaaccccugguaugaggccagccugcugcccaucuaugcagucacuguuuccauggggcucugggccuucaucacagcuggagggucccuccgaaguauucagcgcagccucuuguguaaggacugacuaccuggacugaucgccugacagaucccaccugccuguccacugcccaugacugagcccagccccagcccggguccauugcccacauucucugucuccuucucgucggucuaccccacuaccuccaggguuuugcuuuguccuuuugugaccguuagucucuaagcuuuaccaggagcagccuggguucagccagucagugacugguggguuugaaucugcacuuauccccaccaccuggggacccccuuguuguguccaggacucccccugugucagugcucugcucucacccugcccaagacucaccucccuuccccucugcaggccgacggcaggaggacagucgggugaugguguauucugcccugcgcaucccacccgaggacugagggaaccuaggggggaccccugggccuggggugcccuccugauguccucgcccuguauuucuccaucuccaguucuggacagugcagguugccaagaaaagggaccuaguuuagccauugcccuggagaugaaauuaauggaggcucaaggauagaugagcucugaguuucucaguacucccucaagacuggacaucuuggucuuuuucucaggccugagggggaaccauuuuuggugugauaaauacccuaaacugccuuuuuuucuuuuuugagguggggggagggaggagguauauuggaacucuucuaaccuccuugggcuauauuuucucuccucgaguugcuccucauggcugggcucauuucggucccuuucuccuuggucccagaccuugggggaaaggaaggaagugcauguuugggaacuggcauuacuggaacuaaugguuuuaaccuccuuaaccaccagcaucccuccucuccccaaggugaaguggagggugcuguggugagcuggccacuccagagcugcagugccacuggaggagucagacuaccaugacaucguagggaaggaggggagauuuuuuuguaguuuuuaauuggggugugggaggggcggggagguuuucuauaaacuguaucauuuucugcugaggguggagugucccauccuuuuaaucaaggugauugugauuuugacuaauaa

SEQ ID NO: 12921 - RNA, 79661 nt, Homo sapiens
aguuccaaagcugaucagucucguggugagcagcgaaacuauagacuucucuaacaaaaccauggauucuaggagggacugggaaagagaaaaacgaauucuggaaggcaaacuacaacucccaaaggcccuugcgcggacucagcgcgcgagggacgaagggcgguccacuguaaggggaaaugcugaggaucacugggcuccucccggcuuucugaacgcaagccagcaagugggcgggaccuggggcgggcggagcggcgaaagcaucugcuccugcgcuuuguggucuccugccuccggcuucuccgccugcgacgucgaagggggcguggccugcgcagaggcuggugggggugcgggcgccgcgggacuugggugacgcgucccuuuccagcucagcggugugugaggugucgcggccccgccggcgauuggcuguugagaggcgaguacgcggcggccguuggucgcuggccucacggagcaaggcccccggcgggcggggaggauauggggcggcaguggcggcugcaggaggcgggcguggacgagccgguggcugcagcggcggcgguccccggaguccugugaagcgccccuguccgcgccucuguggggcccucagagagggcugccaggacgcgagccacugaggagccgcucagccagcgccauagcccuuaggacuaucggucacauucucgcgcuccugcuccggcuccuccaucuuggccucggcaguggcggcugccgggaggaugugccgccuucuggcagggggaagaaggaggagaagaugaagaagcaccggcgggccuuggcccuggucuccugccucuuucugugcucucuggucuggugaguagccgcgacgacaagggaguucccgugaggggaguaaaugggagggagcagcccaggucacacccccuggucauuuuggcuuuuaggguccggguuuccaaggcccccguggaagggacaaaccgauuacuucucgacucuccaucugacuggucugguagugcucugugcggagauuuucaugguguauuuuggaauuuacagagacucagugggagagagagaggugccaagguagagggaaccaccaagugccuuuguacucaguuccucuaccccuuggagacggugcaggguuugggguggguguucagauugaugguaaguaaguugcuccgauuugccgccagucuuugcguucuuagugugguaaggggauaaagcacgucggaugugaugcguuccggacgugcgauuuuaaaacgugaguggucaugaagguaagaguaauguauaagcaguaguucuccuggacauuucucgcacagcguuugaucccaaguacacucgggccgcuguuuuuggaaacuuggggggcguguguguauguguguuaugaagcacuuuuucaauugguuugguggagagggugucuuagauguaguguguguaguaguuuuugguaaugccccuuagugacgggaagguaaaugcuguauuuucaaggcgggaagagugcuuugucccuaaagcacuccuuaaguuuuacggaguuucuguuaaucccaggcacuucuggaguuuuuugaggagcagagaaagcuuguaagucgagggacugcugucaccguacuuggaaaagccauucuuuccucccagggaauuucuucaaagaugugugacaauugaugacugaaaagaugcuucuucagucuaggcgauuugcuguuuguuauauuaaaauagaaauuaaguuuccuguuuugcuuauuucugcaaagcaccaacacuauuuucauuuuuauggaugccuuauggauuccagaagcacugaaauuguagaguuguugcucacauaaaauaauacauaaacaaggggaagagaaaacacucgccuggcugagggauuuuuauuggaagaaugauagaaguuuuugagaacaaaaacaauugacuuauuaccuuucauucugaauccuuuuaauacccgucuccuguuuuuaauaaaauccuccccuuucuacuuacuguguuggguacggagaagugccuguaagagauaaauccacucaccucauuuuaaauuuaaauuuguagauacugaagcuuguauucauuuccaucucuuucuggggcugccuaguuauauuuguagacuguguauuuucuuuccucuuucuucuuggucuugcccaucuuuaaaccauguuauucaucaucaaaaguuucugaaauggcuaauaaggaaaaggugaacacuuucauucaaguuuaaaaacacaccaguaucucuggcuuuuuuuaauuuuuuaauuggaugguguaaacgaaaucaagcaauagaaugugauucuuacaaucauuuguaaauuuaaguuaacucugcuucuauuucuuuugggaauuucuggcuaucuuuugauuaagcuaacccucaguauguuuucucaccuucaaucauuagcucuagugaagagcuaaugaauuucccuguuagggaacaaaucgguuggccugguauugaaaguaguaguaauaaacuucugucaaguuuuuuaacuccuagugaggaaaauggauguggagaguuuaagagugugaacauuuuaagaaacuuuagcuuaagaaacuauuggguuaguauauuuugagauuuguuuagacugccaaauuuagagacauuuuaauuauucuuuagcaaaacgauuaaaaggcauuaaaauaggacauuaaggcuuaaaggguuuuuuaaagggugaugaugaugaaugagauuggggaagaggagugguaccuggugcugauuggcaaaggguauguuuuuucuuugaagccucugcuuuugugccaaguuggaauuaauggcacuuaauggauuucuaacuuuugcugcaaucuggugugguauuucuuuucccaacaaccucauucccuuuaacagaaauggcuaccaacaaguccuaggguuagauaaaacguuugcaagaguugaugagugccuuuuaguagccacuuuugucucuuuuguuauucacaaauugucucaaaauuuugugauccguuucuguuuuguacauugagugcuguaugucuguucuacaguauucuaguuucugagguuuccccucucaugcuaccaauauuacuguguuauguuuacuaucauaauuuuguagaucuugauuaugucuccccucugcuuuugucuuguagccuugaguacuaaccuuagauuauguuuacagaaaaaccauuucaucuaugucauuauuaauuuuuguugcuguuuuuuccuuuugcauaguuuauaauuuuugaucaaguaguauagaguauucuaggcauaaaugcacuauagcugcagcacagagcaaugauagcuaauauuugcugacagcugugugucagacacaugauguuuacuugacaauaacaccuuuaaucuuuauaagaacccuauaagauagguauuauuauuaacuuccuuuugcauuuuacaugugaggaaguagagagguuaacuuggcuaaguuuaagcagcuguuaagcuucggagcuuaaauuugaaccuaggcagcacaggcuccugaguacuuuauaggucagaggccuguauuuuauauauguggcuccaucauuuacuagauauguguucuuugacuuguuauguaacuucuuugaaccuuaguuguuauauccucagaauggggaaauugauccauucauacuucacaggguuguuaggaggaugaaauaauacaaaugacagaucuuuguaacacaguaacagcguauuauguaaauauuucaucauaacauuauucaaccacauuuuguucucauaccuacugugccagauguuuuuaugagcaccgaaaauccaagauagagggucaccagcuugucuugguuuuaacacuggaagucgcauaaccuaggaauucccugcauuaguuucuuaugccugcuguagcaaauugacacaaauuuaguggcuugaacaacacacauuuauuaccuuacaauucuguggaugagaaguccaagauaugucucacagggcuaaauaaaguuaagaugucaacugggcucguucuuuuuggaggcucugaggggagaaucuuuuucuagaggccaccuguauucuguggccccuuccucacaucagcacuccaacccuuuuuucaguccuuaugucuacuaaugacugguccuccugccucuuccucuuauaaggacuauugugauuacauuggguccagccagacauuccaggauaaucucccuaucucauaauccuuaauuuaaucacaucugcaaaaucucuuuuacuauguaagguaacauauuuagggauuaggaugcagacaucuuugaggggggcgcauuauucagccuauacccuauaccauacucccucaguccugggcaaacugggaaagcugcaucacccuaaagaggaaaaaaacauaauuaguggauauucugagugugucccuuaauuaguaaaaccuugugcauccaccuuaauugucuauaaguuauguacaugugccaauauaguaauaguauauuaguguauguaauuaaugcaaguuagauauuuaagaaaaaugagaaaaaaauaauaauuucuguuaacgguaccuuuuguucucauuaaaauaauaauuuuuagugagagcuaugugauugaccuacuagauuauuuuaugucauaguauagaagaggaauagcuucaacuacuuaggagucagcccugucauuuucuuguuggcugugcuugcauuauuaaauucuuugcaguaauuuuuuuaaaagcugcuucccgauguugugagggucaauucaguuaaaacugaauaauuccuaagucuaccuaacuggggaaacauaaaccacagugaaucauggugugcuguaaguaaaacccauuguuugugggacuuccacucuuucccuggguuucuguaugaauccuuacauuaaucuuaguaaaacuuauuuuuuaaaacuaaacaaaucuauucuuccuucaccccaaaggaucaucuuggagaagcuuauauuuagacuuucgggaagagcuugacauuuaaacaagucucauacauuuggcaaauauaacagguacuuacaaagguuuuuaggaacagcaaaggaagaauucauauccuacuugugguucugucacuaacuguaugucuuuggacaaguuacuucugugaaccucagcucucauccauaaaauggucugcaggauggauaguucacaaugagcgaauuuuguuguaggcagagagaacacuuacccaguuaucuagagcgugaguguaugugaggagagaugggaagggaggcuagagcuagguuuugaaaggauuugauuaucaugcagaugaauucuaauucuaaccaccugacagaggaugaguaagugaagugguuuaaacuggagaacaggagcaugaggucacauggaucuuuuaauuagauugcuguggaggguaaaguggaauguaggggacguacuuuggaggcacgagguccuaagucguggucccacuagaagagaguugauaucuaaaucaagauguuggccuuuuuguccuuaguaguaauuuuucugaguaugucagaccaguuuuuaucaguuuaagagguuuauuuccugguuugugauuacauuucuguacccuuuugcuuuuucucucaugauugcuggucuauuaauauacauaagugagcagaaaaaaauuuaaaaacuagaacaauauauaagcuguuuuuucuuuuuugaggugaugaauagagcauauuggaaacauaucgauaaaacauuuugaaaauuccccaggaaaucuggaggaauuuuuuugcuuguuucugcuucugucucuaaacuuucaagguacggaaucuauuucuuuucugaauaauauuugaaauaaauaaaauaauaaaacaaucccacuucuccaaaucauuugaugccuuuuuuuucuuuccuugaauaaaccaaugaaagaugaccuuuacaaaaaugauuuuuuuaguggaacuuaaugugaaagacugaggaaaaaaaguuuaucuuugcucuaggauauauauucugaagaaagcaccugguauuuuuauuuauaagaggugucgggucauacagugucagaucccuucagacaaguuagaugaagccacuuaauaggaaaaggucugugaaagaaggugugugacaucuuugcauaacacuugaacacuguguccaauaaaagacggcaaaugacguguuucauguugguccuuuauguuauuaaacauuugaggauauacuggaauggaagcaggcaguaggguugacaggcaauggaaaaaauaaaagguaucagcucuuuugaguauugguuauuucauuuuucguuuguucaugaacuuguacaucacucuuucacuuuucucaacagucugaauggagaaaagaaucaauauguauaauuaauauucuuaugcuuauaaugaaagggaaacuuauaaaaauuuaagugcuuuauuauucucaagucaucuucaaauagaaacaccuguauguacgugaugcuuuuguuuaguaguuuauacauaacuggaaagagaugaaaucucuugaaacuuaucuacauguuuuagauuauacuuuagugccaguuguauguuauguuuuucaaggccauauuuuagacuaauuuaaaagucaaauuguacaugucacaagggaauaggaaauugcuuuugaauauuugcaguauaagaguguuaauccuuugggaugaauuuguuuaauaaaugcaaguuuuuuugaaagaagauuugguuuuaggacuuuauaauuaauugcuaguuaaaauuauuuuauauuuuacaugaaagugacaccuggcuguaucagaaaguauucuguaacauuaauacgguucauagguacuaagcuaauuuuguauuauuauguagcguuuguaaucuacuggagaaaaaacauguaaaggcuaagaacagugccucacucguaguaagcacuacuguaugaguuauucauugacucuagcuacuuugguaauuuguugaguagaaauaagauggccuagguuucagaguuaaaaaugggaauuuauaaauccacuuaaauauuauuugauuauucacaauguauuuggugugaugaaggauacagaagaauugugagacuugagcucuguauauaagcugcuuguuacaauacagauagugguguagugugaaaggcauaaaacuaugucagagcuugguuguaguucuuucuuuucauuguuaauaugaacauuuauugagugauuauuucucuucuaaguacuaaauacuauucaguguaauaugcauuaaauuauuuuauucucuguauagauguuuuaaggcagacacuccauuuuaaagaugaagaaaggugggcacaaagaaguuaaguucuuaacagcuugcccaaguucuuacagccaggaagcaacagagccagaacuaagaaggccagguucuaagccuguguucucuuaaccgguaugcugugcugccaguuggcugguagauggucuugggcaaguuucuucacuuuuucuaguuaauaauuuuaucuggcaaagugucaguuuuuuucaucugaaaaugugggugccuguauuagccuaggaaggaauggacauuggaauuguucaugaaacuuuuaaaagaaauacgcauaccuaggauucuuaccuuguagauuuugucaguaaguuugugauacucuuuuaugcauucaagucuguauuacuguauuaggugaacucaguuuauuuuuuauaugucuaacauucuaagauacuugauuugaauguuaauaaacaacacauaaaacugaacugcauaguaagugcuuaagaggagaaaaugagggcuagaguucucaaggaaggcuugacuuggguuuaagggaaaugugugguuuauaaacucugcuucugugcaaacaggagcuucaugagcugaaauaagauguacugguguugauaacaugaauaauggcuauuucuuugugugugcauguguaugucugucugccugcuugcaguggguagauggcacuuaauugucaaggagaaagagaguuaugaauggaagagauaaucuaguugauauggguaagagugguaguaaacagaaaagccugaggagaaagagagagauuucagagauugugguagauuuugcaaaccaguccaaagaauuagauaauaaagauucagcaagaaaagugguguugugagaacauuauuuugacauaauugugcuagauuuguuuuuagaggaaggagacuuagaggggugaauacaauuggcuuuccacauccacagauucaaccaaccucagguugaaaauauauuuuaaaaacaauaaaaauaacaauacaacaauaaaaauacaaauaaaaacaauguuguauaacagcuauuuacauagcauuuacauaguguuagguuuuaaaucaccucuagauauuauaugggaggauaugcauagauguuuuaaaucaccucuagauauuuuaaaucaccucuagauacuuauauggaaggauaugcauagauguuuuaaaucaucucuagauauuuuaaaucaccucuagauauuuauaugggaggauaugcauaggugauaugcaaaugccauuuuauguaagagacuggagcauucucagauuuugguaucuucggauccuggauccaaccccuucuggaucccaagggaugaccgggcuaaaaagcccuuggaguaauugaggcuugucauaagaaggacuucaucuuggcaguagaaauaaagaacaggguacaauaaauagagauuuuugaggagguaaaugauuuaauuuugugaaagguuggcaagcuggcaguagugcagugcagugcagcagauaacagcauuaggcuaggauucuaaauaacuggauuuuaguuugccucuaaccaaacucuguucaacauccccuuucuguuguccaucucaaugcaaagagauauuuacuuaggcuucagugugcuguauccuauacaggauucugguggacaaaacaaaguaacugcuuucuuggagcacacugucacugagaguacauucuagggccuaaaauuaugaaucugugaaauaaaguucaaugagaaaagaaauguuaagcauuuuuuguuuguuuucuguuuguuugcuuguuuguuuuaacuugggcaacuagaagaauuggugguggucaaaaagaaguggaagaguuggcaaagggcuuggaaggggaaggagcuguuaguuggaggugaauggaauauccaaguggagacauuuuaugggcacuuaaaaaugcagacuugaaugcagauaaaauuuggccuggagugccaggcacgguggcuuaugccuguaaucccagcacuuugggaggucgaggcaggcggaucaccugaggucaggaguucgagaccagccugaccaacauggagaaaccccgucucuacuaaaaaaaauagaaaauuagccgggcaugguagcgcaugccuguaaucccaccuacuugggaggcugaggcaggagaaucacuugaaccuaggagacggagguugcggugaaccaagaucgugccauugcacuccagccuggucaacaagagcgaaacuccgucucaaaaaaaaagaaaaaaaguuggcuggaguuauccucguaaagcagagguccccagccccugggcugcggaccaguacugcuccguggucuguuaggacccugaccucacaacaggaggugaacagcaggugagugagcauuacugccugagcuccaccuccugucagauuagcagcagaauuagauucucauaggagcaugaacccuacuaugaaccacacacgcgagggaucuagguuguguacuccuuaugagaaucuaauggccccccaccccauccauggcaaaguagucuuccaugaaacuggucucuggugccaaaagguuggggaccgcugucauagagggaaucauuuuugaaagagaacauuggacuuuugaaacagaauaaagaaaggugccaagcauaguaaagcucugaaagaaaggaggaaacuggaaaggauggauggaaagagauuuaaggaagucauuuaaguggucaacaauauaaaaugucuuagauaaguuuggagagcuugaaaacugagaaacuuuucaaaagagggaagugauugauagcuuuugggaguggagaauaauagaagauauuuggagagcugguaggcaugaauuccacacauuuguuugguagccaggagauguagaagaguacauaaaaaaaaaaaaguuaacauguagaguagcuucauacuuguaugcugcaacccauuuuacacagugccacuggauuugucuuacaugcagcuuugauuaugucaguccccugaugaaauaucuuucaaaggcuccuugaaggauaaaacuuuaaaccuugauaauuuuuaaaugccugcagucugacccacacuuacuguuguagcuuuauuuucugcuuuuccuaauagagacuuuguuugagcaugacugaucuguuggccugguaguaauuuauuugaggacuauuuuuguagucucuaauugaaaauuaagguaacaaaacuacugucacuuguguuuuagaggcuaaauacacuguacccaauuucugaaaauauauuauuaucaaguauagggcaugauuauuuccagcaucuuagaggacaaauuguauuggcugaauuucuaaugguagguuauaaugguaggauauaaaaacagaacauaucacauuuguuuacuaagugcuucucuauguuggaucaaugaaauuaugggccaguuuagugaaacaauuuucuaauagaauuugauauguggaauauuaagcuaagaaaauuuaagacccaauccuacaucagagugaaguuaaaagucagaacuacugaaaugcaaagguuuaauuagaaacaggcacuagaacauagaacuuucucagcuaagcuguacaauugcacgugauuugacuauggacuguugaugcagccaaauagaauaaaaacugcaaggagaaagaggcccaguaugcucuuaccuauuagcagauagaccaagcagaagagaagcaaccuuaaaagagcuccagacugauacgugguuuagaagaauaucugucuuuuaauaaaacauugugauggagagaaacuagguugcuuaagcaaaggcacuagaggccuggugaucuuuuggucuuguuuuauuaccaguguuugaccaaaauggcuuccacauuauucacccauuucccacaaguuucucaauacuuacaggauuucaguaaauuuuuucagauauccaggaaguaauauucaaaaacuacaauuuucacugauaacuuuaaccauacugcgcuaauugaguggcuggcacuauauuucuguacaagggauuaacuuugaauuuauguuuaagaagcaauucuuuguugccuaguuuaguuauuucuuuuaccacaaaguguuuucucauucuucuuuuuaaagcucugaaaaagcuuuucuaauucauaguucaaaguaggagcucaauagaucaucaugcuggcaacagggcaguguauucucugccuuggaguugcuuagucuuaugugagaaacaaaaauaaacaguuaauuucauuucaguguguaugugcucagguagagauagccaaagggcugugggaauuuagagcgggccacccaccaaccccagauuguggaaaucaggaaaauguuuuagacccuuauuaguuucuugccccaagagagaagaauuauagguauugaguuauguuuuagauagugggagugggagcagguacagaacauucuugaaagagggaacagcaugagccagagacaugagacagcacagucuguguucaaggaacuauuacagguagcucuguaucgcugaagcauaaagugaaaggcagggagagugacaggaaauaugaagcugaagacuuaguagaauuuuagagauuuuuaaauagcauguggagagaagcuugaguuuugucauguaguuaauggagucuguaaaaggucuuaagcaggggaaugguagugugauaauuuacuguuagauuuuuggcagaggugugaaugguugauuugcagacguagcaaguuaggaauuagggagaucuguuaggagguugcucuagguaagagauaagggcuugaguuaaggcagucagaauggggauugagaaaugauuugaagaaauuuagaguagaauaaacaagauggucaagggagggugaaggcaaaggaguagucacagguguuuuucagguuucuaguuugaggacuggguagauagcaguaccagauggugggaucaaggauauaggaggaagagauuuggaaaaggaagcuaauguauucaauuuuggauuuagauguuuuugagauaccuuggaauaugaaggaagagagaugcaacuuuuaaaugagcuuuguuuauccucaacauuaagguaggguaucacagaaggguuuuaaggaauggaccaguuaggaaaagauaagggcugaagauaaaguuucaguagcugucaacuaaaaaccaugagaguacguaagucuccuauguagaauauaaagggaagauuucagaaccaaacccuuggagcaucagaauuuaaauagugaacagaagcagcauaucaaaggagacucagaaacaagagucagugugagaugaaaagcagaaguguguaauuugacaagucaaagaggagaugguuuaaguuaaaacagcagucagagguaccacaugcagcagggaaaucaaaaaaagcuaacuucugccacaccauacuagucucagugguacaaugaggacagaaacuagauuucagcaggcugaggacuaaauagaaggugaaaacauugagauuacaaguauaaacuacugugaaauuugauaagugaaaguagacagaaaagguaguggcugauaauaacugacauuucagcacauauucugugccaggcuaagcauagcauauacauuuauuucaguuccuccuaauaagucaauuuuacaauguugauacugaguugaggcauauaggcuggccugccugccuuccguccuucuguccguccguccguccuuccuuccuuccuuuccuuuccuuuccuuuccuuucuuuccuggcagggucuugcucugucccccagucuggaguacagcagcaugaucaccacucaccgcagccuugaccucccugggaacuggugauuuuccuuccaccucagccuccugaguagcugggaccagaggugugcgccaccaugccuggcuaauuuuuguauguuuuguagagacggaguuuugccuuguugcccaggcuggucucugacuccugaucuccucuuaaauuuguccauacucuuggauuaaaguauuaaucuaauuuuuacaaauaaggaaacugaagcucauaaguugcccaucacucaccuugcaaacuuagaucucucuccaaauuguuggauuuuuccauauugcuacguuucauguuuaauauuuucuagccaacagauaaaugaaaagaaagguaagaagauaacacuguuacauucacucaagaauuggugauacuggucaaagcuagauacagcauaauacaaaaauaaaacaacuaucacaaaggagaaguucugauuaacuacuucaugauuuucguaguggcaacaagugauaaauaugaaggccguguaguaguggcuaagaggcgcaggcuucagagucaaaaaaauccaaguuuuaacccccggucccucacuuauuaauuacaggaucuugaacaaguaauaaaaccuguauaggccaggcacaguggcucacaccuguaaucccagcacuuugggaggccaaggcggguggaucacuugaccccaggaguucgagacuagccugggcaacauggcaaaaccccaucucuuccaaaaauacaaaaauuagccagacauuuuggugcuugcauguagucccagcuauucuggaggcugagguggaaggaucacuugagcccgggaagggggaggccgcagugagcugagauugcaccacugcaccccagccugggugauagagugggacccugucucaaaauaaauuauguacagcgaaaugcacagaucuuaacuguauaguuggaucaguuuugacacaugcauacaccuguguaacucacacccccucaagauauagaauauucucaucacccuagaaaguucucucaugucccuuucuggugaaucccccagaggcaaguagugaucugauuucugucaccauggauuaguuuugccaauucuggaacaucaucuaaauggaguuauacaguauuagcucauguguuugacuucuuuuacucaauguaaugucugagauuuacccauuuuguuuccuuugucauuaauuaguuccuuuuuauugcugaguaguaguacacuguaugaauguacuacaguuuauuuauucuucuguuagugguuaucuggacugcuuccagguuuucgcuauuaggaguaaaaacuacuauggacauucuuguacaaggcuuuuuguagacauaguuuucauugcuguugagaaguaccuaaaaguagaauugcaacugcugaaacggauauuauaugcuuuucgauacaauauccugagaaagucacaacaucauuauaauauccugagaaagacacaaugaaggauucugacugagaauaccuaaucugaaucuggucaucaugauacaucagacaaaucucacauaagaaccauauuauuuaaaaagaaaggggacuguagccuucaaaaauguuagugccacauaaaauaaagcuccagaacuguuccaaguuaaaugauacugaauagacaugacaaaugcaggacaugaucauagauuuaauucuguacuggagaaaggaauucuaaaaaagacauuggauuaauugacaaaauugcaauguggacaguaaauuuuugugucaauguaacauuuacugaaguugauaccuguauuguaguuaugcaagagaauaucccuauucuguggaaauagauaucacaguauuuuagagguaaguuacugggagagagggaacagagggagagaggaaggaugagugagcaugggcaaaugacaaauaauggaacaaauuaaguaaaauauuaacaauggauugauacagcuaaagcauuuguagauuuuuuuuuguacuaugcugccuacucuucugaaauuugaaauuauuuccaaauaaaaaauuuaaaaacgguuugaauuuucuccugugugugagaaguugauagauccauucaaguuuaucagucuauuaucaguuuuuuccauuccuuaugccaguuuugcaauguuucuagaaauuuauccauuucuccuguuuucaaauauauuguuauauauaguuuauaauauuuuauaauuuuaaaaauguuuccucugugguuguuuuuucuuuuuauuccauauuguguuaauucccauuacuaucuucccuuuauugguuuugccagaaguuugucuaauacuuucuucaaagaaccaacuuuugauuuucuuaauuuucuuugcuguuuuuuguucucuauuuuagcaaugccuauccauauauccuuccuuguuucuuugcauuuguacucucuuuuaucuuuuugaguugauuagcucuuuuguuuucagcauuugucucaauguauucagaagcauaguuuuccugcuauugucuuaucuacaucccaccaauugugauugguagucuucugcugauuauuucauaauauuguuuccucuuuaaccuaaggauuauuuugcuacauauuucuugcuuccaggcuugggauauuguuagcugucuuucuguuauuucaaauuuuguugcagcaugguuggagaauauaaucuuuuagagcuugaguuuuuggaauuugaggcuucuuuugaggcuuuaguuuacuaucgguauuugggaaauguuccacguguccuugagaagaauguuuuaauuuauaugugguauaaaauucuguaucuuugagcuucuuacauggaauauaaauaucauuuuguccacuuaaucuguuauuuugugagguaauuuaaaauagaccaccauacuuuuuguuuauucucuuuccaccuguagcuuugccagugguuguaguauauuuucuacauuguuaggugcauauauauuuguaauucuuucuucuuuuuacucauagauaauaaaucgcugucuuaauaacauaauguuuuccaucuuguuugguuucuauguuaauuaaaauggcuacuuuguuguuuucauauuuucuuaaaacuguauauacuuacucaaauuuuuaaaugaguugaaaauuaccccuaauguuuccuaacauaauaauugguacuuacuggguaaucuuacaugcuuguaaaguuucuucauuaaaacucagaggaaaacaauucauuugaaagugacagacuccaguuuaguuuuauuagccaagccuaauaauugcagacuccuucuuugcaauuauuaggcuuggcucauuugcauauuaguauauucuuuauugcacauuaaugugucuuucuggaauucauuauugcauuauuuugcuagauuugauaguaugauaaaaaacaaugguuaaagauagcugguucaguaauucugcauuaggcagauauaaaaagcugucauugcaagccauuggauaucauuuuuaaaagguauuuuuuucucaaucacuuucacauuaaagaaugcuuucuucuguaaugaaauuucccuuggcacaauaaagaauguuuucugcuuucuuaaugaaaucuuccuuggcucuucaguugcuauauuguuuggaaaauuuuuccugagucccucugcuguucuuuuuaguaagaaugaauugauuucucuuuuacccuaauacuuaacgauuauuuuuuuagacacauaguuguaacauacacccuuaaaauggcaggaugccuagaaguauuaaagaucguagguugccacaacaagaaaaacuugucaccauacauucaaguugaaaaccuuccuucagggaaaaaaaaaaaaaauagaaauacaguuucuaaaaugaaagcaguagguuuaagaaaagauuaaauccccaaagucugucuuuuaaaccuaggcauuccauuucuucugguguuauuugggugcuucugauaaacuaaccuaggcugauugcccucuauuccuuguuuacagcuaucuuccugggauuugucuuucuagucacccuggggguuuccuuugccucuguuaucucaguaucauauugcuguaauuacuguaguuucauauagaucuagccccucauauaagaauauucuugacuauuucuggcuuguuauauaaaaagucucccuuuuuaccaccucaguauguaguucaaacuaccccuauauauuauuuugaauugugaaauugacacuuuuuccaaguaaaaggauugucaaauauuggcaauuucaaacaguucuacuuacuagaagauuucuugccaaguuucuaucuggacacguuauuguuucuaucauaaaugaguccuuguuaugguuugagagaguguugauuugcuucuuaauuuuauacuugggaauauaauuuuuauaucugggacuucuuuuaauaggugauucuuuugaauuuuccaauuauauaaacucaucugcaguuaaugcagauacacucauuguuuggaacuacagauaauuuuacugucuuuuccauuuuuaugccucuuuuaucuucauguuuuguaaugcuaaugaaaauggacauucuugucuuauuucagaucuauauaggugucuuuuuagguuuccucacuaaauauaauacugacuuuuaguuuuauguauuacauauguauuuuccauguuaaauauauaauuauuccuguuucauuauugauucuuaaaacauugauggauguauaaguuuaucagauguuuuucaguggcuauggauauaaucguaacauauuuuuccuugauauuuuugcauagcaaaucaaguugauuuuauuauguuggacuaguuuugaaugucagagcuuaacucuacuugauaauaauugugguauauuucuccuuugguauguuccuagagacuuucuuuuuuauuguuuucuugauaaguuuugcauguuauuucauaaguacuauuaaccucuaguauucauuuauguaugugcuauuucuguuaguuuuugauaucacuguuagguucucuaugcaaaaauaauuuggaagcuucuaugcuuuuaaacaguugagguaacuuuaggauuaucuguucuuaaauauuuguuagaauuuauaagaacugguacuuuccgaggagguuagcuauuugacagcuuucuguguaccuugugugauaauuaucagauacugcuucuggugaagacuuuccuguuguaccuucauggaauucauaaugucuuacuuggaaugcugauaauaauguuuauguuuuucuuauacguauugauuuucgucauuaaauuguuaaaagguauuaggauaggaaccaucugucuguuuaucgccucaaauucuagcccauauagaaauauguugacuuaacaacuuuucuucuuucuuucucuuucucuuuuucuguuuguugguggugguggguguuuuacaggcuucccagcuggcguguauguuguaaagagaguucuucagcuucagcgucaucauauuacucucaagaugacaacugcgcacuagaaaaugaagauguacaauuccagaaaaaggugccuuaaauaaaguuaacauuauaauuugugugucagcuuucugagagugucugaaaacauucagaauaaaaguaauuucaaaaaugccaugccauaauuuuugguggagauucguauuuuucuuugcuauuacucagguaauucuuaaauuaugacggcucagagauauuuauauguuuauucuuguugcuuguauuuggaauuuuguaacauccuuaguccuguaguauaggguagugcauguucagagagcugaaaaugagugauuuguuuuuaaugaucuauaauagaguuuuuaaagaaaccccaauuuugcaaaugagaacuauuagaagugaguauuccagggagaaucuacagucaguggcuuuguaguuuguuuuauguaauuaggugcaguaaauauaaagacuccaaaaaaccucauggucuuaaaacauguauuauuuuaccauucuaaaugauaaauggagaguauugacuugauuuggcuuuugccuuuaacuucaguguauuuauuuaaaauuacugaaguaauuuauauugguauaaaauauuuauuauuuaugucucauuccuuuccccaaaggaacaacagucuacuauuucuugugaaaacguuuggaccuuguucuguggguauagauaacaccuuuauauuugcccacaaauuaauauuuuuauuuccaugaaaauaucauauaaauauauuacaaauugccaucccccuuccccuccagugauagcucauauaucaucuuuucauguugauauauucugaauggcugcauuuuaaucuuguuauauagacauuauuuaucaguuguucuuuauugacaaacuuuugcauuuuguucccugccaugugugcacacauguggguguguguaucaacacauacuuacaauuacauacuugaggguuuuuugggcauauuuagaguggauuauuuaaauuuaaguuauguuggauauauuucugggauggagcauuuaaaauuuugaagacuugccgcauaucucaaaaaaaacuauaauuuuauauuuucacccacacaguauauaagauuuugauuuaaucccccuuuugaugaagcauuuugcaaacaaaugucauaaaagugaauuuaagcaaagcauuaagggggaaagcauguucuuucaguaaacauuuagauaccuaguaugagcuagauaggcucagguaaacaaagauugaauaugaacuuuuaugaaaauuacacucuagaaggcauaaagguauuagaaauucuaacuugaauguaugucaaaaaagagaugaaagaaagagcuuuauguaucuucauuugucagguauucauuggaguuuuacuaggugcuuacaacggugcuggaugguaagacuaaaaugcuuauuaagaaaucaaaugaaguucuugaacugguguauugcacauuuuaaauguuguagcaaugaggggauucaaggaaauagacaauaaucuuguauacaaaugaaauuaauuagagucaaauaaacaaggcaguuuuuugguuuuaaaguauggaaaaaaaccaucuucguauugcuuuauaacuguuuuguaaaacaguuuuaucaggugauuuuuguuguuguuguuauauaggaugaaagagagggaccuaucaaugccgaaucauugggaaaaucagguucaaauuuaccuauuucuccaaaagaacauaaauuaaaagaugauucuauuguggauguacaaguaagcuaugucgcuuugauuuucaauaauaugucauuucaaacuacuuuacaagauugaaaaccuuuggucaccauauuguguguguauuguuaguuuuuucacuuugagguacucuguaacuggacuuaagauuacuuaccugcuaauaguacuacuuuugagaacauguaaaauuacagauaauaauaaaugugacuagucucuugguaguaaaaguuugaguauaaauccucauuucuuccucgguucuauuuugguucauuaugauguaucuugucucuucagauuuucaguuguuaagaaauuuuuuucuaaccugaaucacuuggaacaaaagggaguauuuuuauguagaacacagaguauuuugauaaccaagauuuccacuuauuguggguaugaauagauaauagaucaaaauauguuuuuucccuuuuucucucauauuacauucugaauauuguuuauuuugugcaccagacuuuaugaaaaauacuaaaaacuagaauauauacaccauaaacugaucagaaugcugagguaucuggaaaccauguaauaucaguaauggcugaagguacuggggauauuuuaucuguaggcagaaggacuaaggaaaaacuaaaaucucgaauauuaaaaaaagaacacacauuucaacucagaaugagggagaauucuuucuuuuuaaaaaaauacagccuuggcuaauuuuuuuuucauuuuuuauuuuuuaaccuuguacuuuuugcaagagccagggcuauuuuauaacuuacugaguuaucuaaagcaauagaauuaguuucauuuuauuggauucuggaagacauuugucaaggguuuaugcauaggaguaagagaaaaaugauacuuguagcccuuacaauuguaugacuauccugaacacuccuaccguuauucauaaaacuuuuauuaugauguaguugugcucaaauacuuccgagugcuuaccaugucuuguauaccuauguuguucauuacaguagccacuagccacauguggccauuaagcacuugaaaugcggcuaguccaaauugaaauuuacuguaaguguaaaauacacauuggauuuugaagacuuaauuaaaaaauagcauguaggccgggcacaguggaucaccugaggucaggaguucgagaccagccuggccaacauggugaaacccugucucuaccaaaaauacaaaaauuagccaggugugguggugcacgccuauagucucagcuacucaggaggcugaggcaggagaauugcuugaacccaggaggcggagguugcagugagccgagaucaugccacugcacuccagccuggggcaacagagugagacucugucucaaaaaaaaaaaaaaaagcauguaaaguaucucauuaauuuuuaaauuuugaauacauguucauaugguaauauaguauuugauaauaaggcaguagucauuuucucaaggccuccaucauaaaaaugcagaugacuauuuauauuuuuuugugaauuucucgguguaaauaauuccccaaaugaucauacuuuauauucuccggacugcgugccucgauguuuguuugugcucuuguacuggcccuccuuuucuuuaaugccuagcucuucuaauucaucauaguccuuaguuucuuuuuccuugagcugaacaugaguaccucucacuugauauucauuuauugagcauuuaaacaccuacugugcgcuagauacugugcuagacacugggaauaugaggaucaagagaacauaguucuuacugaggacauuuaugguauaguugaagaagagagggagacaugaauaauggcaauugaguuguuauagaugcagugauaaaaguguacagagaacacuggaggcauaggggaaagggaguaguuaauucuguuuaggguugaucuuggaggaggaggugcugauagagguuuucaaauaugaacagguguuagguagauuucacauuguguuuuggaggacugaaaggcccaggucauucaagacugaaggagcaguaagaaucauuuauugcuucaugguguuacuugaacauaucuuauaucguugcuuauugauacacauuauuuccuaaacugcucagggucaagaacuauguauuguacuguuuuguacauguccauaggguuucuuuguugcuacuaucauucaucaauuagagaagagggaaaucucuguagguccugaugcaaaguaggaaauagguagggagaaagugcuuuccuaguuuaugaaaugccaugaaaaaugcuuagggccuguauuuucauaugaaaugcauuccuuagggcgguaauauuggaagaaaggauuuuuauaaaaguacuuuuuuuagugaacauuguuuauauugucauuuuucagaaaugcuuuccauaaaugcccguucugcuaaagagauguuauauuaaucucaacauuuaauuuagcugacuuguuuuuuuaaacagaauacagagucaaaaaaguuaaguccaccggugguggagacacucccuacaguugauuugcaugaagagucuuccaaugcaguuguggacagugaaacuguugaaaauauuuccagcucaucuaccucagaaaucacuccaaucucaaagcuugaguaaguuguuacaaaaaacaaacacaaaaaagaaucuccuuaguuagugauagaaaaauuuccuuaaaagauaaagcagcuugauacucaaguuugaaguuuaggcuauauagcagaccuaaauuacagugcuuguguuuugugugcguaugugugcaugcguuuguguguuuugaauguaaugauuuuauaacaaguuuauuuagcuaacuaacucaaugaagcugauagaucccagauaugaaaucucuauauagucugagcaaaguaagguucuacuuaggaaacagugcuuauuugaauugaauucccuauaauuaucaacucaaaugucagguuauucauuuccauuaaguaucacugucauuucauucauuuuuaugucuucgugugaaucgcuaacuuuuucaaacucgauaauaaauauucagaguguuuagguuuaagugauccuuaauuuagaaaauuuguuauguacuucuccuagcuucuuccugcagcaguccaaagaacaaaacaaaauguccuucucuuaauacuacauuaagcauuuccuuuaucaaaugaguugacauaaauaaagugcaagaagaauaacugguacauaacucaagaauguaagggccuggguugaaggaguugcacaagauauuaugguuaccauuuagaagcuugucucaguaugggccagggaacagaagacauguugagaaauaaugauaguauuuaaacuuuuaaauuuaaaugauucagaaggaauuuaaggcuagauacuauauaucugaagagugaaugcuauacucccauuauauuaaaaaugacugguuaaugaaauggaggugaggcagggaaaaauaggaagguuuauauuuuaaaaacgaaauucuaagaacaccuuaaaauuuuagugaaaugucuugagauaaugacuuuugaaggaugccauaaguaacaacuuuaaugcugguagaauuaguauaguaaugauggaaauuaaacuuuagagaagauacauugagaauaaguaauuuuuaaaaaucuuauuuuugaaagaccaaauauuaaccucauauuugguaaguaguuauuuagaagcugaggacaauaacagaucaagucagcaauugacuuuacaugauuuaaaauuuucuuucuuugguuuacauuauguuuuggaaaucacuaauaguguuuuuaauguauauuaccucaaguuuauuuaauuaccagauuauguuucuuguuucuuuuuuuagugaaauagaaaaaucugguacuauuccgauagccaaaccaagugaaacugagcagucugaaacugauugugauguuggugaggcccuugaugcuagugcuccaauugaacaaccuuccuuugucaguccaccugacagguggguaggagcaguuguuuguccuucuuaugauucuguaauaacagcaguguccuguuugaauggacuuugguguauguuaaauuccacuuugauugagagaaagcugaucucuuuguguuucuuccuugguuuacuuugugcaugaguucaaagaauuuagauuguauagaauuuguuauccaguaaaaucuguuuauuuaauauaucuuuugguuuuaaacagccuuguuggccagcauauagaaaauguaucaucuucacaugguaaaggaaagauaacaaaaucagaauuugaaucaaaaguuucagcaagugaacagggcgguggugauccaaaaucugcauugaaugcuucagauaauuuaaaaaaugagguagguauauaacuugcacuaucucuuacuucuuuauguaaugcauuuuuguuauuagcuaagcuuauaauaauuugcuaacuauauuugucauaaaaucagggagauuaaguagacaauaacauguggaacuaacacgaacugugcucccugagagcaagugauucuguuuccauuauaguguuuaucacauaaaguuguuucaagugugaacucucucugguuauauauuauuaaaugauuuugugccacccacagcuguuugauagcagauacauaaaguccuuauuuaaucaucuucuuagaaagcuaucuagaagaagguaugacuaauuacauuuaauuaucuucagaauacaaguuaauaauacaagauuaaauuuaggcucuucagucagaacuauuuuaauggaacauuuuaccuuucauuauuugugugcaaaauacaaccagaccaccuuauauuuuagagugugauucuuauaauuaaggcagggcuuaucacaguggaacaguuuuacuuucuuuucuccuucugaguucuaccuugacuucaugcacuguagaauuucuugaaauaguaucaacacagcaauuuaaacuucccucagguaagcaauaacuaaguuacagagaugaaguauauuccauaaacuuaacaaaaacaaaaauaaauaggguccaugaguaguucagugugcugacuaccacauccauauuuauuccucuuuaauuuggggaucuuuuguucucugcuuucuuuuucacguauuuucagugaaucuucacuuacgacuaacuaaacuucauucuggagacuuucacuaucacgggaccaacuguuuugacgauguuucuuacaaauauaggagcucaggauuucauagucuaacaucuugaaggaacuacuuuucucagugauaccaaaucacgcauauguuaaaguuuaguugucagauaucacauccaugaauaaaauuagacaaacguuaaaacacaucuuugaagguauuuauaauaaugucaaauguaaaauucaagcauggcagcuaacuuuguccuagauuugcuuguucuccuuagcagacugaaauuucuuuauuaccuuagagacuuaaacuguuugugagucuaugcuaaucggcaaaagaguagaauuuuaauuaacuguauuaauuacuuucuaaaugaauuaguaucccagaaaaaucaugacagauaaugagcacauuaugaguaauagccaauaguuuuauguaguaucuacuucagaauaacucugucccguuaaguuugugugagugggagagaauuugcuuucugaugccuugugcuagccucuuauuucaaggaucugugagacacugauugccguacuuauacagagaaugcuuuccaaacugauuuuguuguauuguuuauagacagugcauuacaaagugauuuuuauuguauuuguucucuuauuuguugcuaggaggauauagugauuucuuuggcugggcuucaaaggguaaauguauguucuuuuuguugcaguuuuuguauuugagcuuuacuuuguuaguaucucagcuagguaaauuuuuauaaguguauguuucuuguuuauuuucucaauguaucugaugcaggacaggcaagccccaaaauuagugcuuagcccgggaggguucuuggcuuagcccaggaaagaauucaagggcaagccagugguauuaaacagcgacuuuaauugaagcggcaguguacagcagcagcagcagagguaaugcucuuuguggaguagggcuaccccauaagcauugugcccagaauagcagcucagaagcaguucugcagucaugcuuauauacaauuuuaauuauaugcaaauuaaaggguaguuuaugcagaaauuucuagggaaaaggugguaacuucuggguugucaggcaguuguuaugggaagggguaguaacuuuuggguguugccauggaaagaggugguaacuuccagguguugcuguggcagugguaaacagacauagcacauuggugggcuuggcuuacagaaauuugcuuccgucugggaccuguuuuagcugguacucaauuugaucugauguccaagacccgccuccagaauugaaucccaccuucccaccucauuccucccucagagauuagauacuccuccuuaaucuuaagaaggcugcacaaggacagagauccaucuucuguaacugcuuccugcugaguuuacaguguaggcccugucuagcaccagaugagugaaaaucuuuggauaacugauaggggcccagagacaggaugaguuggaagccuugugcuaacguuaucuuuaccuggaacuguuguaaucuaagacaaaacuuugcuaagagguuaaacgagcaaggaccaaaaauuaguaacaagacagccuucaaaggucccagaagagguagguaaaagccaguugagacuugcgaaggcaguuuugauaguugaccagcuguaguugcaaugagugcccugguuauaucuguaaccagguaguuuacucauagaucuuuugaauguuaaucucaaccugucuggaguuguucauauaggugcagcagguuuuauuaauaacugcacauacucuaccuuguucagcuaguaaauaguccagugcuagucuguuauugagaaauacauuugccaaagagucuagggacucuugaauucucuuuagugcaugaccuguguugguggcuaaggauucuaggguuugagucaaguuguuuaggguucacuuuaagcaaagccacccaaggguacugcugcccugauuccugccagaauuaauccuauugcucauuuacuucugguguuacuaugacugugaucccugaaggggcaagaguggcuaacauguauucaccucaguuccaaguuuugauacauaagggaaagcuacuccuaaaagagaagauguugacuuuuaacuauccagaauuaaaaaacaaaaaacagaugacuaccucgggagucaggagugguuaugggguguaacuucuucccauucauggccacaaagaaaaaugagcugaauuggggcacaaauggagacccuauggggugugaucuuuauucuuuguugccaacuugagucuauagagauacuuucccccuauucuaauggggguaguugaacaaucuuuguuuucugaaagaggguggcaccgccaccuucccagacuagauaguuguuuuuccccuguauauucuaauccaggagaagccaccauguauggucuccuugcuuucaaguggaaucccauuuaccucacugcagcauugguaucuuggcagcuagaguuguauucagagcauugcagggaaacuucugcuuuagugucauuagcacaaaagaugcagaagguaggaucaugagugcacuggagguauacauacccaacuucccagguccagguaaugguggggagguucagguggauuucauucaguggggggaguucauuccacuuaucaaguaaggguuuggguauuucaggauugcugugguuaguuaggaggucugugggggauguuugugagauuuuuuggauaagucagaagauugaaaucuuuauccuggggauguugaugacgaaucuagcaaccaugaagguggugcccugaugcuauaauuuuugaaauauuuacuguagaauuauguuucuacccacaccagcucaggguaauugggagagcaaacaagauuaauagugacaacaugauaucugcgguugggccuuagcauggccucuacacccaauaaggacaagagagguguuuccuaggagguuggcuaaagugaucgaaaagaaguauuacacuauuuugcucccccagugcucaaaaggguucaaggaccaaugaguacccacucaccucuacucuugucuggcccagaacauccccuggcuacaaguccccugacuccaaguccccuggccacaggguucccaccaagggacacaauggaccuggggcaggcagcauacuaccucagcauuggcacaggagaaaauaaaaucuuugccauuaacauugcauccagcaccuucugacaacaaggaggaauacaaaacaaaaaucaaaaucuguagccccccaacagacugaacagaugcucccuuccuggccaaagggaauggauuugggcaggcaccuaccagccccccaaacacuucuaagcaauaucagagucaaaaccaaaagccaaaauaaguuacacaucaauaaaaaaacaacagcauagaauuaagcuauacuggaggaaaacacugcucccacagaccucucucuaagacuaaacauuuuagccucaggucacaacagcaguuguagcuggaggagaaaaacucacaggagcucacaaaaaaagcuaaaagaguuaaaugaaucugagaagcuuucaaaagaauagauuacaagauugaaaagcaaaauuucugguaauuuagcaaauuaacauuuuaagaaaauuggguuuuaacauuuuuuuuuuuuuuuuuuuuauuuugagauggagucuugcucuguugccaaucuggagugcaguggugcgaucucugcucacugcaaccuccgccucccggguucaagugauucucuugccucagccucccauagcugggacuacaggcgugcaccaccaugcccaucuaauuuuuguauuuuuaguagagaugggguuucaccauguuggccauggccaggauggucuugaucucuugaccucgugaucacccgccuuggccuuccaaagugcugggauuaacaggugugagccagugcacccaguuagaccauucuuuagaaaguguauuguaaacaauuuccuuuuaauuauaccaaguuuaaucauacacaaaauuucuuuuuauaaaagucuccuuuaugaaccuugucacgacauaacacagacccuccacaacaugcuugaauuuucuuacuugucugauaugguuuagcucugugucgccacccaaaccucauguugaguuguaauccccacguuagaggagcggccagaugggaggugauugaauuguggggguggaauuuccccuugcuguucuugugauagugacuucucacaagaucuaguuuaaaaguguguagugcuuaccccuucacucucuuccuccugcacugccauguaaagaagguacuugcuuccccuuugcccuucugcugugauuguaaguuuccugaggccucccuaaccaugcuuccuguacaaccuaagaaacugugagucaauuaaaaauuaaaccucuuuucuucguaaaacaccuagucucaaauaguucuuuauagcaguguaagaacagacuaauauagaaaauugguaccagagaaguggggcauuguuaaaaagguacuugaaaauauggaagugacuuuggaacugggaaaugggcagagguuggacaguuuggagggcucagaagacaggaagguaacagaaaguuuggaacuuccuagagacuuguugaaugguuuugaccagaauacugauaguaauauggacagugaaauucaggcugaggugguuucagauggagaugaggaacucauugggaauuugagcagaggugacucuugcugugauuuagcaaagagccugguggcauugugccucugcuuuaaggaucugugggacuuugaacuugagagagaugauuuaggguaucuggcagaagaaauuucuaggcaguaaaguauucaagauguggccuggcuacuucuaaaagccugugcucauuugcauaaacaaagaaauggccuaaaacuggaacuuauauuuaaaacggaagcagaguauaaaaguuuggaaaauuugcagccugacuugugguagaaaagaaaaacccauucacuggggagggauucaagccugcagaaauuugcauaaguagagaggagccaaauguuaauagccaagaaagugggggaaaugcuuuuagggcauuucaggcaccuucauggcagccccucccaucgcaggccaggagaccuaagagggaaaaaugguugcgugggccaguccccggguccugcugcucugugcagccuccggacauggcacccugcaucccagcugcuccaacuucagcugugguugaaaggggcaaagguacagaucaggccauugcuucaaagggugcaagccccgagccuuugcagcuuccgugugauauugggccuaugagugcaaaaagggcaggaguugagguuugggaacuucugccuagauuucagaggauguaugcaaaugucuggauguccaggcagaagucugcugcagggacagagccgucauggagaaccucuacaagagcagugcagaggggaaauauggggugggaacccccaauccccagcauccccacuggagcacugccuaauggagcugugagaagagggccaccauccuccagaccccagaauguuagauccaccaacagcuugcaccgugcaccuggaaaaguagcaggcacucaacaccagcuccugaaagcaguuaugggggcucuacccugcagaaccacagggguggagcugcccagggccuuggugaugaaugaguucuugcgugaucugguuguuuaaaaguguguugcacuucccccuucacucucuuucuccugcgccaccauguguaaaaggugcuugcuuccccuucagucuuccaccaugauuguaaguuuccugaggccuucucaacuguguuuccuguacagccugcagaacugugauucaguuaaacuuuuuuuuuuuuuucauaaauuacccaaucucagguuguucuuuacagcaaugugagaauggacuaauacguuguccuauacuaccucuuucuugaauaacuggacauuuuacuuuaggacaaggauuuacuaugcaagauuucucccucauauaaaauuacucuuuuuuuauauccuuugcaaaacaaagagaaaacauuuucuauccauaacauucuuuaugucucucuuuucuaccuaaugguuuccuuauauuuugaacuucccuuuuaguaacuuccaaauuaaacaaaacauuuuuucccaauaaaaaauacauuucuuuagcacauuuuauguaaaccuagcaagaaauccugaacugccuaccagacauuagaauuuuauagaugagaaucauuuuaccauuuuuagauuuuauaccauacaauaagcucagucuauucuauucuguucugaucuguucuguucuguucuguucuguucuauucuauucucaugccauuuuaaucauuuuaaagccuaugcacauaaguaauuuaccuaggaaaggguugccaaaguggagacuucagaggcccugacuugcuggagaaccuaccugguaguggagacacugagaaaauagguagccacuuguugacugcuguagguggcuguccauuugaggucaggagccugugaacucccaauuccuuugaccaagaggggcaguuacaagcaaagcaguuauaagacagcucccaagaaggaguugcaacucgcuguuaggaaaauaauacuucuaacuuuaggacagaaaagggcaagacuaauacuucccuagggagaggggcuauaacccacaguccuaaaggaaugucaaugccaaaaaccccagcgcaucuugggugcagucuauaauaccaaugcuguaaacccagagugccugcauuucagccaacgagggucccuucaccaaugccaaaaacccuagugcaccccgggugcagccaacagugucccaugacugaguugaggucacagaaugugacuguggugucccagagucaacacacuggggggaccucucacaacuaagugucccaccuuaaauaauugccacacacaguugacagaaaguuaaaagcaaacaauaagacugcacacauuuuaggauugaaaaugaaaugacugguggaauaaugaacuagaagggcaaggaccaguggaagaggugcucaggauguguuucagggcacacuaacgaugggggcuuuuaacugaccacuuagccaaaggcuuuuguucccuagcuuaccugauaauuauggggggugguagaggggacacacccauccacagaagccaaaaugugacuggucuuccacaugggauuugggucuucauccagguucccucaucuagagugggcucagcugcugcagugggaggggcuugcacaggggcugguaaccuacuggucugccugucagagcagugggucccauaugaggcaguggcauuauggccacuugcucgucugcucagcugugcugucugccagggaaaaugaugacucucaaaagagcuuuugauuaguguuagagcucagguuuuacagcucugcuuaguuaccucucuggucaucucaccugcugccaugucuugcugucuuguuuuguuaacugcugucucucauugucccuugcuguuuucuugcuguuucucugacugccaucucucauuggcucuugccaaucaccuucucuccaucucugcuguugcaucaucuugccucuccuccagucacugccaucucugcuuucuucaucccuucguggucaccagaugauucaggacagggaagcccccaaauuggggauuagcccaggaagguucuuggcuucaccuaggaaagaauucaagggcaagcuggugguguuaaacagcaacuuuuauugaauugacuguauacagcagcagcagaaguacugcucuuugaggaacagggcuaccccacaggcagggugccuagagcagcagcucagaggcaguucugcagucauacccacuuuuaauuauaugcaaauuaaggggugguuuacgcagaaauuucuaggaaaauggugguaacuuccagguugcuggauccuugucauggaaaggggugguaacuuccagguguugccauggcagugcuaaacugacaaggcacgcuggugggcaugucuuacagaaacugcuccugaccuguuuuaugugggcaugcauaugguucggugucagagcccugccuccggaaucaauugaguccugucuccuuccuuauauucaaacuagauuuuuauuaucuaauugaaaaaauuaaauuagugguaauacuagcucuuuugucuuuuucugccauguauuguuuuaaguagccauacacuucauuuaguaaaucaacuuguucuguaaagcacucuaagguggaaguuggauggggaccaaauugcugucuuccuaaagggagguuuggaaauggcucuacuuccuuugaagaaaagaagaaauagucccagaaguuauggauauuucauguuagugcucaaaagcaugcucuuauguagcaaauauaaacuaaaugagacuuauauuguuuaccagaguuuccuaucuaauagauuuuguacacuucucaauauaguguuagugaacacaucaaaacuuuguuuuaggaauacagaaaugauucaauaauggaauaaaugucuguauucauuauucaguuuaagaggaaaaaaagucacaagauuggaugcccuuccucaguauuccuucucuugucuucagauauaaccacugucuugaauuuaguauuuuuuuuguuuaguuuuagagcuuuucaaauaaguauaaauaauauauauuauauggcauaguuuaauauaaaugacauucuuaaguaacauuuuauucaacauuguuuugagauuuguucauuguuuccacugcucuguuuauagugacuacugcaguucauccauuccucauuuaauggauauuuagguuauuauuuuugguauuaaaagcaaugcucuaaugaacauucuuaugcauaucuuuuggacacacaugaguguuuucacuuagauuuauacaugggguguauuuagggauuaugcacaucuuaauauuguuaaauuuuaaacuccuuuuagcauagauuucucuuggcucaacagauauuucacacuuggccacagacuaucacacuuuaaacuccauuagauuuguauaauuuaugucagcaugccccaacccccaggccacagaccagcaccaguccauggccuguuaggaaccaggcgcacgacagguggugagcagcagguaagcaagcauuaucgccugaauucugccuccugucauaucagugguggcauuagaaucuuauaugagugugaacccuauugugaacugcacaugugagggaucuagguugugcacuccuuaugagaaucuaaugccuuaugaucuaagguggaacaguucaucccaaaaccaucucccugccccauccaugggaaaacuguuuuccaugaaacuggucccugguuucagaaaaguuguggaccacugauuuauaugauaucucaggcuuucauuuggauuccaugauuauuacugaaauuguauuucuuuuuacaaauuuauugauuuuauucuuugcuucccacccaccccauccccuuauuugauuugcugauacucuuuauacuuaauaauaauucuuuguugacugaauguauugcagauacuucucucagugugugacuuauucguccaugucauuuaugguuaaccuaaccaaauguaucagcuuuuaaaaaugauuuaugcauucugcaucuuauuaacaugauuuauaaagauuuuuaaauuuucuucuaaaauguaaaguuuuguuuuuucacauuuagaauuuuuaauuugccuuaaaauuuuuguguacacaguguuucuuuuuaaggauauuguggaaauaauauuaaaacaucuaaaauuaucuagcuuccuuuaauggauguauuaacuuauauuuuaagguggaugcauggcaaguauacaauuuauucauuuguacaggcuauauaugaguaauuguuugcuuuagaguuuuauaaauuauuuuuuucaacgaccuaugcuuauaucacuuaacaagugaaggaacacauccuaaaaagaauguuuaaauuaucucaagagaaauucaacuuuuaaguaaaccaaaaccuuucuuuuuacguuuuuuauuuuuucaaaauauaaucauucauuauaaauuggaacuuuaauuugacagaaacauuuguauuuauuucuaaaauuuauuuguauuauuugaaaguugaagucuucuuacuuuuugguguuucuuucagagcucugauuauacaaaaccaggagacauugacccuacaucaguagcaagucccaaagauccagaagauauaccaacauuugaugaauggaagaagaaaguuauggaaguagaaaaagaaaaaaguaaggaaguauuugaguucuuuaaauuuuuuuuuuaaguauaugguguaguuuaauaugcuuucuuuuuuugauugguaaaacaaaauaaaauuuacuuuugaaaacuuuuuaaaggugaaacuuaaccaaguugcuguugauccauccauccaucauguaccuguauauaauuacauacaguuuuaguuuuaauuaaaauccauucuuguaaauuauuaagugagcauaaaauaaggcauagcagugauuuucaucacaauacgaggaaaauugaggcauggaaacuauuuuaaaauucauauggaacucaaaaagaacuugcauaaaauccuuggguuuaaaauauucuuuaacuuaccaaaagguguuuuacauaugauguuucaagaacauaccuaaagaaaagcuugcuuauguuaugaggcagaggagggugacuaaaauuauaauuuauucccugugugauggguuauuaggugcagcacaccaccauggcacauguuuaccuauguaacaaaccugcacaucuugcguguguaccccagagcuuaaaaaaaaaacaauaaaauaauguaagaaauacauccuuaauagauguuuauaauagauauaaauacagaaagcuuugauucucauggacaagcuucauuuugugaguuauguuacuuagacauaaguaauguagaauuuuguaguuaauuuguuuuggggggauauuuuaagcuauugagguggagcacuuugauuuuuuuaugaauuuuuaaaauauucucucaaguguuaaaaccuauucuuuucuagaagacagcuuauugcuuuggagaucaguguugcuagagguauuuucagucauaaucaucaaauauauauauaaauauuuauaauaacgguuugucugcaggucagucgaugcaugcaucuucuaauggagguucacaugccaccaaaaagguccagaaaaaucgaaauaauuaugccucaguagaauguggugccaaaauucuagcagcuaauccagaagccaagguagguguuuaaauauaaaauuuuguauauauaggaaauuaacgacuuuuuaaaauacagguuauuuguuuacugggaacuauauuuuaaugugagauauuuuccuuauucacuaauaaaagcagaauauacuuuucaaaacauuaucuuguaugaauucuuacuuauauuggcugauguauuuugcccugcauuuuuuaacuuuuaaaacccguaugaaauuuuaaaaaggaaauaacuaaaauauuauuuuuuucuuuaaaguaacaggcauugaauuuuaaauguaucauuguaacacuaauuuaaugcuguugccgugaauggugaaucuuagccacuuuuaugcuuuuuucccaagugaguguuuuaaagucuuagguguacuuaagaucuaaaaauacagaagucccagaaaacuuuaaaguuaaaauaaauacuuucuucauuauuccuuaaguaauuuguuuccuuuccucuuuuuaaaauagagcacaucugcuauucuuauagaaaauauggaucuuuacauguugaauccuugcagcacuaaaauuuggugaguuauacacaauuuuaaaaaguacauucuacauauauaugcauauuauguuaagcuuuuacauuaggguuacauugacauauaauaauuuaauaagcuuuuaugauugauuagugcugauacuaugcaaaacugaggacaaaaugccuuccuuuccuuuugaggaggucacaaaaagcaaaaaauggcagaucugguuaaacaauuaugaaaugguauaaaaaguacuguugaaaggguguuauugaaagagugaugaugcguaacugcaagaggagaugagagaaggcuuccuggaagagguaauuccugagcugaaucuugaaggauuaauaggaaguggcagaugaaugaggcagagguauucaggaacuguaagaauaagggggguacugcugccaucucggcacacugcagccucccugccugauucuccugccucagccugcggagugccugcgauugcaggcgcgcgccaccacgccugacugguuuucguauuuuuuugguggagacgggguuucgcuguguuggccgggcuggucuccagcuccuaacugcgagugauccgccagccucggccucccgaggugccgggauugcagacggagucugguucacucagugcucaauggugcccaggcuggagugcaguggccugaucucggcucgcuacaaccuccaccucccagccgccugccuuggccucccaaagugccaagauugcagccugugcccggccgccaccccgucugggaagugaggagagucucugccuggccgcccaucgucugggacgugaggagccccucugccuggcugcccagucuggaaagugaggagcgucucugcccggccgccaucccaucuaggaagugaggagcgccucuucccugccgccaucccaucuaugaagugaggagcuucucugcccggccgcccaucgucugagauguggggagcgccucugccccgccgccccgucugggaugugaggagcgccucuacccgggcgcgaccccgucugggaguugaggaacgucucugcccagccgcccuguucgagaagugaggagaacccccgcccgggcaccgccccggccgaaaaauuaggagcccguccggcccgcagcccccccguuuggggaaguuaggagcgucucugcccgggagccaccccaauccuggaaggaaggugggggggugagccccaugcccggccagccgcccguaaugggagggaggugggggggucagccccccgcccggccagccgccccguccgggagggaggugggggggucagccccccgcccggccagccgccccguccgggagggagguggggggucagcccccgccuggcaagccacccgguccgggaggugaggggcgccucugcccggccgccccuacugggaagugaggagccccucuacccagccaccaccccguuugggagguguacccaacagcucauugagaacggaccaugaugacaauggugguuuuguggaauagaaaggggggaagggcggggaaaggauugagaaaucggaugguugccaugucuguguggaaagagguagacacgggagacuuuucauuuuguucuguacuaagaaaaauucuucugccuugugauccuguugaucggugacccuacccccaacccugugcucccugaaacaugugcuguguccacucaggguuaaauggauuaaggguggugcaagaugugcuuuguuaaacagaugcuugaaggcagcaugcucauuaagagucaucaccacucccuaaucucaaguacccagggacacaaacacugcggaaggccgcaggguccucugcauaggaaaaccagagaccuuuguucauuuguuuaucugcugacccucccuccacuauuguccuaugacccugccaaaucccccucugugagaaacacccaagaaugaucaauaaaaaaaaaaaaaaaaaaaaaaaaaaaaaagaauaagggggcagugcuaaaaaggaguauguuucuucugggugacuguuagauauuacaagaagaaagauacaaugagaguagggguggaacauaagccuggagcauucguuuaucuauaaguaggccauccagugcuguguauacccagaguguuacaugucauggguauuuauuuuccgccaaugccaugcuauaugcaguuuuauauuaugcacauggaaccaugcuuuuaauuuuuuccuaagcagcaauauuuuuggcaucuuuccauguuaauaaauguaaaucuuagcaucauuuuaaaaaaaaacagcuuuauugggguauaguugacauacaauaaauugcauguauaauaaacuacaugucaaaguguauaauuugguaaguuuugacauuuauguaucugaagccaucaccacaauaaagauaacaaacauauccaucauucccaaaaguuucaucauaccucuuuguaauuucucucaaacucucuucccccacagcaauuacagaucugcuuucuguuacuauaaauuaguuuacagucucuagauuuuuuauguaaaugaaaugauaguuucugguaccaguuuuaauggcugcuuaguauuucauugucuggaugaaccauaauuuguuaauucucuuugcuaaauauuuaacuugauuucccccccugcccuuauagacuguguguacuucgauauagcaaaauauauauacaaagguggacaucugaagccuugaauccuuaagauaaauuucuaagaacuaaaucgaagacuaugauaacuuuuuaagacaauguauaugccaaacuauccucuagacuagucauuuuacacuaucacugucuguucuuaagaaagucaucccuucuccaagaaugaguguuaucuaaaaaaggaauuuuuaaaaaaaaaugauggagcaaaaucaauauuguuuuauuuacaggucuuuuccccccacuaaugguauccuuugggaaguauuuaaagaugcuucuuauagacaacuaaggcuacauacccuccucuuaacauuuuaaugaguaacucuuaaugguagucuaauuuauggaaacuguuaaugucauauuuaauaugaacuguuauuuugauugguuuaaguaauugucuuuuguucuuuuugaagguuuguuauugaacuuugugaaccaauucaaguaaaacagcuugauauugcaaauuaugaauuauuuucuucuacuccuaaagauuuucugguuucuaucagugacagguaaauucuaaagcuguuucuauagggucuauguuggaucucugaaaaaaagaaaaacaaaaaaacaaaaaagugggucacauuuugacuucaguccauuuauuuuuuaaaggucaguuuguaauaacaacgauaauacgacuguauuguaggcucuuguuaaucacuuaccuuuuaccuucauuagcucauaugcuuuaaacauaaccauaugauauuauucucuuauaauguggggaaacagaaaaggggagauuaagugccuugcccaggucacaugacuugugaguuuuagaaccaagauucagaacuacaacucugacuucaaaguccucacuugcagucauuaugcugucuuguuucuaaacauuucuuuuaaaaguuguuaaaaacauacauguguaggugcuuuaugagguauauuuuuauuaaaauauauucuaaaacuuuuuuuguacaugugugauuauaaaagaaauaaauauauguugugaggaauuuggaauagaacugcauuuugucaaccagagauagcccuuauuagcauuuuaauauauuucuuccagucuuuacuaugcacuuauuuauuaauucuauaaaaauauguacuuuuacauccuggaaauacucuuuagucuuuuacacguaucauuuuuaauguguacacauuauuuuuuguucaacagagaugugaaaucauuucauaaauacuuuuugaguguccacgauaugccauguaggaugcuguuucuuuauggaacuguuauuuugucauuuaaucauuaaggguuuuccuugguguuucuuccuccaccucacacucagcacugcauauauacaguuuuugaaaucgguucucaagaccucuugagaauucuguuauucugccgcuacccuugcucaguucacuucuuuuucucucagcugcaauuuucuuauaugucaaaugaacauacacagcucugauaaguaaaguguauuuuuuuaacguggugagagggcucauuauuuugaggaguucuuauaauguuucaguaaacagauauaauaguuuuagacuuuuauauuaaauaccaaagucuccuuuaaaggggaauagauaugucaaacucagaugugguuuuaaaaguuuuuucuucccauucucuuuccaccaguacuuguauuuauacuuuacauuauuacacacaugucaguaugugaagagcugugccaccuucuuccaagacagucucuuggugacuuucuguuauaaaaccuccucccaaaccccaagaagugguacugguccuacuuuuuguuaauggugugauuuuucaaggcauucuuuccugguaaagagaaacccgucaguucaguuggaaaagaaaauguauuaaauguauguauuuauguauuaaacuguuaagucagcguguucaccuggaaaggaaaaaaauuauauuuugaaaauaugauagaaccuuucaauaugugguuuauaauuuuuaaaaaagaacauauugcuuauauuuuuuagauauccaacaaauaaguggauuaagcuggguacuuuucaugguagagaugagcggaauguacagaguuucccuuuagaugaacagauguaugcaaaauaugucaagguaauguuuacacauacaggacuauguucuauaaugaaaauauacguguuauucacacuuuauacaccucaucuuuuuagaaaucagaaaaguuaagaaauagacuacacuauaccacuuaauagauaauucuuacuuggguauauuauuucaugaaucaaauauugcuacauucccuuuugcauugcuggaagccuaggccaguuuuuuuguuauuuauggcccugauaaaauuccaaauuauaacuauuuaaguuuuuugagucuuuaugcaaaaugucaucuucauaguauauuucuuucuauuuugaaacugaaaucauugcuggucacugaagucuuuaaagcagauguaauuucuuguuagacucugauucuuagaccauuucaucuuuaacguccacuuauuuggcauuguuacagcuuuugucuuuuucuuuguauagccaaaugaaauauucuguguccaaguaccaauugcaaauaaaauagaguuuuaaacacugguguuuuauauuuccacugcugcuucuaccaacuaauuaaguaaaauuaucacuuuugaauuggguuagacaaaauagggaaaauucuuacuccuuccuuuccucuuuuuuuucuuuaaaauuauagccauaccuuaaaguacuauugaauuaauauuaugacauuuuuggaauggcagcaguucuaauuucuauccuuucuucuuuaaaugugagaacuuauagcuaccuaauuuugucuucugugauuuuaccaucucuuuuuaaagcauguuuuaaauugacuucuauaaauagguaaacuuguaguauucuuaaucucaguauaaaaaugcuaaauucuauuuuuaaaauaaaguugauauucucaguuaauucaaaauuauuaguucaaaaaaauuaaggaauguuuucaauuccuucuaaaaugaguacugaaacaauuacuuaauuuuuuauacaguacacuuucuucacucugaagaggcaaaaacguuaaaaaucauuugcuaggugauaaaaucguauuuaauuuuggaaggauauuuuauuggaaacauaaagaaugccuuauaaaacuuuccaccuuguuccuuuuauggugggagauuauacagcauuuuaaauauuaguuuuauaaaaaaccuucuuugguagaauugagucuaaaggcaagaaacauuuacuuacagcucaugaaaagcagagaaaaauuacuuucugauuuucauuuuaugguaauaauguuauguaaguuuuuuaccuggauguuccuuaucuuaaaauaacuacacccaaaucuacuacuuuuuaauagcauacauucgaaaggccaauugguauauaucuuccacuucuguaaguuguacuugaaauaacauagcauaccaaaaauucauacuuuccccgaaauaaguuguauauaauauacaaguauaaauaucauuccauaauggacuguuaccaauauguauauguguagaauauauauguauaugugcauauauaucaauauauaaauucauauauggauauauacuugauacaugucuguaauacuuaaaguaaaagauuguuucuagauacuguuuauuaauugcuuuuagaaugcuuucuaucuaacagcuauauaaaauaacagcaauggcuuguagauuaguuaacuuauaaccuuaaaguuaauuuauuucauugcaaucauuuagauuauacucucagguagugauggcaaaaauuuaaaucauugcuuuuauuucugcaaggaauuaagaauacuacaguguuauccaucacaugacauuacucucuauacuuuauacaacauaauuuacaaauauuuaaagaugcuuauugcaugaugucuagacuuuggaacugauuucuuuuucuuuuccuuucucuugcuucagauguucaucaaguacauaaagguuagcaaccuucucuuuugcacuauuaaauaacagggcauggcguauuaaugcauuacaaaaacuuuacaaguauugauuuuggggaaaauaaggacuuuauagaaauguuuagaaauguuauaaugaaaaaacugaguauauuguuagauaaucuuacaugcucucugcuggcuucccauuuuaugugcuuuuauucuuuagguugaguugcuaucacauuuuggaucagagcacuuuuguccauuaagccuuauaagguaaugcagaacaaaauacauuuauugaguuuuuaaaaaaauugauauacaaaauuuucgauauauuuaaagugaagaaauaauuuucucuuacgugaguuaauaccauagaaauaaaaacugugaaaccuuucuuuugaaugcauuuuggaaaaaugucaaaauauccucuuuuaaaaaaaaaaccucauuuuguauauuuguuuuaacuugcuugcuauuuugcuaugaugauaauacacagaaacguuuuagacugauaugaaaacucauccauuuaaaugccuuaaauagauuaguuuuacauuuuaauugaaacaguagaugacuuaaauguaaggagcagccauuauuuuugaguccaaaagccaguggcccucaaaauaugaccaaaguugauguuugucauuuauugugaagagauuagucuuaacgaguguuuuguuuuggaagucuuuaaugaaauuguuguugauaggguauuuggcacuagcaugguggaagaauaugaagaaauugcugauucccaguaucacucagaacgccaggaacuauuugaugaggacuaugguaagugacaucaaacagaugacuguuagguauauuuuuuuuacuuuuuaaaaaucgaauaguaaugggggaguauagcuuacuuaaaucaauaugacuguugucuucaggcuuuuguuuuguuguuuuuaacucuaaucaacuuuuacuuaaaucuguuuucuaauaugauugcuuuguauucguauugcuuuccaagcuuaucuaucacuuauuuguaacugaaacucccuucuauaacauuaaugguauaaauuaugauuauaucccuaugccagggccaaaaaucuguuaaacucacaagauacugaaauaguagaaaugagcuuuaaugccugugauuucccaugagccuaagagcaagcacauuuuggcuuccugugagccauugagaaauccugugacucuaaagaguuagaggaaaguuuuaugacacucuccauuuccucuuuaaguccuuauuuuaagauguguuaaacuauuguuugaacaaucuaaauuuucucaagagugaaaugaagacauugacuaagaguugguaaaguauauugaaagcuugaauaaaaacgucuuauaaaugugguuaaaauuuugguaagcauuacaguuauuuuccuugguuuauauuuguuuguuaaaugguuucuuaaucuuacaugcuuuuugugaacauguuuuagauauaugauucauauuuaucauaaaauguuuuaaaugucagcugacuuugacaggacauaauuugagcuuuuaaauauguuaccauuggagcuagaucucagcauaauuacuuuuauuuucguuuuuaacagauuauccacuggauuauaauacuggagaggauaaauccucaaaaaaucuucuugguucugcuacaagugaguauuuugaggauuuucuauucauucuacuacuuuuucauucugacacacacagacauuuugucaugguaugguugaggagaauucucccaguguugaacuuugaguugaaauaaaagauacugucuuuugaaaaguauuuuuauagaaaugcgauaagaauauaugaaaagaaagaggagagagacaaaugcaaucguaauaaagguguuucuucuacucuaauuaggcgcugacauuuugggacagauuccuuauagugaagaaagggcuauggauuuucuuggggaaagaauuauuaaaacagucauaccacaguuaaucuauggguaugguuaguuugccauuuaguuacaaaauauaaagggugcuccuaccaucaugauaaugaauaccaauaagaauacuaguaauaauauacuccuuguaaacuaagaaacaaugaauaagauauacuggugcuuuaguuuguuguuauuccaaagucgaaucccaaccuagugguaggcucacuaaggagacuacuagaaagaccauuaccugacugacacuuuauuuuucaugguuagauucuguguagguauauuucaaugauguuuuugauuauuucugaaaaauguaaaauuaacuacaaguaguuuucuuuuuauuugaaaauuauuaaucaaauuuaauaaaaacaaaucuuaguaaaaucgaagacuaguugcgugugcuugucacuuuuugcucuuagugaauugaauuguugaauaccgaugucugugaacauugacuuuguaaguuuuuuagcuauucaaccaguagucuaaauacuuagguugauauuuuguguagccacaguauauagaguuaaaauuaccucuuucaucucuccuucuagccuuuucuuucuuucuuuccuuucuuuucuuucucuuccugccuuccuugccuuccuugccuucuucccccuccauagaagaguauagaccucaguggacuuuuuaggggaugggaaaaagaguguuaaaaauaccuguagaaggaaaaucuuuugugauuacaaaguaauauucaacuuuauuacauaucaguucaguauauuuuguuuuacuuuauugcuaggcuucugacuuucuagauauuagugauuacuuuuaaauaggauuccuagcuaucuaguuauugauauaaaaauaagucuuauucacugcuaugugauguauuuuuuaggagugaaagaaaugucuuaucugucuggauauuaauguuuuuguuucccuuaauuugcauuuuauauguuacauaguagucauuauucugccauuuauguagcucaguaauguugaauuagcucugaggaagcauuauuauuuuauggggucagaaaauagccccagacuaaaagaucucuagcuucugguagguacuggaaaaaagaggacaccuuaaggaaauaaugucuuauuguaguuucagauaaaggaaaaguguguugauauucuggauuuucuugcuauaucuuccuaugugguuaacuucuagaugccauuaaaaccuaaccauaggccaggcacagcggcucaugcuuguaaucccaguacuuugggaggccuagauaggcggaugaccugaggucaggaguuugagaccagccuggccaacauggugaaaccccaucucuacuaaaaauacaaaaauuagccaagcauggugcgugcgccuauaaucccagcuacuccagagcugacgcaggagaaucgcuugaacccaggaggcggagguugcugugaguugagaucgcaccacugcacuccagccugggggacagagugagacucugucucaaaaacaaaacaaaacaaaacaaaacaaaaaccuaaucauauaucaggggaagacauuucccuguuuguauucaugucucugaucaguauaucaauuaauuagacauagaaucuuguuuagauacuucuguuuggaucuuucuccuugaagguauaucacuuaauuuuccuuuuacagaucucugggagggcaagguuaucuuccaguguucuagguauugaaagaauuuauacagugagauaagaugggugggaggaugucagcugagucucuaaaaugagauuuaaaaugaucuccaccuccugaaguuuuagaacaagagaggcaguaagagcugagugauaagacuuuauugucauaaaacuuuauagacuuggccuaacacugcugccuucuguaucuguguccuucuacucuucucugaaguuugggacugaauuagcuauagccuccaaggugguauaacuugaagaaguaaauaauaaaguggaaucagaacuucaguaguucugauucaaagaacuggucuuuggcacaagaaugucuugaguuugacuauaaucaucacugcuuucuaaauuagcuugaaauuggcccauuuugaaacuaguuuuuuuucuuguuuuuaauguguacauaguauccacaagcuagaauugucuuuaaucuuaauagaaacuccuuuucuuuuugcucucaaguaguuacuaguuauaggaaauaugucaccagaauacuuugccugugcugagaguuggaugucaaagagcauccacacugcauaaacauucuugauauuauauaauuuacuuaacuacuaaaaagggagaagcuguuaucuuagagcagcauucuuggcuuuguguguauggcuuccugauucuuuuguuuacauucuugaacuaaaacauuuaaaucuuuuacaucagcaagauuucuccauaucacucugauuuucuuguucuuugucaugugaauuugccagaccucugccuacuuugauauuggcgcaggucugccuuugcucuuaaauaugugguuuugguuuuuguuaaaaucacccuaucugcuaaagggagauaggugcaugugcauguugaagagaaaauguaguuuuuacuucucaaguauuuuuuguggaaaaaaaguagauccuagaaggaccauuuuccuagaaaaugugggcaugcuucagagauaguacacauaggaggaagucuuuuuuuguugguuuaucuucuguuguauuauauaaacucuucaacuucagcagccuggaaaaauguuuguuuucuuuaucaaaaagagacauuggagcacugaagacugaguaaauaauauggagauauuuggucuuuaggaccaaauauuaggagcauuuuauuccuaaaggaaugaggcgggaugaauaaguugcccaauucaaaaauuuaaaaguugacuaauccaggagaaauuagggauauuuaucucuaguuuggcaauuauauucaaagaugucauuuuagucuauucugaaaguuuuuuaauggccagauaaucaugguguauacaaacuaucauguguuuagauacaaauugaaaauagaauagaauauucacaauucugcuuucucucaaaagacaaaaaagauacauuaggcaguguucuguaaacaugggaaaauuauuuuagguuaaaugggcugagaagaaauuugcuaaauuuugcuuuuguuaccacguuuccugaaaugaugauaauaaauaauauuuuaaaagggugaauagaaggaucuuuauuguagguacugguguuaaaauuuagguucagaaauaauacuguaaagcuacuuucuuuacacagauuaacacauuuaucuucuugaauuauuuaauaaugaaugucaaaaaauucgaaaucucauauaagaucucacuuugaaacaaaguauauaaacuguugauugcacaauuuggguuuugugaagcagucaguuuugacuauagguggcaguguagguggggcaucauaaauaauauugcaguauugguuggcauuauaaaggguguaugaggaaauaacaguuuccauuccagacuucaucuugguuuaugagggaauacggaguuuccauuuuuguuaucucauaccgcagcaucucuuuagcuuaaguaagaauuaaggccacuucuguuuaucaguuugccaggucaaagggcaauauuaaaaauguuauuuaaacauuuuaaaauggcaaauauugagccuuuguguguuacaguaaugauuagaaacaaaguaccacugcuuuguugacuuucagcguauacacucauaauuucgugaagaucaacauuauggcugauuccuagcuaucacuuuaaagcaguuugaaaucugcuacuauuucucccauccugaagcauauauuuacaggaugagcuccaggcagcacucuuugguuuacuugcaaccuuccugauguaguagauuuuucucucuuagauccuuuucuacuuuucacaucucugguuuucauugaaaauaugaugaauacucuguggaucgcuuuaggaagggagauuaagacagaaauaauguaugaugauuaauauguagccccugccagaucuuaguauuuuaauaguaggaguaucugauaccaaagaauuaacuucuaguggaauuucaaagguuagacugggaaugaaaguuaauuucacuugaaauuacaucacauuacuggaaggaaggucuucuauucccaguaccauuuuuuauggaguucugauauuuuguuaugcucauguauaaauauaucuauguagauauugagguuuguaccacuuuuuucauguaaauauccuccuucaaaagagaaguaggguuagcagguaugcaaauugcuuuuuacaacacuuuguuuuaugaccuugacuuuucauuaaucugccccauaccuguccccagccaauuaacuaaagaauuuguaugcuuuaugauuuaaaaagauugcuguuuuggucaaugaguuuuuuaaaagucaucaaagagauuugauucuaugcaauaucaauuuagaauuuaaccauauuaccauagauaugauaggcuaaucauugaaaauguuuucugcuuuuuuuuggauaaucucuguuuuguuuuuaccugugauaaucacauaauguaggaaaagcauuugcuuuuuuacacuuuuuuaaaauuuuaaacuguagagaauuuuuaaagaaaaauagguuuuucuguaaaauaagaauuuuggucaucacauuuuuuucccugucccaguacagacuguauguugaguuauacuugaguuuauaguaugcugaagacaguguuuugguaaagugucuagggaaguuuuacaagaaaaguauauuuaaggccaggcgcgguggcuaacagcuguaauccuagcacuuugagaggcugaggugggcagauuuccucagcucaggaguuugagagcagccugggcaacacagugaaacccugucucuacuaaaauacaaaaaauuagcuggacgugguggcaugugccuguagucccagcuacucgggaggcugaggcaggggaauugcuugaaccugggaggcagagguuguugcagugagccgagauugcaccacugcacuccagccugggcaacagagcaagacuccgucuccaaaacgaaaaguauauuuaaauauaaaauuccuuuugaacauaaaaauuuagauacacacuuuacacuuuuggcuaaaauuuauuuguguccuauauuggacuuuaguugugaggugaauacaaaaguaaccagucaaaaaaugcaaaagaucauucuaaaugauuuuuugacuaucugauauuaauuuauauuagaauauuuagguauuugguacuuuuucugauugaauuuuguuuuagaugccauucuaaauauggugaauauugcugcuaauauucugggagcaaaaacugaagaccugacagaagguaccuaaucauuuuaugggucuuuuaaauagcugguacuccagggauccuuauauuuaggaaaaucaaguaaugaguuaagaaaauuugauuguuuacauuuagaaauauagaaauaauucagaggaacuuaccaaucuuuauuauucauuguuuauuugaauuucacaaguucuguuuuauaaaagaauacugucuauauaaaacuuaugaauuugccuuuugacuucuccuagcucuaauauuaauagcaaugauuuuauuccuuaucucuuuaccgagauuuugauguccuaaugguacuucaaguauguuauucuuuuauguguuaaauagcuacuugauuuagaaagccaucuuuuccuuagagaaugacagaugauaauauuuuuggcaagaagaaacagucuugccuuuuuguuuuuuuaaaaaaugcuuagauccaagugaacacuuaaaaugacucauuuauuuccucucauuuaacaacucuuucaguaucuagaaggcauauuaaucacguaagguuacacaacauucauagucaccugacuugauuuaauuaucugagaaauugagaaacgauauauauuacuugugaucuuauaugaucauuucuuccuaaaagaacuuugauuuuuuaagaaaaagucugcaguagcaaaccuauuuggcuuuuuucuucucuuccaagaaauuuguuuuaguaaaauauuuucaugguacagcuuuuaaaauugaacucaacauugggcaucuuucuuaaaauaggaaauaaaaguauaucugagaaugccacugccacagcugcaccuaaaaugccugaaucaacuccuguuucaacuccuguuccaucuccugaguaaguuauaaugugauauuaaauagaauuuuguuacaauggagagauaaguauauuaguauaaaaaaaggaauuugugauuugugugugaaaugauuaccuguagagagcucugaaucauaggauagacauucuguggccacuuagaaaaucugaguugcuucuucccauuaguguauaugcauacugggaauauaauucagaucaaacuuuuuuugggggggguauuauauauuacuuucauuauucacaacagugacucuuuuccauacuggaaauaauugaccuuacucugcagguauaggcuugaggacaaauuuuaaaggcccccccuuuuuuuuauuaaguucaaguuuaaaagcauugaucugugguaucccuagaaagcuaccaaaauaccuagagcagugguucuugaauaauguauuugccacacagcaagcucuuaacuguuccauuucucugaaucauguaggccuuuccccagguugcaguggggacacuuugggcagggauguaucuaaauagguaauagauauaucuuuuaccuuuuuugucuuuucugccagaggugguuacuuuaguugguaccucuacuucuuaccuauaauaaauaauaagcuuauaaugauuuggauaaucagguaguuauuguagacuuaauuuauguauauuucauuagauacacucccuacaaaacuuugcaaguccuuuaucuuagaacaacucuacuuaaagaguauaagauauuugaaaugaaccacuuaguucaagauaguauguaaugagaccugcaguggguaugcuuugaacugcaauuccugagaacuauacuauuucaaaaaugauauuuugaugcuuugaaaggcauagugagaaaauuauauuauccuguguuaauccugaaaguuacuggagauauuuauuggguaauuagaaaauauagcguauguguuauugauucugaaaaggaccuaagaaaucuauuggggauagagacauucuugguguuucuaauuauguggagcugugauugcuguuccugauuuuguaacuagguuucuucaguuaacaacacgcuaugucguauuuuucaaaacuaaauaaaacugauuugguuuuuuauauauauauguacacacuuucauacacauaugugcacaaguaggaauauuuguugaaagcuguagucacaggcuaacguagcaguuuuuauuuuuccauauuaguuuuuuaauagauauuuuugcauaauuucuuauucaguauuucuucauguuugucuuaaauucuuuuuaaugcuuuugaaguaaucuuuugaagcaaauaugugaaaaugaaggaauccaugauaggaugucacuguuaaaguuacggaaagccaacuuauuuucuuuuccuagguuuuaguagguuuugccaugugaauuugagaaaaaacuuuuaaaguauauuucugauuacaguguguaugaugggauauaacaucuguauucaguauuuuuuaccaaauucaauauaauuuuucucucuccccuucuucagacauuacuuguuuuuacugucauaaauuauuugguagaaaagcaauauauuaccugaauauguaagaaauauuauuagagacuaaauauauauggcuauaaauaucuuuuuauuuaccgaaguguagucuaauuauguuuuaauuugguccauuuacuguuuuacuaccaaaaugaaagucuacaucauagauacuauuuuauuacuuucuucugucuuugcuauugugacauuagucuuuauuugaagacauuuccuggcaugcuuaguaauuuuucagaaugggaaaauguguguuugagcauaauuauuuuugguauugaaauuaccauauuuuuucauauuggacuuuuuauguauaaggcuacacccaguaauuaacuaucuuuaucuuggaaggaaucacaagcauuauaauuuauaacacuguccccauaagcuucauccccccacucuccuguaugccacauacauacuccacagccucaaaaugggauagaauauuaauaguggcacuaguaguuuaauagcagcacuguuagcauaucauaagccagaauuguuauuaaagugguuagguauuuggcuuagaagauuagccuagaugauagcaaaauuauuuuaggaagggagauauguuucuuguccuuaaaguagauaauccuauguguguaggugugugugugcguuguguguuuaaugcuguauuggaguuccucaaaucauucuuagaaaaauuauguuugagaccaaccuagcugccuuuugaaaauaggguauucaaguacaaagugcacucauaaauauuaagaauccuagauucuaguuuuagcucuggaccuuauuuaagcuaguuuauuaagcuagcucuuaguuggcuuaauuucugauguguaagggauagugaagcuuguaaagauucagugaauauuuaugagaggaaaggaacacuacauucagugaauggaaguauucacuuagaaacaauucuuaaacagauuaaaagaaagcaaguuugauaugguaaauauggugguuugagucaucuggcuagucacuugauaaauaguauuucucuuaucauuucugagcaguauuuguuuuuauaauaaaaguguuuuguaggugaaacauuuauccaaaaacaaauuucuucuauauuuccaaccuuuuaucuucuguauggauacauuuauuuuucuuuaacauauuucaacuuuagacuucuaaguaagugauuuauaauuaugauauauguauuucuagguauguaaccacugaaguacacacacaugacauggagccgucaacaccagauacuccaaaagagagucccauuguacaguuaguucaagaggaggaagaggaggcaaguccaucuacagugacccuucugggcagcggugaacaggaagaugaaucaucacccugguuugagucagagacacaaauauuuugcagugaacugaccacaauuuguuguauuucuaguuuuucagaauacauauauaaaugguguucaguuagaguugcucuuuaucggcagcgcagccgaacugcuuugaguaaaggaaaagauuaucuuguguuagcucaaccacccuuacuacuuccugcggaaucaguagauguuucaguauugcaaccucugaguggagaauuggaaaauacgaauauagaaagggaagcugaaacuguuguucugggugauuuaaguaguaguaugcaccaggaugacuuggugaaucacacuguagaugcaguugaacuugaaccaagccauucucaaacucuuucucagucucuucuuuuagauauuaccccagaaaucaaucccuugccuaaaauagaaguaucugagucuguugaauaugaggcaggacauauaccaucaccagugauuccccaagagaguucuguugagaucgauaaugaaacagaacaaaagucugagagcuuuaguucuauagagaaaccaucuauuaccuaugaaacaaauaaaguuaaugaguuaauggauaauauuauaaaagaagaugugaacuccaugcaaauuuucacaaagcugucugaaacaauagugccaccaauaaauacagccacuguacccgacaaugaagauggggaagccaaaaugaauauagcugacacagcaaagcaaacuuugauuucuguuguggauucuucuucauuaccugaaguaaaagaagaagaacagucuccagaagaugcccuuuugagaggguuacagaggacagcuacagauuuuuaugcugaauugcaaaauucuacagaucuaggauaugcuaauggaaaucuuguacauggaucaaaccaaaaggagucaguauuuaugagacuuaauaaucguauuaaagccuuagaaguuaacaugucucucaguggucgcuaucuggaggagcuuagccaaagguaagcuuuauuaugaauuagcacagucagcuucacacagugaguuaagcagcauagaguaugaccugugauuacaggagaggauuuaauuaucucaugauauaauagagguaagcgcaauuuuagcaagagagagaaagaaagcuacuugaaugcugaucagugccuuaaugaauugauuuuuuguuuuuaauuuuaaaaguacuuuccagugacaaaacacuuuuauuaggcuggcaacaaguuugaauuaucuauacucacuuucaccuuuuuucgguugcuuaacuuuagccacuuuuucugcuugauucccagagggcucauggaaaaaaaugauaguauauagaccuuaaagcuuuuaguggaauuugaccagauaucacuuaagaguuuagauaagugaagacagagauggacugaacuggaugauugggcacauuugcaguuugcucucuuuuaaacaggucucggcauccuaguucuaguuguaauaauuucugcuuuuaagugccagagacagugccaauucauuaagacaccaggccuggcuuuuuaaaccuauuuacucuuuuuuuuauccucuguguguccauugucuguccuuagggcuucucuaccaacguuuugcaaacaucuaggcacaaguguccagaguuccugaaacaccaccuuuucuuacaucucuuaaauugaaaugccacuaauaaggugucaccaaggcagucuuauaucugaaguaggaaauuuuucuaauccauacauagaauuaauuggcuaaucauguguguguguguguucauguguaacaugcccacuuagcuaccccauaccugcucuuacuuuucccuaccuccaucugcaucccaagggaaccacagaaauuacuaaauuuuacauagcagaagauaaauagaauuguauugcauaggccugaauaagagucacuuucagaaaaauagauuugucucauauaucaaaaucagaaguauguuuccauuacuaaguggaauaaguaagaaauuaaagcugauuuagaccaauucuuacuucauagguaccgaaaacaaauggaagaaaugcaaaaggcuuucaauaaaacaaucgugaaacuucagaauacuucaagaauagcagaggagcagguugguuucuacaucccuuauuuacuuuuuauauaaauuuccacugaauucuguagggucucacugguaaacaguaaguauuguaguuucacuuuuucccccugcuagcugguguuuaagccuguuauauuaaugugaugucauguuuggaaaguuacauagcuauuagcaucauuaucuucuguagagaaagauuuguuuaauuuuuuuuuuaauuauacuuuuaaguucuaggguacauguguacaacgugcaaguuuguuacauauguauacaagugccauguuggugugcugcugcuguacccauuaacucgucauuuauauuagguauaucuccuaaugcuaucccuccccccuccccccaccccacaacaggcccuggugugugauguuccccacccuguguccaaguauucucauuguucaauucccaccuaugagugagaaugugcaguguuugguuuucuguccuugugauaguuugcucagaaugaugguuuccagcuucauccaugucccugcaaaggacaugaacucauccuuuuuuauggcugcauaguauuccaugguguauaugugccacauuuucuuaauccagucuaucauuguuggacauuuggguugguuccaagucuuugcuauugugaauagugccacaguaaacauacgugugcaugugucuuuauagcagcaugauuuauaauccuuuggguauauacccaguaaugggauugcugggucaaaugguauuucuaguucuagaucucugaggaaucgccacacugucuuccaccaugguugaacuaguuuacaguccaaccagcaauguaacaguguuccuauuucuccacauccucuccagcaccuguuguuuccugacuuuuuaaugauugccauuuuaacuggugugagaugguaucucauugugguuuugaauugcauuucucugaugaccagugaugaugagcauuuucucaugugucuguuggcugcauaaaugucuucuuuugagaagugucuguucauauccuuucccuacuuuuugaugggguuguuugauuuuuucuuguaaauuucaguucuucguagauucuggauauuagcccuuugucagauggguagauugcaaaaauuuucucccauucuguagguugccuguucacucugaugguaguuucuuuugcugugcagaagcucuuuaguuuaauuagaucucauuugucaauuucagcuuuuguugccauugcuuuugguguuuuagucaugauguccuugccuaugccuaugugcugaaugguauugccuagguuuucuucuaggguuuuuaugguuuuaggucuaacauuuaagucuuuaauccaucuugaauuaauuuuuguauaagguguaaggaagggauccaguuucagcuuucuacauauggcuagccaguuuuccuagcaccauuuauuaaauagggaauccuuuccccauuucuuguuuuggucagguuugucaaagaucagaugguuguagaugugugguauuauuucugaggguucuguucuguuccauuggucuauaucucuguuuugguaccauuaccaugcuguuuuuguuacuguagccuuguaguauaguuugaagucagguagcaugaugccuccagcuuuguucuuuuugcuuaggauugucuuggcaaugugggcucuuuuuugguuccuuaugaacuuuaaaguaguuuuuuccaauucuguaaagaaagucauugguggcuugauggggauagcauugaaucuauaaauuaucuugggcaguauggccauuuucacgauauugguucuuccuacccaugaacaugggauguucuuccauuuguuugugucuuccuuuauuuccuucagcagugguuuguaguucuugaagaguuccuucacaucccuuuuaaguuggauuccuagguauuuuauucucuuugaagcaauugugaaugagaguucacucaugauuuggcucucuguuugucuguuauugguguauaggaaugcuugugauuuuugcacauugauuuuauauccugagacuuugcugaaguugcuuaucagcuuagggagauuuugggcugagaugaugggguuuucuaaauauacagucauguuaucugcaaacagggacaauuugacuuccucuuuuccuaauugaauacccuuuauuucuuucuccugccugauugcccugggcagaacuuccagcacuauguugaauaggaguggugagagagggcauccuugucuugugccaguuuucaaagggaaugcuuccaguuuuuguccauucaguaugauauuggcuguggguuugucauaaauagcucuuauuauuuugagcuacaucccaucaauaccuaguuaauugagaguuuuuagcaugaaggguuguugaauuuugucaaaggccuuuucugcaucuguugaguuaaucaugugauuuuugucuuugguucuguuuauaugauggauuacauuuauugauuuccauguguugaaccagccgugcaucccagggaugaagccaacuugaucgugguggguaagcuuuuugaugugcugcuggauucgguuugccaguauuuuauugaggauuuuugcaucaauguucaucagggauauuggucuaaaauucucuuguuuuguugugucucugccaggcuuugguaucagaaugaugcuggccucauaaaaugaguuagggaggauucccucuuuuucuguugauugggacaguuucagaaggaaugguaccagcuccucuuuguaccucugguaaaauucaucugugaaucugucugguccuggacuuuuuuugguugguaggcuauuaauuauugccucaauuucagagccuguuauuggucuauucagagauucaacuucuuccugguuuagucuugggaggguguauguguccaggaauuuauccauuucuucuggauuuucuaguuuauuugcguagagguguuuauaguauucucugaugguaguuuguauuucugugggauugguggugauauccccuuuaucaauuuuuuugcaucuauuuuuuucuucucucuuuucuucuuuauuagucuugcuaguggucuaucaauuuuguugaucuuuucaaaaaaccagcuccugaauuuauugauuuuuuuuuuuugaaggguuuuuugugucucugucuccuucaguucugcucugauuuuaguuauuucuugccuucugcuagcuuuugaaugguuugcucuugcuucucuaguucuuuuaauugugauguuaggguaucaauuuuagaucuuucuuacuuuuucuugugggcauuuagugcuauaaauuucccuguacacacugcuuuaaaugugucccagagauucugguauguugugucuuuguucucauugguuucaaagaacaucuuuauuucugccuucauuucguuauguacccaguagucauucaggagcagauuguucaguuuccauguaguugagcaguuuugagugaguuucuuaauccugaguucuaauucgauugcacuguggucugagagccaguuuguuauaauuucuguucuuuuacauuugcugaggagugcuuuaccuccagcuauguggucaauuuuggaauaauuuuguggugccgaaaagaauguauauuuuguugauuuaggguggagaguucaguagaugucuauuaaguuggcucagugcagagcugaguucaaguccuggauaucuuuguuaacuuucugucuuauugaucugucgaauguugacagugggguguuaaagucucccauuauugugugggagucugagucucauuguacauuguaggucucuaaggacuugcuucaugaaucugggugcuccuguauugggugcauauauguauuuaggaugguuagcucuucuuguugaauugaucccuuuaccauuauguaauggccuucuuugucucuuuugaucuuuguugguuuaaagucuguuuuaucagagacuacgauuguaaccccugcuuuuuuuuguuuuccauuuguuugguagaucuuccuccaucccuuuauuuugagccugugugugucucugcacaugagaugggucuccuaaauacagcacacugaugggucuugacuauccaauuugccagucugugucuuuuaauuggagcuuuuagcccauuuacauuuaagguuaauauuguuauaugugaaugugauccugucauuaugauguuagcugguuauuuugcucguuaguucaugcaguuucuuccuagccuugauggucuuuacaauuuggcauguuuuugcaguggcugguaccaaucguuccuuuccacuuuucgugcuuccuucaggagcucuuguaaggcaggccugguggugacaaaaucucacguuugcuugucuguaaagcaguuuguuucuccuucacuuaugaagcuuaguuuggcuggauaugaaguucuggguugaaaauuccuuucuuuaagaauguugaauauuggcccccacucucuucugacuuguagaguuucugccaagagauccacuguuagucugaugggcuucccuuuguggguaacccgaccuuucucucuggcugcccuuaauauuuuuuccuucauuucaacuuuggugaaucugacaauuaugugucuuggaguugcucuucucgaggaguaucuuuguggcguucuguguauuuccugaauuugaauguuggccugccuugcuagguuggggaaguucucguggauaauacccugcagcauguuuuccaacuugguuccauuuuccccgucacuuucagguacaccauucaaauguagauuuggucuuuucacauagucccauauuucuuggaguccuuguucauuuguuuuuacucuuuuuuucucuaaacuucucuucucgcuucauuucguucauuugaucuucaaucacugauacccuuuccuccacuugaucgaauugucuacugaagcuugugcaugagucacguaguucucgugccaugguuuucagcuccaucagaucaauuaagguauucucuaugcuguuuauucuaguuagccauucgucuaaucuuuuuucaagauuuuuagcuucuuugugauggguuugaacaucuuccuuuagcucagagaaguuuguuauuaccaguugucugaagccuacuucuguguacuugucaaagucauucuccauccagcuuuguucuguugcuggcgaggagcugcauuccuuuggaggagaagaggcgcucucauuuuuagaauuuucagcuuuucugcucugguuucuccccaucuuugugguuuuaucuuccuuuggucuuugaugaugguaacguacagaugggguuuugguggaauguccuuccuguuugguaguuuuccuucucacagucaggacccucagcugcaggucugcuggaguuugcuggagguccacuccaaacccuguuugccuggguaucaccaguggaggcugcagaacagccaauauugcagaauggcaaauguugcugccugauccuuccucugaaagcuuugucucagaggggcacccggccccauaugaggugucaguuggccccuacugcgaggugccucccaguuaggcuacacgggggucagggacccacuugaggaggcagucuguucauucucagaucucaaacuccaugcuuggagaaccacuacucucuucaaagcugucagacggggacguuuaagucugcagaaauuucugcugccuuuuguucagcuaugcccugcccccagagacggagucuacagaggcaggcaggccuccuugagcugcgcugggcuccacccaguucgagcuuccuggcugcuuuguuuaccuacucaagccucagcaauggcagaugccccuccccuagccucacugcugccuugcaguucaaucucagacugcugugauagcagugagcgaggcuccgugggcaugggacccuccgagccaugcacgggauauaaucuccuggugugccauuugcuaagaccauuggaaaagcacaguguuagggugggagcgucucaauuuuccagguaccaucugucacagcuucccuuggcuaggaaagggaauucccucacccuugcacuucccggguguggcggugccccgcccugcuuuggcucacacuccaugggcugcacccacuguccaacaagccccacugagaugaacccaguaccucaguugguaaugcagaaaucacccgucuucugcgucgcugaugcugggggcuguagacuggagcuguuccuauucggccaucuuggaaccuuccaagaaaguuuucuuuagcauuauucauaguacauuguguguguguguuaaauagaaacauagaggacuuuccugcaacuuuguuaaacucuaaaauauuuuuguuuguauuuuuuuuaauguagauaaucuuauugacugcaaguaagaacggcuuuguuucuucuuuuugaucgucauaccuuuuuuuucccccuaucucuuggcuagagccauauagugauacaauaggacugguaauuaugaccguuccccuaucuugcugauuuuaagggaacuauucuaguauugcaccucuagugugauauguguguugucacauaauaaagaaauuuuacacuuuucuaaaagguuauuugggucucggggauggugaagugaggaggccuuauacugcggaguuuuguuaggugcaucuuacuuuccuauucauggcacguuauaaauuggagauacacuuugcaaauauuuucucccaauccauuacuuguuuucuuauucucuuuacagugugguuugaagagcagaaguuuuugauuuguugaagcccaauauaucaguuuucucuuugcucuaugaaauauuugccuaacgcaaaaucacaaagauuuuuuccuuuguuuuuucuagaagcuuaauaguuuaguuuuauauuaggcccaugauucauuuugaguuaacuuugauguguuacaggguauggaucaaaguucuuuuuggaaagucaggguuagaagagcaaagcauauagacauccauuuguucuagaaucauucguuggaaugagcguccuuucuccacagaauuuccuuuguauauuugauaaaaaucaguuaaccauauauaugugggucuguuucugggcuuuuguucuauugaucugcuugucuaucuuuaagguaauaacacaauguuauguuuguuguagcuuuauauuaacauuuuuagucagcuaauguuaaguccuccaauuuuauucuuuuacaagauuguuuuggcuguaguaguuuuuugcguuucuguguggauuuuaggcucagcuuguuaaucucuaccaaaauugaaucuugauugagauuguguugaugaauuuauagauuaauuugcauaaugucaucuuaauauuaaggcuucugacucaugaacgcaguguguuauuuagcuuucauuaguuugaauacgaaagccccuuccucuguauuuucucuuugcugauauguagcaucuaugucuugugucucaaagacuuaugugaguacuuuucaacaauguuguauauuaauaguauuggaaguuaauccugauuagaaguguuaaucaacuuacuaacuuuaauagcuuguccuuuaaauguuuauaacugucuugaauucaucagagucaaauguaagucaggauucaaaagaaacaauuuaaaaagucacauuuagcauuuuggaaagaugaaguaggauagaaaguaccauaguggaucacaguaagggaaguaagugaaauauuuuguuacaguuuuauacacccccccucuccacacacagguacacagcuuuuuaaaaaaguuuuugaaucaaaauaugaaaaacuuaggucuagaauaauaaauagcuauguagauauuucauauaagguccuaaaagaguuuuagauuuccuugacuucuuccugcccucguuuccuccucccuaacuuuauuaaaaguucaaauuuucgaccauccuggcuaacacggugaaaccccgucucuacuaaaaauacaaauaauuagccgggcauaguggcgggcaccuguagucccagcuacucgggaggcugaggcaggagaauggcaugaacccgggaggcggagcuugcagugagcugagauugcgccacugcacuccagccugggcgacagagcgagacuccgucucaaaaaaaaauaaaaguugaaauuuucaguuaaagucucccuaauacagggucauaacuaugauugugauguagaauucccuaaaguaugcauacaaacuauauuauaaauaagacaucuuuguugauuauaaaaguuucuaaaauucagugcugccuaaaacagauggaaagauaggcauuuuugaugcauuucuuucauuggugauauuuuagcauugguuggaugaacaauuauggauauuucacuauguaccauccuaaguuccaauauaauaugcuaugaaggaaauuuuuaaaacuugguuuugggccuacuuuauaaccaaaaaaauucuucagaaaauuuucaauuugucuuugcgccaacugcuuugcuuuaaaaacacugacuucuuaaauauuucugguuauaugcuaguuuauauauauggaacacauguuaauuugaaaaguaauuuaccaaauucuguuauacaguauuucacauuguagcagugggugacaaaaauaaauaaauaauaauucuuguuggggaggguuagacacggucccagauacuucguguuuuguuuauuucuaaaauuucuguucaaaguuuacuuacucauugagauuccuauuaauacauuuguuuuggaauaacuuaaugguuuuuuuuagauuauuugacuucaauuuauaauguuaauaguuuguaguuaauauucaaaaaaaaauaaauuccuuuaucauaggaucagcggcaaacugaagccauccaguugcuacaggcacagcugaccaacaugacacagcuuguuucaaauuuaucagcaacaguagcagaauugaaacgggagguaauuguuauugcugguauugcgagacccaaugcauguauagagguugucauaaagccaggcuuguuaacaugaacaugguaccuaaaacuuugaccaaacaaaauugucauuuguagugaacuuuuucaaaaaccagaauauggcauuuuuaaguuuugaaaauauauuaucauagucuuuuguaaaauauggcuuucauaauuuaggccauaccuauaauauagguauaaaacuucuagcaggccuuuuguaagcauugauaguagcaacacguacuucauuuucaauucaaaaaggccuauaaaguugcuuaacaaagcaaacauuucauugauuuaaaaacuuuuuauugagcaucuaguguaugugaagugcgagcuguacacuccuagguugugguauacgguaguuaauagucccuggccucacaggguuuacguccugggggagggauagaauacauuuaguaaauaaauaaauagaugauaauuucuccuagugauacguacuaugaagaaaauuaaauguguguguguguguguguguguguguguguguguagggugguagcaguaagggaugcugcuuuaguuagagugaucuuggaaggcuuaucugaggaggugguauuacaacuaaguacucaagaggaguuagcagccacacauugccuggaaugauaacaaaccuguuucuagcagaacuagggcaaaggacuggagaguagaaacaguguaauguguuugacagcagaaagaaagcugguauggcuggagcagagugagugagaaaagugaagcugagaaauggguucaagauauuggcagaggccuggucauguaggacuucguagacaauuuagaguuugaauuuuauuugaaucuuuguaucauuagaaguauuaagaagugauaugggucaugucauuaaugcuuagcacuuugagaagcucuccauuuguugcuuuguggagaacugccuguuggggaacagcaggagcagaagcagacaggaaaccaauuaagagguaauugcaggccaggcaugauggcuuuugccuguaaucccagcgcuuuggguggcccagguggucagaucacucgaggucaggagguggagaccagccucgccaacaugaugaaacgccgucucuucuaagaauacaagaaaauuagccggugugguggcaugugccuguaaucccagcaacuugggagcuugggaggccaaggcaggagaauuaguugaacccaggagguggagguugcaauaagccaaggucacaccacugcauuccagccugggcaacagagcaaggcucugucucaaaaaaaaaaaaaaaaguaauugcaguagccugaaugaggugguauugacuuagaguaggauucuaaaaguggagaacaguguaaacuuguugaauucagaauauuuguaaguuguagaaagauaagccuuaaggaacuaagguugaucucuaaguuuugggcuuacguaacugggugguugauaguucauuuuauaagaugggaaagacuggguaaaagcacaauuauuuuuucuccuugaggaggagauaguguaaauggaaagacaaacaaaaugugacaaaauguuaacaauuggugagauagauaaagguguaaauauauuucuuguuuuauuucuaaaacuuccauagguuucacuccuauagaaagaauuggaaugcugcaaagaauuuuuuuucuuuaaugucauaguuuauuuucaaagagcaugcccugcauuucuggucuuugaagcacauuaaaaaaauacuuaaaaugauuuguccuuugaauuuuagauacccuuauauuuuuccuaauaugauuuccuaugauuauuauuuaacccucuucucaucucagguuucagaucgacaaagcuaucuugucauaucuuugguucuuuguguugucuugggacugaugcuuuguaugcagcguugucgaaauacuucucaauuugauggagauuauauuucaaaacuuccuaaaaguaaucaguauccaagcccuaaaagguaauaucagcauuauauuucacaauuuuauuuuuuuuacuaugcuuuguauauuuuugagaaauuuuaagcaaauaaagggagacugagguaauuucuuucccuauaugauuaucuugaaaccaaaacauuaaaaacaucauucgauaguaagaugguccuaugccuaaccuggcucuguagacuauaauagagaaaacacuaauaguaagugcaugaaaccccugaaauauuugguugagaaagaugcuuaaauguggaauucaaaggaagaagagaauacuauuuuaauacaguaccuuuuagacaaagaucucuaaauuuuuuuuuccaccuguauuagcaauaacuggaguguuagaguuagucccgugugguauguacaguucucaauaaccucuguguagccucaacaaaagaguaaauuauaugugcuuuacucguuguaaccaauauguauuuuuccuaauguguuagguguuucucuuccuaugaugauaugaauuugaaaagaagaacuucauucccacucaugagauccaagucucuacaguuaacuggcaaagaagguagauuucuguggauauauaauauguauauauaaacaugaaacuagcuucuggcauaaauauaaugucaguguuguguucaugaccaucugcaacaaaaaauggauacaaguagccuuugucuuugugcugugucaagccacuuuaucauuuucacauuuuauaucugucuuuguuccuaaaagcccagaggguagggaggggggcuuaguuuaauuagcaguugguagcuuuguuugcacaugcuccuguuuagaaguauuucuuuuuagaaagggauguuugagaaaguucaacagauauggaaaaccugaaugugcucccauagcauccugugcuuuucugccuccucuucuuauacagguaggaccccuuuugucucuaguuuaggacuaugaggcacuuucugaacaaaaaucuggucucuuuuuuuuagcuccagaaccuauaauuagguuccauugucuaacacuaaauaaauacuuacauuuaaaugaauggauguguacugaguggauauuuuccuauuucaguaucuuguaauuaaugcauauuaauagaauuagaaauuuguuuucauacuaauauuaaaauaacuaaauuaauuacauauuuuauuuaggagugcuuucuuaauaaucgaugguuguaggauuuaguaacugaguagcauguuucaauugauuaaauuauucaaguaaucauuccugggcuucacuguuuuauuauuaucacaaagcuuuacagacuuaacccauuacauguguuuacuuaaagcuaguaaaucucuucuuccuccuugcuuuuuucuuuuucuuuugguugauaugucuuuuuauaagugaaauuuuuaauuuaaguauaauuauguguaaaacguaaugaauuuucacaaacaauacagcugugcaaauaacaccuaaauuaagaaguagaacaugagcaccucaaaaacuuccuugugcucuuuuagucacugcccauccuuucccagaguagccaguauuuugauguguaaccauugugagauucaccaugccauugacuauaggcauuuguuuauuuucguuccuuauaguauuccauuauauagguauacuguacauuauucauuuacauuuagauuauuuucauuuugagguuguuacauacuuuugguaaacaccugugcauuucuguuggguauacacuggaaaugggauuggugaaucauaggguauguguguguucagcuuuaguaaauacugucauacaauuuuccacacuguuuuaugaauuugcccuucuaucagcugcguaugagaguuacaguuacuucauauucuaaacauuccuuauuugagguauacccaugcaauuaggaaauacguuagauuuuugcuucucagcauuucuagucuuaagugaaaucgugacuaucuuacuauuucucuucucuuuauccaauuuuuuagggccaaacagaguagcuuuuugcaccugauaauagaauuacuucuauuuuaaacaacagugucaucuugguguaucuuuaccaguaaagaaaguugaguagaguagguaggagacugacuuuaguccugauucuaccaauaguuaauucauuuauuucuucuguuguuugauaaguucuuguuguuauggcauuuaucauaguaugcuuugauuuuaccuauuuuuacuugccuuauuuucacuucuaagcucugugggagagaccaugucuuuuucuuauugugauaaaaagcacauaaaauuuaucauuuuaacaguuuuuaagugcacaguucauuaguaguaaguauaguuacauuguugugaaacagaucuuccgaauguuuucgucuugcaaaccugaacucuguguccauuaaccaauuccccuuuucucccucucucagucccuggcaaccacuauucuauuuucuguuucuaugaauucaacuacuucagauaccccauauaaguggauucauacaguauuugucuuucugugauuggcuuauuucacucaacauaauguccucaagguucaucuacauuauagcaugugacagaauuuuuuccuauuaaagggugaaauaauauuccauccauuuuauuuauguaccucauuuccuuuauccauucaucuguaaguggacauuuggauugcuuccccucuuggcuguuguuugaguagugcuguucagggguauacagauaucucuuugcucauuuuuuaguuggauuguuugaguuuuuuguuuuuaaguucagggaauucuuuauaaccuccguuauggauuauaacccccauuagauaauaugauuugcaaauauuuucuuucauccuuuagguugcuuuuucacuguuuugauuguguccuuggauguacaguuuuuaaguucaacgaagucccauuugucuauuguguuuuuguugccuguacuuuugggucauauccaagaaaucauuaucaaguucaaggucaugaagcuuuuccccuguuuucuuccaagacuuuuauagauuuaugucuuuaaucuauuuuguguugauuuuuguauauaguauaagauaaggguccaguuucauucuuuggaaugugaauauucaguuuuuccagcaccauuuguugaagagacuguccuuuucccauugaguggucuuugcacccuucuuaaaaaugaguugaccacguacaugagggcuuaucucuguguucuuuauuuugugccauugguguauuugucuguguuuaugccaguacucuaccacuuugauuacuauaccuuuguaauguguuuugaaaucuggaagugugaguuaucuaacuucauucuuuuuaaaauuauuuuccuuauuugaggucacuugagauuuuaugugaauuuuagggugaacuuucuauauaagcagugucguuuuacuaguucacuugcagauuauuuuggauuuucagugaauacagguacguauacugagaacaaagacaguuuuguuuuuuccuuugcaguccuuauagcuuuuauuuccuuugcuuucuuaacuguguuagcuugcauuuucagcaauguuaaauaaaagugauugacaggcaucuuugucuuguuccaaagggaaagcuuacaguguuuuauugcuaagauuguauuugucauagauguuuuguggauuuuuuauucuguauuuugucauuauguguuaccuauugucauagguauucuauaaauuuuuuuauauuauauuuuauuuccauuuuuaauguuacaaacaugaauuauauuagauuuucuaauguuaaacuuauauugcauuuuuaauaccaguugcucaugauauacgugugugaauuuuguauuguauauauuauuucuacauaauuuuguuagauaauuauuuagaaauuuugcaucuauaugaauaagauuggcauguaauauuuucucauguuggauuuugguauguaagguuuauaaaaauuagaugggcagggguaucccuuuuaauuuuuuuuuuuuuuccccuuccaugcuuucauuaagauuuuuuauuggggaggaaguaaauauucccuuuuacugccauuauguuggaaguuguguacugguucuguucuuuuacuaguuacccuagaagucagaaguauuaauguuugccaaagucucaaguucaucaauacuuguaucuucuccuuaacaauacauagaucuuaaaacucuuauuugucccaagccuuauuuauguuacuguucuuguauauuuuaauucuauucuuucugcuuaauuuuaacucaacaagguauuucuuuuuacacuuaauguucauuuaaauuuaccccacguuuacuaauguuuuuauucuucagagcuuucauuugucauuaguuaaaacugaaauauucuccucuucuuuuucuuuaucauuuugagauucgugaggcucuuuggagcucuggauuuguagguuucuuuuacuuguuauugagaaauucucaaccauuauuuuuuccucccagauauucccugugccccagucucuuuuagauucucauauuuaauuaaacauauuacuucuccguauaucuucccugucuuguaaacauuccaccuuuuugacuuuuuaugcuguauuuuggaugauaucuucugauguguuuccaggccagcagucuuacuguugcaaauuuauucauuggguuuucaauuucaguuauuuuuuccauuuccaggaguucuuuuuguauuuuuuaaaaauccaggucuguauuuuccuuguuauauguuuccugcagauauuuucaagcuuauuuucuagacauauuaagcauaauuaucuuuauaguuuguguuugauaaaucuaauaucuuaaauuuuugugagucuguucauugucuuuguaagcucuuacucaggguauguugugucuuugugugcuacuuuuucucuuugaaaaguuauuuguagggauaauuugaggccuagaauauagguucuuauuugagagggaauuuguguguguguuacauucauguaauaccuuacauucaugacuugugguuuguugggccaccaggugaugauaauuuggacugcaaguucaugcauggcuucauucuuuaccugagaauauaguccuuuggagucucaguuuacuguacacagggagaugguaucuuauuacacuaaacuuugggugggcccuaggaccugauuucugauccauucccuuaugauaccaucagaaccaaaguucauauauucuuguguuggcaaauguuuucagggcaaaaaugacuuuugucuucuacuugacuguccggguucccacuuuucuuucaguuuuagccuagggauuacuuucuuggcagcuuuucaaugcuuuuagugauuuuuuuuaaaaaaaacaaacuaucauuacuuaguugcuuucauuguagagguugaucugaauaacauaacuguuucuagaaauagacaucauuauuaaagaaaguaaauuaagauuaguaaucugguagaaaugacuguuuagagggauguuuugauauuuucauauauuugaugacuuucucaauaaaucucugaaauauaauguaaaaaauuauaauugguugaauuguauuaauaaauuucccaaauguguagagcuucuguagugaauuuacuauguguaagcuuuugucucugucagaccuuaaauuguuuauuuuuaguggauugaauaggacuaaagucucauagccuuuuaaaaaugugugucuauuuugucagugugggggugggguugggauauaucuugaagcugcuuagaguaaugaaaccuuagaaacuuugggcuaaaacuaauaaaucuaauuuacucacuaugccagaaguguucauucauuauugcuuagugauauauauugcauguucaagcuguuuuuagauugggauuucauaguuuugaucauaguaauaaacagagaaaaauaucuuggaucucuuuuuguguuuauuucucuaacuggcuuccaaacacggucacgacuacuuguugcacauuguuaaucuaccuuugugacacaguuuagaggcuagucuuuuagggaaguauucaaaugaucuguagguuuggugugagcuuacccaggaauguuucuuuucuuaucagguaaaagagugaggcugggcccaaagaaagaucguuauuguauugguugauaaccagcuacuaguuaacaacuuaaggaaguauaguuauuugaagacgaccagucaagcauaggaaucauaucaucuuccaccuugccucuuuuugcuuacuaauuuaaaaugcauaaauauauaguuaaccugauacaaauucauugguucuauuacuagaggauaauaaggaaugaaugauuugucuuauuuuaguguuuaauuauagcaaauccaccaaauccacuuuacauuuuacaucugcuuuuuuuuuuuuuuacuuacaguagacccaaaugauuuguacauuguagaaccccucaaguuuucuccagaaaagaagguaauuguuuauuucuuuuuaaguuuauugcuauguuuugugauaauaaaugaagaaaagagguugaaagguuuaagguaauuaccuuuaaguaguccuuaacugaauguuuauuuucuaucaugauaauguuguaaauaaauauuaacaggggucagcaagcugugacccacaggccauaugggccaugagccagauagguuuucucauuuuuaaagagugauaaaacagaacagcaugcaagagagaaaaugugugaccugcaaagccuaaaauauuuacugucugacccuucacaaaaaaaauuuguugauccuuggaugauugucauuauuuauuaccgaaugcaugccaagcacagagcaugcaccguuccucuaauccucaccacaaccugaagaugauguuauccucauuuuuuuuuuuaauaaaaaaacagcaacucagaauguacuuaggauuuuuuggcuucaaagucuuugcuuuuucauuuugccuuucaaauuaaguuauacuaauuuuaguuguaauuucaucuaggugaaagaacuugggcuuuguaggcaaauagccuaagauucauucucaacccggcugcuuacuacauuguaacuugggcaaagaaccaaacaucugaaccuugcuuuucucauuuaagaaucaaggauaaaauaccgaccuuucaggguuaauagcugccauaauacaugaaagcaaccuguaugcucucuggcaguuaguagguauucagauauuaguaucacucccuaaaccuauauucauagguagcagguaagcaauuuaaagaguuuugauucaguaguauuuacaaaaugggaagaugaugcuaguaucuauauagaacauaacaauguauguguucugugcuguuuauaauacuguuuuacuuuucaccaggagguggcacuucucuauuagcucagcucucuagguguuugauaagguuacuaugggaaguaucauuacuaacuuuucuuuuacuuguguuguagaagaagcgcugcaaguacaaaauugaaaaaauugagaccauaaagccugaagaaccauugcaccccauagccaauggcgacauaaaaggaagaaagcccuuuacgaaccagagagauuuuucuaauaugggagaaguuuaucacucuucuuauaaagguccuccaucugaaggaagcucagaaacuucaucacagucagaagaguccuauuuuuguggcauuucagcuugcacaagucugugcaauggacagucucaaaagacaaaaacugagaagagggcuuuaaaacgaagacgaucuaaaguccaagaccaaggaaaauugauaaaaacucuaauacagacuaagucgggaucauugccgagccugcaugacauaaucaaaggaaacaaagagaucaccgugggaacauuugguguuacagcagucucgggacauaucuaaaauuaauugaacuuuucauacagaagacuuuuuuguuguuguucuuugaagaacagucuguaguauuugaaggguuugggggagggagaaaauauuaaugggaaaggcauucagaaauuaugguuucuaccuuuuuaaaaaguagaugggauugugucaaucuugguuaaugagcuacaguuuuacaaagcugaucacuuccuauaaggacaaugguagacauuuuauaaagauguuuuuucacaagauuaauuacugggacaaaaguaauuuggaagcccaguuccuuaggugggauaggaaugaaagccuaaaccucuuccuuuagcuuuguuccuauuucuugcaccuucccauauuuaugugccuuuugucuauuuauaaugccacuggaagaggagggauaacuuuuucuguuauuugauuucuuuuauaacuuuguuagguuuuugaagcugcaaacacuacaaugcuuugagggggucugugccugaagcucaggaguguggaucagacagucuaaagauccuaaaaacuugccaacuggaucuuuguuuagcaaacucacuggaaaugaacacuuaauggaauuuuuaagucuguucuguuagguagauggugaugcucuuguuauuuucacuuauucagacuggauuacuucuuacuuaguuacuaacucaaugaggaaaaaucccuacaggaucuuuuuuugcaaacaacugauauaugcagacaaauuuuugacaaauucaccuuuuaaacacacuuaaccauuugugaagguuuucuuuagcuuacauuuuaaacauacacaauaaacacuaauccuccaaacuuucacuguuuuuauuaguaugaauauaaaauuugaagguuuggccaauuaguacaagucucaugauauaaucacugccugcauacauaugcacagauccaguuagugaguuugucaagcuuaaucuaauugguuaagucuaaagagauuauuauuccuugauguuugcuuuguauuggcuacaaaugugcagagguaauacauaugugaugucgaugucucugucuuuuuuuuugucuuuaaaaaauaauuggcagcaacuguauuugaauaaaaugauuucuuaguaugauuguacaguaaugaaugaaaguggaacauguuucuuuuugaaagggagagaauugaccauuuauuguugugauguuuaaguuauaacuuauugagcacuuuuaguagugauaacuguuuuuaaacuugccuaauaccuuucuuggguauuguuuguaaugugacuuauuuaacgccuuuuuuguuuguuuaaguugcugcuuuagguuaacagcguguuuuagaagauuuaaauuucuuuccugucugcacaauuagcuauucagagcaagagggccugauuuuauagaagccccuugaaaagagguccagaugagagcagagauacagugagaaauuaugugaucuguguguugugggaagagaauuuucaauauguaacuacggagcuguagugccauuagaaacugugaauuuccaaauaaaucugaacacuugucuuuauuaauuacuggcucuucugucuuuuaaaagagaacucagaaauuauuaaucuuugaacagagauuuaaguuuuugccacuuuuaaaguuaaauauagcagcauuccauucaauauugaucacauuucagccaacuacaaaaugaugguacuuuuacauaaacauuuugcucccuaugcuaucagaauuucaguuuuucauaucuaaauacagcauaacauuuuguaacaugagguuuauuuuuuccucucucacauaacuacaugagaaaaaaaacuuaagugaaaauaauagauuuaugccuauuaagaagcaaaaacuauauagauauuuauccaaugggauuuuuaguguucccugaugaucaaccucauuuuauuucuucuaauguuaaguaaagcauuaaaacaguaugaaauaaaaggaaacuagggaauugguaagaacaaggaugcaaaguaaaacaauu

SEQ ID NO: 12922 - RNA, 8272 nt, Homo sapiens
cuuuuccugguccuaaauucauugccaguuccccagucugcagcaaaugugccacgucaagacuggaaaucacagcccuugagugugucucagucagcgcagcagaauucaggggggaaagcugaaugcaaccccuggugcaggaagggaggcuuuuccugaggaccgggagaggauuuuaaguacauagaaggaagcuucuggagauccugcuccgucgccccaguguucagacuaccuguucaggacaaugccguuguacaguagucugcacauugguuagacugggcaagggagagcaacgccauggaccgcuggggacaaaaugggcuguuuccaaggagaagacauuuguuugcuccuuuuuugaaucucauauccaguguuuuucuucacagguuuugcacacuagggaccaagaagcccucggggacacugcugagaaaagacugccgaagggaagaccagcggguaaggccuucuugacugcucaccuggucugugaccaagggaaccuagguggggagcccaugauuuguguuaacaugcaagggaaacagagguacaugugugauggguagagauguauuuaauuuuaaaagagcaaaagugugugguauauagcgauuuacuguuuuuuuuuuuuuuauuucugaagauugauaauucaaguguuuucuuaaagguuuucccacuucaaaaugaaauaugaaaaaacucauuccagacacuuaagaauaguuuaaugaggcuacuuuugaauuguuuaauaauaauucaaagauuuaaaaacuuauauggaugaaggcuguauguauaacuuuuaacaucccaggacugaagucauuuuuccccaaaguaaagaauacuugcugguuuuuaaaugcuauauggauagugcuuuucugaagauuuccuucuguaauauaaacaacaggaauaauaguaccuaacaauaaaagaagaaccugccaagucuugccuaccagacaaugcagaugggauuugcccagagaagagcaccgacccacaacuuauugagucagcaacugaguaaaucagggaauaaaaaccucuaucuuuagauaccccuguaaauaucuguuuuacauuuuuuuuaaaucaaagagugguuaauaauugcugcucagcugagcccucuugccuauagcuuacaaugcuuccacuucucugagcauuuaaaauaaggcacuuugucuagaaacccacugauaaaaaaggaauuuguaaacgaaggcagaaguuuucuuuggucaguuuccagcuguccuggaggugaaagagggugggagagggggaggaaggugggagggaagaaaacccucaagcugaaugaaauccuaauagagaaaauaauagagcaagucuggauugcaaugugaucugugcugaacuuuagaggucggccccuuaaagaaaguucuggaaaaauguuauugccucaucccuaauuuucuuaacccccauuaauuucuauuccgaaacaauucuauauaaugaaaacaucucuucuacaggguuugugaaaaauaaacauaaucucuuuuguccuccuuuaaaguuacagugguuccugaacaaauucuuuucuaaguuauacauuuugcaacaauucaaaaauugacucaaguucucuuuagcaaaauauuuuauuauaaaagauucccuaaguuuucuuuugucaaaacaacuuacuuuaaaaauuacccuucugaucaccccaaaauguguauaaagaaaacauuaaguauucucauauauucaugauuauuaguuaaaauauaaacagcaaggagaaauuuagcuacuuucacuuagaugauauaguaaaguuauccuuucauuuucuauugugacuuggagaguuccauauuaauuauuuuuaguagaacaaaugagauguuaaaaaucuauauaguuucuuuuacauaagaaaacuaaaaaaaguaacuuagaggagcucauuuuuucaagaaauauauuuuuucuaauugauacaauuacugaagaggaaaaauagcuaacaagguacuuugguaauguuuuucucaaauuuucuggguuuuuuuuuuuuuuuuacucuagaaaugauuacauuucaaaauuugcuuucauuuaauguauauuuaauuucaauuucuuucuucauguuaaacggucuuuuuguuucaaagaaaugaaucccuaugggucccucaccuauuuucucccucaggaugacuuuuagucuggagauagaagggacauaagggugccucuggcauaaguacaggaguagaaauauaagaauuacuuuguaaaaggauaaccaaggaguuccugcacaugcuugauguggcucuagcgacuuauuuucgaggcaaaguuuuaacaaaugaaaacgaauaguacuuauuuuucaauuauaugggcuaaauuaaagaucaaagguaaaagcucauuuuauaaagcucugcugaaugaaggcaggauuguaguuuaugcgcugguacacacgcccacauuuauauacauuauagccauaucuauauccagguaaauuagaaaaauguuuaauuuuauuuucauauuacuuuauaaggagauauacaaauauuuuagggaucauggaaucuauuccagaggaaacuaaccaacagugagcaucuucaacuaaaacuaccccuggauguaauaaguguaaguauuaaaauuaaacauuauauguggucaugaagagaaaauuguuucagggucuguccaaacuacacuucauagaaauuucauaauuauuuuucauuuuagcaugugaaugauugauaaauuggacuagguacuggguuaaaaggacuuuuccaccaucuaagagaaaggaaguucagagccuuagcuucaacaccacaauuucuuaacuggaaaaggaucaaucuaaaacgguggacuuaaauuuucaaacucauuuuucuuuuaggccacagaucucaaaaucaaagaaagacuguuuacuauaggacaaaguuucacacugaucacuuuccuguaguuagucaauaggcuuaauauccuuccugcuuggcauucgggcuuucggcccagauaauauguuuauguuuguaaaagaccaaaauauacuaucuacccccaccucucgccuacagaccacccauguauuucacucugugggaaacaguuuaggcauaaaaauccuaacgaaagaauucuccccacuuuuuugguugaagucuuaagcuguuauaagauauaaaaaguacaacuugguaaugugaaaaaauucacucauccacaagcauccaugcucgguaaagagacgccaaagcuuucacuuacucuguaagggaucugcucuuuauaaacaaugcacuuuacucugcucuaaggagaauagcccacccaucacaauaacgucaaaauaauaacuaagagaccaucacucagaaauccuggcuuaaaauaacuagaaggucaggcuuuaaccugagacaggaaauuccugaguuaagauagaaacuuucuuacuucaaaucccuucuuacuuucauguucuguaaauuaaguagaaauaaauauuuacucauuuucaaaggucucuuacaaauaauuuuuaucaguuuuaauaguuagagauaacgaaguaaauuaggaaaaauaauuaaaucuucauuuugaauuuuuugacuuagcgugacagccaguuuccuggaguugcuuugguuuaauuucacuacagaagacuuagaagacaauucuuuucuuacauuuuuuuccuuaagaaauaaaagacaaaaagaaaacaagguguaauaaccacacuaaaaauuacaugguaugauaauaauacaaauagcucuuuuauguuuuagcuaguauuuuaaguaauaauaaacuaauauucaaccuauaauuugggagauuaaaaaaaggucaauaugguuuucagucuuucaucuuuuuaacaaguuuaggggcagguucaacauaacaaugaagugugcauaugucacauaguuacuguaaguguguuuuaaaaaucuaucagaaacauaaauuguccaaaagccuuaugaauagaacaauuguuuucagcaagauuuuuuuuuuccccugaaaaacuguugugguuuuucuggcucaaaaaauuuuuauaucuugccuuaauaaaacuguuuuauauuaaagcauaacauacaaacucacaaauauuucuuuuuauuuuuucagguugcaugcaucauuccuuuaauugagcagaguuaacuggaucaaauuauuuaugggagagagaggaaaaguuauaaagaauuauaguaauuuuuaauuuccaccaauauacucuuuguaagugaaucacucuauaauuacuuucuguugcacugaaugcagcaacaauaacacaauaguauuuuaaggcacugguuuuuggcauacucuaaccuuguaauuauuuaaauaacagccaaguuuacucauguuuuugauucugucaagaaaaaaaaaaaguuccuuuacucgaaagugauggccgaaacagaaucggaaauuuguuuucuugaaauuacauaaauacacagaaaauggcacuuauuagcuuuuguuaaaacauuaccuuaccuaaucacugcauaaaaguccagauuuguagaaaauuguaauuuucucaguaucuaaaacuauuuugcuuuccauuaaguuucuauuugcuauuuucucagaauuuuacaauuaaagauaaaucacaaacuguuuguuuuucuuaaaguucuuugagaaaaugucuaauuauacaauccuuggacaauacuguguuuuuuuggugcuguguuuuuuaagaaguccuacuuacuggaauuuugacuauuuggauauuuuuguuuuuaaaaggggaggggaauuugcuuaauacuucuaaagaugugaauugauaauugauauuaaaauagaauuacucucaacucaccagaauuaaauuuuauaucugcauauuuaacacuauuagcucauauaaauuauaagaaaaauuuucaaaggaucugguuuuaauuuuuuggauaugaaaugaauuugccuuuucugccuuuucuuaaguacuauuuuguaacuauauugcacuaacuauauccaaaacacauucugagcaucacugugaguaacagccuuccaguuuguacccuuuugauucacagcauggcccuauaguuaauuaagagguggauaacuuaagcucacaacugccuuuaauuugauuucacauccacaguuauaaacuuugcauuuaaaaggaaaaugagacauuuaaauagguuccuguuguuucacauauaauugguaaaaacauauucccuuguaggauccuauuaucagagcaucaaauaccaaagucagcaacuuggguugccaaauaaauuaggcucauuaauuauuuugaaaagggcugcuguuuccauguaaaugauaauuuucuuuuucauggacaagguuaugguacuuaucuacuaaaagaaacaugcauaaacauaguuuuuaucuuuaacuucaguauuaaaauaugcaguuuuuugcaaagaggaaaaacaucugguucaauuacgcugaacucugacuacaugugggccaguaauaauaugaauuggacuuaagaauaaaccuuguguuuaaucucuuuuuuuccuuaaaauuuuaaugugaguuuucuguuacgcaaauuauccauguuagcacauuuggaacaaauguauaaauguacuuucugaauaaagucaaaagucuaacuuguuuuuaguuccauaauguuuuaauguuuaauuauauuguguauuuuucucccuuuccccuuacucuccaaaaucaccaaaucuggaaaacaggcugauuguaucugucuaugagcaaaggaaaccugaaggaaccaagggccuggcuggacagaguugucaugugucugccugucuacacuugcugugcagaacauccgcucaccuguacagcaggcacagacaggcagucacaugacaacccagccugaaugacaaccagccauugaaagaaagcagcccucacaccauagcaucuacaccaagagcuacaaccaaaaugaggggcucgggggccugggguuuuaaucuguugguuuaauacuuaacucauguauuauuuuauuuugauucaaguauuaaaacccaccaaaaguaaagugaguggugccuaugaaauauaauaaaacccauuucugaaaauguuccugugcauucuauaguucucuuuuccuaauuguugucagcaaaucacuacccuugaccuuuauuguacacagcuuugcagcacccuauauugauauaaaaacucaauauaacaaaacaauauaacuucagucugaugcuuaacaaagaauaaauuauucuaagaauucuuguccauaaacuaaguaugguuuucuaugucaugauuuuuuuuuuuuuuuuuuuuuuuuggaaggggauaggguggaaagacagagaaaagaaaagggagaaaaagaguauuccaaaggaucaagugcuuugaguuaacucugccagucuggguuaacucugccagucugggucugggcaaaacacagugaaaagacuacuauuuccaacuaguguucaacuauauuaaaauaauaguuucuccucuuuugacauauggaaaguugaaauuuuugauacuuccacgcgucaugguauacauaaauuuaugacugcgucauucuuuaauuaagaaggugcuuaugcuacaguucuaggaguagaauuuacaaggccaacacauucacuugcaaccuaugcuuccaucacuauaaacuuucaagaucuugagauguucaggcaauucauuuaucuucagaagcauaaggaaagugguuaaugcacuugaaauguauauuuugacacaucuuuugagaaaauauccaaacuucaguuuaugcacuguuaacuggagugaaaugauaagggauggcuuuugucuaugaauacuuuaaauacuuaaggguaaaaggugggaagauggauaaaauuagaaaugugucaacuuuuauuuaguucauuaacauguuuuagcuucaguauuugaaauuaauuuucaucuuucuuagauucuggucaagcuuaaaaaauguaacacaaggcuacucaaaacuuuuuucacauuuaacaauuaaacacuuuauguauguauucuuaacuaaagcaaacuauuuuucauucagcuauuuuauuuuuaaaaugaaagucucagucuuaaagcuaagaucccagugaguuucaaauuuucugacaaugauauuuuaaccaaaccugacauuauaguuucuuuaauuaaaaaacugaaugauggggcaaaacuacaaagcacaaauaugauuaaaguuaaauuucucucauuuaaacaaucuugucuuauggcaauaugucaucugcuaaaauucaucucugcuucugcaagauacauugcacgaugcagauuuuugccuuaaauaaaagucccauuacuagcaaauaaaguccuaaacaauacuuacaaaauguagaauauaaacaggaagacaauauaaaaauuacucacagaauaucgacaucguucuacccaaucuuaaaugccuuguaccaccuguugcaaaugcugccuaugagaguucacguauggaauuauucuacuggacccugcaaggcucaggagagugcuugacagcucccagaaugagacaaugaccuagccagaacauuaaggagacuacacccguccuucagacuccaaagggaaagcuaggacggcagcagagucauccuaaggugaggcacuccaggauaacauuuucaauauuuuuccuuaaaacauaaaguuaacaccuuuuuuguuaaacauuuuuuacucaauuuucaaaaaaaaugcuugaaagaauguuuuguauguauuuuaaagucauuaaaugaggcacauuuaaaaauuuuucucuucugggaaaggguaauauaaaggauaauauugcucuuccaggauaaacuuuugagugggacaaauaaugcauauaggggaguggguuugaaucuaaacucauuuuuaauaaauuuggaauaggauuggccauuaugguuuauugaauaauacucuuuuuuucaaaauuauaaaucuuuagauaauaccagaacauggaaauauuuguaugaauaauccuauauuaaaaaagaauaacaucagauaguuuauguauguaaaaaaauauacaacugugauc

SEQ ID NO: 12923 - RNA, 15384 nt, Homo sapiens
agugugugcuaggggcuucagcagggaacuccacucaaggacgugguguaggaagcaaagacaaaccaacccaagugguacugaagaggacaagaugggaaggacauuuuuauuuucccuaaucuucaggcaaccucaccaagcuggaggucacauguagcugagugugaaaccaagaaaaauacgaagcuucaaaaguacugugcguuguauuucuucauucucuggcaggcugggaguccaaggucagucuaggcaggagggcugcuuggccuaagcagucacacaauuuucaccgucuugagcauaucugacaagacauacgugucaucccaaccccucccaggcuuccucaggguccgcuccaaagccugggcuguuucuaggagcucugguguggcaaguuuuugcucagggugcagcugacagaacaggaucucauucacuucacccucaauucgccggacauauaggagggggaacacugccuugagcccagccagcacugagucuuuuagccccaagucucggcacacaagguugagaauaaaaacaccuauaggguaggaagaaaagucagaaugaccucacaucaggagacauaugaaagacaaggaucggcuuugaggaaaauaccaauuccugucccagggagacugguggacuaaaacacacgguggugaugaguuugcagagaauacacagcauagaaaggcagauggagaaaagcauggggagcaugugagccauaaacaaacuccagccuuauuucuugcucuucugugcugcucacauguuauuuuaccauucuccaagccucaguuucccaaauagcuucucaaagaauagcuuugagaaagaagugauucccagcugggcacgguggcucaugucuaugaucccaucacuuugggaggcugaggcaggcggaucacucgaagucaggaguuugagaccagccuggccaaaauggugaaaccccggcucuacuaaaaauauaaaaauuagcugggcauggugguggacgccuguaaucccagcugcuagggaggcugaggcaggagcugcuaguggggcugaggcaggagaaucucuugaacccaggaggcagagguugcagugagccaaaauccagccugggugacggaaugagacuuugucucaaucaaucaauagaaagugauucccuacgaaaguaaaauuuaccaacuccacagggauauuacauucuuggcauacacaccauagaguauuaaccagugacagggccgagguuaucuugacuucugacaauuaagauuccaaaucaagccaguuaccacagugccuuacaccaaaucaaaaauaccuagaggguuguuaacauagggauuaaaggcuccaguuuugaggugacaaggcacugacuuugagccccaacuguuaccuugcgucaccuuggcaaaucuucaaccucaguuuccucauccaaaaaguggacugcuaugaagauuaaauaacacacugccuaguagagcacguguaggaagcaucauguaguagcuagcaucaccaugcuggugggagugugaacugcuacaaccacuuuguaaaacugugugguagcaucuacaaaagccaaaaacauacccauaaccuaugauccagcaauuacaacccuguguauauacccaagagaucugaaaacauaauucaucaaaaggcauauacuagaauguuaauggcagcaccacuuauaauagacccacacaggaaacaaaccaaauacgaacaguagaauggauaagcgaauuguguuaaguuacaugauauaacacagcaauaaaaauaagccauguaaacacaacacugugaaugagucucacaaacaucauguugagugaaagaaaauggacacuuaaagaguacauucagccaaguucaguggcucaugccuguaaucccagcacuuugggaggccaagguaggaggaucgcuugaggcuaggaguuugagaccagccugggcaacauguugagauccuaucucuacaaaaaauaaaaauaaaaaaauuagccaggcaugguggcauccaccuguagucccagcuacucaggugacugaggugggaggauuccuugagaccaggaguuugaggcuacagugagccaugaucaggccacugcacuccagccugggaaacaaagcaaaacccugucucaaaaaaaaaaaagggaacauuccaacauuccauaugauuccauuuauauaaagaacaagaacaggcaaaauuaagcuggguggacaaauguuaagacagugauuacucuugcgaggacaaguuacugaaaggggauaagagauacgacuuucuggcaagcuggaaauuuucugugucuagugcuaguaaauggguguauuaaauuuggaaaaauugaucgagcucgcacuucugugcauuuuucauuaaaaagauaauuuuuguuaauggucccuucucuccucccucucccaccuuuuguucuccauaccuucaggagucaagaugcuuuuaaccuucuguagaaaagauugcuccacaaaugcugggggcggacaacucauucccaguguuggguccuuacugucaacaucaaacauuaugacaucguagcaaggccgugcugggaaaaagaaggaaacaaguccuugucuuugcuggauaaaauaauaccauuuacauuccaacacuauaccuccucuuuaccaguggugggcauggugacuaaguuagaaggaugacacagaggaugugguuugccuguaagggcacugaugucauggcccaggggagucuuugucaucaggguucagagugucccauaguaaagauggaaccuucuuccacauuuaaaagcaccuuccaaaggcaaaaacauuacugggguccccuuugcaugaauauuucucgguuaagagucuaucaacaccaguggcuuuugacuguggcagaacauuacaaucaccuugggaagcuucuaauguguacuacacgccaaccaacagaauaaaauauccugggguaguagggggcagaugggaggagagaugggaagccucugguauuuuucuugagcuuuccagguaauucuaaauacagucagaguugagaaccacugaucuagacaaagcagcugacuaagccuuuaagggcugacccagcaaaugguaacuuuuaacucugaaaacagcacauuuugccucauaggagaaaauguucugaaauuucaguuaguguuaucuuugcaguuccaugaacaagagcugacucaagaaagaaaugauuuugcuaaaugggugagaaagaacugaugaagaaauggaucugcuccuuacuauaauguuaaauuguuuuuauaagggguaggucugcaaugccacugacagguuuuuagaaaauuuugagacuguggucauaauuauucaauaauuaauaaguauuuaauuaggacugcugcaugcuuaucauuguucauagcacagaucugauuuugguuucuuacaaagagaacauguuggcucaucaaaguccaaggaaaacaauagccugcauuugcagccuugagcccuccaguaaucugaaacauuuugguguuacagaagaugggcagagccauugaaaacugaucuauagauaacaacagcaguaacaucauggauuaaguacuuaccaugugcauggcacuguuguaaauacuucaccguauuagcuaucugggcuugggcaccuaaacuaacccuagccucagagagggaaccuacgaaacuguuacaauucaauucaguuugcaauuaaaauuaagauagcaucuguucaauacuugucccaggccuccuaguuugccacacccuuacuggaaaauauucuaaucuagugagaccagaguaucuguuauggaaugagcagaccagcaguccugaacagaacugaaccaaccuaacugccuucuccccgaaggacucgagcuccagaaaguacuaaacucaccagcagccuaucuguauaauagcagaguuacugucccuaguauuuuacagaaaauuauuaugcuuaugguuuuuguccuaaaucugggaugcaaauuacuagagcaaauggaaccuuaauucuaguugcagaaggccuaucaaaauucccacagaguaccaucugcaucaagguuucuccaccugagcacuguggaaauucugggccagauaauucugucaucagugcccguccugaacauuguaagauguuuacuagcauccuagaccucuaccguuuagaugucaguagcaacaucccccaccccgauuugugacaaugaaaaauugucuccauacauuaccaaaugucagacccugagguuguauaccacugaucuuacaugaauacuguuuugcucuauuucuggcuuuaccuccaguugaaauauuuacaaaaauaccucccaacacacauuccaccuuuucuucucuguuucuuugcccaguuagacuucagguuucuuaagauggugaggaaaugacaagguuacaggucagaaaaaagcccacuggucuguuagcaccauaagggcaggaauggccuguuuuacuuauugcuuuacauucacaccuaacacagugcuaagcauauagcugguacucuagugaauaaguauaucaacaaaugaacaggcugaagacuggaacgauacucaugccacucucuuagagauaaacuguagaggcccuugcgggccugacaaugucgcaucaaucaucccucaacaccccuucaaaugcuccaagagcaguaccuucuccuccuccugccaagcuggcgauauaguccaggccaucugcaauguggaccuucauucggucacucugggagaagccaaaccacuggguggccacuuccaacauggagggaucgaucuccacagcaucaaugcaggacuuuggaaaaugaucguggacaaagagggggaggcugcccccgcccaggccuaccaccaacaaugccagugggaucucuguaagaaaagaauagagcaucacauugccaccuguucacuggaaaauucuguaccagccucagggaaggcaaaagggaaagucagcucacugucuccauucaggggauacaagauuuagaggucucccugucucauuucagaaaucuaggagugaauuugacaucugauaacugaauccuggauucaugaugacuagauccagaagaugaacuaguguguuauuauuauugucucuuaaagaucucaaaguggccaggggcaguggcucacaccuguaaucccagcacuuugggaggccgaggugggcagauuacuugagcucaggaguucgagaccagccugggcaacauggcaaaauccugucuauagaaaguagaaaaauuaacugggcauggugacacacaccugugguaccagcuacacgguaagcugacgugggagccuaaggaggucaaggcugcaguaagcugcgaucauaccacugcacuccagccugggcaagaguaaaucccugucucaaaaaaaaagacuucuucacuauaagaauuauuagacccucucuaggaaagggaagaagaguggccaaacaaucuugcucaugauuacaaggcagcagaggugcaaugucccuugcccuugacucaaaaggccacaccgucuucucagacacccucaccaaguaaggguaagccauucaaguuccacaaaucacaggaaaacaaaggcccaacuccuacuccuaagcacagagcacagccaccacagggggaucaaaggaagacaacaaaagucacccgaaggagacagacccugagaauuaaaucuaagaacugagauucuagugacauacaucaacacuaagauaggacaaaaguauaggguauuccaagaaggcacauucagggacuucaggugaaaacgguuacaaucacagacaaaacaugaacaauuucacuaaugcagucagauccaaaccugcuauuagcgauaaggcuaugacugcauuaacuauaauaugaaucuuuucagaaaguagaaauucaagauagaauugcaucuuuuguucaaauaaugcauuacagaaaagcugaacaauuaaaaucuguguauuuuuacauaucucauugaauacaugauauaccuuaauuuuaaaaagaaaugaacagaaaaaauaccacuuagacucuaacauauuucaauacaauuucaauauaacagguugaguuugaggcaacaguuaauuagaaugcucauuaacuuauaacaugguugagaugaagaaagauacauugucagcuuguaauugcuguucuucaacuacaaugcaagugacaccaauuguuuaggucuguaaucuuuaugcucccuucuguggaaggcaguggcaucucucucaccuaggaguagcucuggguuucucagcagggcaaggccagcgaucauggcuuugugguguucacaacacagguaacucuuaucaauggacugccccggggcugcagggagguccuccgcaucagcaggccgcugcuucuuccuguccuuuuuccgcuucuucugggcuaaacaagagauaugaagcccuaugcuuaguacacuaguccucaggaagcaaggguuacuggcagcagugugcuccagauggcuugaacacucaaaagacccaaucguuaaaauuuugcaaacugguugacaucauguugauagcuugaaacuggccguagugaaaucaucuggauguuuguccccuacaaaucucacguugaaaugugauccccaaugucggagccaccaugcuggucacgggggcagaucccucaugaauggcugggugccuuccccaugguauugagugaguucucacucuagagcuguuguugaaaaaagccuggcaucucuuuugcucccucucuugcuaugugauguaccuggucucccuucaccuucugugauaauuguaagcuuccugaagccucaccaaaugcagaaguugguaccaugcuucuuguacagucugcagaaccauaagccaaaauaaaagucuuuucuuuacaaauuauccagucucagguauuccuuuauaagcaacguaaaacaaacaaauacaguggugguauuuauacuagagaacugauaaacacuauaaauuaggaugugcccccccuaccccgccccacaaagacauagucauuaaacauuuaacauauacaauggauacaaggaagcuggaaaaggaaauggcaaaugcacacucaaaaaccugggaaaacucaacugaggagcccugguaccucccgucuaagaaauguaaggccacuaacaggagaaaagauuacucauaaagucuuuuaaagaaagguaaaguuacuaaucaccugcuaugugccaauuacuauaccguaacuuuuauuuuuuuagcucuucuaacaaccuuaucauuccaauucuuggcacaugaacacacuaagccacugaaguguuaaguaaauagggaaucagcagaugguagagauaggaguugauccucggacugccugucuccaucaccuaucaucuuucugcuaugccacacagguagcacuaccaaccuuugcugaagaaggaaaucacaaguauucaaaaaaggaaauaaauccuaaaaagccacuccacuuucccucucaccacucccuucccugcuccaggguaucauacuaaacggauggcugugucuucauagggaucagcugcauuccccagcaguaaaaagugcugaugaguggagucggggugcuuuucagauauauuaaaucacuuuuuaauaugcucuccuucuugcucaccaauacucccaugagggagaacguucuuuccaugagaacaaagugcuaccaagaaaucaaggaacaugacaauggugaaaaaaccugaaacccaaacugaaaggggcaaaauguucuuuuaagcaauuuuacugagauuuuagugagaugaaacuggaccaaccugcagccacagugaccaaacaauagggcagaaacccaacaaucuugggugcucuuggccagggaaaaccccuaaagaaaaauaccauuucgcuggguaacuugauucuaggcucagagccagucuaugaccucaagcaucugaauucucugucuccacccuccucccagauggccuugcuaugagggcaggccagucaggcaaagggaacaacugggaaucaggagagccauuucagcuuccauccuugaaucucugcgccucagacagggaagaugcacuggagacggagaggugaggggcauucacuuuucgcggucuauauuugacuuuugaagugauuucaaugaacaaguaucacuuuuaaaauacaaacuaacacagguaaaacaaacuauugauuccccaucgggggaguuucugagugacagcugggagaccacuuaaagggauccuagaagagaugguuuagaucuacacuguccaauacuagccacuagcccccuauggcuguugaaauauaaauguaaauuaauuagaauuaaagaaaauuaaaauucaguuccucaguuacacuagccacauuccaaacgcucagcacuacauauggcuagucgcgaccacauuagaaacucaggaacuaaacaucuccuucaucacaggcaguuuuacugaacagugguauacuagaaggccucuaagucacccgccaauccaaaacccucugaaacaggugagucacacuauggagggcagggcucaccugcaacuuccauaguucuggcucaccucacagaggccuauugaaacaauacacagauguauauggagcaccugcaaaacagaugccuuuaaaccgaagacauuaaugugauuaucacuguauuugguuucacuacucacguccccuaucacuucagagccaggcucugcucaagaacagaauguacucugcuuauagcuauucacacccuaagaguccagaugguuaagaaccuacagacacccagguccauccuacaucucggccaagcucccaagaaaucuaguccaugccacggccacuugggucccaccacugugccuaugacaccucaccuuugugagacacauccuucagcaaccuggcuucggacugcaccacauuccuguugcugaggaagaucagucgacggaaguaucgcuugucauccccuugcacauccucaaugacauagucaccgcucaaggggcugcagucuuggugcugaacgguccggaccccaauguccccacccacagacagaaaggggaccugaagguacaaccagagauguggucaaaacagcagcucauuuaagaaauaagagaaauuauaaccccuucccuuuuguguguauauauccccauaccacgguucuagacaacaacuacuccacagauuugccauucuauuaaaguacuuuucuggagccuuugaacugaucucaaagguuuaauucaucuuuugaaaaucaacuggacacauaaagaucucccaaacaacuagugagaugcagcugauucuccccaaguucuuuuagggguuuuucucaucaguaaccccuaaaagaacucucaauaguccaggauaacaaaagcuagagggaacccucaggaaggggcugugauuaugagaaggaaucuacacaagaauaaagauaacaaaauccaugggagaaacaaccacuccaaaucuagagagauauuccuuuccccugauuauucucaucuauuuuucccccacuuuucugaaccuuaggagaaaaauauacuuucccccuaaacuuucccacuccuucccccuaucuuuauuucuuuuuuuaaagaccuauaagacuaguuaauaaucaccaauaucuccugacccugcagacucaggcacuggugagaggccacaaaugaagcuccucagaggaucugggcuuccuugaaauaggggucaucaaccccaaaguuggccaggaagaaucaaacuuacauucaucuguaaacacgagucagccuagugggcaaaaccacaggccaggaacccaggagccuggguucuuuuuuuucagaucuguuacuauuugcaccaagccucuagauaccuuugcuuucccaccuaucaagaaggaucaaagcuugggcaacauagggagacccugucucuacaaaaaauguaaaaaaaaaacuagccagguaugguggcuugcaccuauagucccagcuacuaccaaaggcugaggugggaggaugguuugaacccaggagguugaggcugaggcugcagugagccgugaucacaccacugaacuccaguccagccugggcaacagagcaagacccuaucucaaaaaagaaaaaaaaggaucaacuccucaucaugaaguucuuuuaguaaaaucacuuguucguuacccauggugaccaggauagcacaagacaguugguguuaacugauaauaccauaucaccacuuaggcaaaaaccuucgguuuccuucccaguaaaacaccugaccagcaaugugaauaccuggauaacugugcugagcuguuuuggcccucuuccauuuauacccucagauaaugauaguucuaagaagcaaaaugaccaagaaaguccaguguggaaggagaaauccacagucagagcaacucaaauuaggaagaacugaagcccgcaaugaguagagcauuuccauccugccaugucuauggacucugagaggcucccccagacacagacgcuacugugcucacuuuccucucauugccuggggcaaaggacaguuucccugccauuuaacccuuagcugcugauaccccuccaggauuagaugaagagucacagacucuaguccuagcuccugccaaggcucccucugccucccuggcugcuaacaugacuucagagacccaugaaagccguacgaaagcuuuguuaccugcugcugggugggcaucccagcuggggccagcuccaugacucuagccgacagcucagcuuggaugugguccaugcuuucauacugcugaccucggugaagggccacuguaaucaaccuccugaagccagcacuggccgccagcuguuuccggcccucauccaugccaaagagccacucggucucccggcccugagggacuagaaaaaagaacuugguuacagggaguccuggaaagugaucaagcccacaaccaauauggcccaaacggcagggagccagucccuguccaagaccagcaucuuccccaacugugacccacugaggagcuaacaauucucuaguucacaacaucuagggcaaagcagcccaucagacauaaggcaggaccaaggguggagaagaagugugggcauguccguaggggaaggaggcagacaccuaccacaagaaaaacagcaguaaugccaacacaaauaagccaugccaggcaugacuccaagcuguugacaaauauauauuaauggaauccuccaacaguccaagaugcagguaguaguauuauucccauuuuuacauaugaggaaacugagaaacagaaguuacacuauuugcccaacuucgcacaauaaguaaauggugaagcugggacucaaacccaggcagucuagccccagacucuacccacgcuuguauucacugcacuauuuauuuccacacauggacagacagaauuauagaauacuugaaaaacuagcucagucaccaggaaacaaauuaccguaacaccaagaccauaaacacuuugcauuugucuacaauguuccacuuuugaaagcacuuccuccuacuaucuuuuuuauccuuauuaagauaaaucugauauaacuuacugcuuucaguaauaauggcuaacauuuacacagcacuuccaaggccagguaccauuucuaagagcuuuuauacuucucacaacuacaccagaguuacaaucccaucaaggcagagaaagaaaaguaaccugucuaaugucacaccaucaggaaaugacugagccaaaacugaaacccaaacagucugguuccagagcucacuuuuuuagcugcuacccuaugcugccucuccaaauuuugcagagaagcacagcaacuuccccagguccugcagcucacaggcuacagcugggacuagaaccuaugucuuagacuugcuaguccagcauuacuuccauuacuccaugcuacaaaguaacuagcaucucuauaucauaugugaccuccuaaauuuaucucuauucucucucuucccuaccaaccccauucucacacuucaucaagccuuugcaauggcagaugaaaaggaauaggucucaacuccaaguagguugcuagagagcuauuacucuccuuucaucaugccuuggguagucuaauccucuggaaguacaaaccccugcaagacaaaaaacaguccagaaucccaccaaagccccagcccagccucagccccagccccagcccaagccccagccccuguaagccagccccuccagggaagagagggagcaaucccaacucacugaugaaaaucgcaaaaugauugucccgcgaugguuucacaguggggcuguccaccacguggaggguguagcguggcucccccguguccccaucgcacaaguccagagacacacuccccagccuggccuugcggcgcagcuggcugcacagccaggcauacugcugucgcuccugcaccgccucggccagccgcucggcacucuccagccgcacaggcuugcgcugcuccugagcacacagcucaaagaucugaagggcagagccagggacuggccugaacuuggucaugaugaaggcaaagacaggcaaggagaacugaggcucugcuuccaacaccugguccuggcuguuggccacuuggugcacccucaccauccaccccucccgggagaaguggcccacugcuuucuucaggaugugagccugagccagggagaugcagagauagcgaccgcccaccugcaggacacggccaaccucagccagcauccuguccaccuguuguaaggucuucucuuccucaucugucaggacagcauccagggugcccuuguccaacaccaccuggaacgaggcaucaggaaacuccaucugcgucauguccaucuucaagaagcucaucuggggccgucggguggcauuacauuccuucauuugcuugaugacaaccucacugaugucgauguucacuauaucccgauagcccacaucauacaguugcucacucaguucugaguugccacacccaaucaccagcaccuggagaaaaaauucacagacaagagggagguaaucaaagcaaaggacuguacuucagguacuucaaggaaucaagucucaccuuggcugagucacauuuucagaagguggagacgcuacugccagagaaagagcgacauuguagaguugaugcuagacucuaucuugaaacaccacauauacuugcuagugaaaaccacauucagcuacaauacagguuauaugagaaugggcuuuguguugcagaaacaaauuaaucauaacuguucuuuucucuaaaucaugcacuuauuacucaggaauuaauaggaagucagagaauccaaauauagaguuacaguugaaauccuaggccaggaauaacccuauuuccucacucuacucaugccuuuggcuccuuuagacaauaaaguacacuuugugaggauucaaaucuuacuuccaucacggauuccaucucaugauauuuggcuaucuucugaagccgaacuuaaaauucagauuguugucucccucuccagggagcaaucucccauucaaacuuagaaauucugauauugccaucuuuggaaaagcaugguacaaagagaugugcauaugcucuggagccagacaggccugaguuuaaauccccacaugaccaccuggacaugaucuugggcaaaaaaaaaaaaaaaaguggcucucggggccucaguuuccucaucuguaaaauguaugcauggccacucaccugaauuuaugaugagaauucaaagauugcacaugcacauacacagcacccaacauaaggcuuggcacauaaagcuuccccacaaauguuaaguuuucuaccuuccuccuucccuaccuccaguacaaucucaccuauaccaaacccauuguuguacuuaucacguuucacuucuggaacaugugcaggguuuacgucuuaaugcucuuauaguuuaaggacugagcagugccugaaacuuggggcgcacucaacgacuauuugaaaaacaaauucauacacaaagucacaccugcugcagguugcacaggaaugcacagugacagaagaacauacuuucaagaugggaagucacucuucaaguaggguuauuaauccaagaaugagcuggggugggaggucuauuaucugaaaaccuuuaaagaaauguuuuuuuuuuuagacagggucucacucugucacccaggcuggagugcaguggcgugaucauggcucacugcagccucgaccuccugggcucaagcgauccucccgccuaagccucccgaguagcuggaaauacagaugcgcgccaccacgcccggcuaauuuuuucauuuuuuguagagacgaggucucauguuccccaggcuggucuuuaacuccagggcucaagcgauccucccaccucggucucccaaaguguucggauuacaggugugagccacugcgcccggccugaaagaauauucuaguuugucuuuuagcaggaacaaugcaggaaaugcugaaauaugcguccaacuaggguccucccgccugucacuguccaccaagugcaagauuccuguuaccaguucccaccuuccggagcacguacgaagggcuaccaacccgcgcuccucaccuuuucccugggcuugauauauuuauguagcaccccgcacaguuccagguagguuccauaccacucgaaagcuuucuuuccucgcugcuggaagaacuucucccaauagucaacggagccaaacucccuggaacuuuuagguaagagguucauguuccuacugccgaagcugcguuuucaagacuccccuauucccugugagauaccauuugaggagcuugcccaccacacgcaggcuccgggacacugcagugggaauucuuuccacggaaaaacagccacauugauuuguucccccacuccaaaccccaggaaugacccuuacacgacaaacgcacgcauggaccacugaaucucacacacgcuugcccccuccuccgcgccugcuguuccuuccccacgugaagagccccucacacuuuucccgaacuagauuuccgagcccauaaccauauccgggugcgaag

SEQ ID NO: 12924 - RNA, 2606 nt, Homo sapiens
ccccuuccccuaccaggugggcucugugguucuucaagaaugaccgcagccgggccuggcaggacaaccugcaccuggucaccaagguggacacuguggaggacuucugggcgugagugucuguccccaguggggcuagaguuggggggcucugagcucugggcucccucucuccggguugagccagcccucccuagggccuuucagccuuugugagggcuggggcuuuguggguucugcccaggggguauagggcacaaccaccccccaccccaccaccuucuuugggcucagggagagagccuggggagcaggagaagcaggaagcugaccuugacucggccacuccagggcuuugugaccugggcaaguuccuuccccucucugaaccugucucagcugcaaagggaggacucggcugccucaguguccgggugcucacgggaguggcucugaaaagggcuacacaagcccuagggagggugagaaggccucggcuguagcuggaggggggagcaccagggggucuaaaacccuccccagggguuggcucagccuucacugggaaggcucuguggaaaaggugggucuugagaguuuggauaaacgggaguggaaucccagguggcaggccaguguaagcaaaggcuuggaggccauggggucggaugaggaguugggagggcugaacccaguuggaaccaggcccuaaaaagccuugacuuuuggcauggggucgggggcucuguccaggcuauacagucacauccagcuggccagcaagcucuccucuggcugugacuacgcccucuucaagguaagcucugcucuccucuuucccucccgcaaagggacaagggguugaucccucccggacuccacugcguuaaucccucagagggguggggguggggagcuacgggccaccucucagcagaguugugguuucugacuggaggaaaugcucuacaggagcccggacagaguaggucaggcccaagccgcaccuuggaggaccuuaagaggcgggaagagggagagggagagauuucugaccuggcuccuuaacuagggaagggcaucagaauugcuugaggacacucauugaugccacacccaucccuggagggcugacauuguguuuagagaucuccccagugacuucugcccugccugggaaccaugcagccaagccugggaugucccccuugccugcauuggggucugccccugaggcuuccuuaauccaccccgauuugaaugcuugucuuaaggaacucaguaaaagagacaugcacauauacaaggcuauacaaggugaccagugcugucugucggggggagcugaguggcuggggguggaaccugcuugcacugagggaagggaggauaagagaaucuggccuacuuagggccucagcagagagcggauaaggccgggaugguggguggguccccauuucccuuugaacacagggaggcaguugacuugccaucugccuugcaggauggcauccagcccaugugggaggacagcaggaauaaacgggguggccgcuggcuggucagccuggccaagcagcagcgccacauugagcuggaccggcuguggcuggagacggugaguuggaggaggaggguccucaggggaagagacgggcugugugggucucaugguggcaguggucucaaggauggcaggccagucccuaugucccagccggugaucucacaacccccuacuucggguccagcugcugugucugaucggggagagcuuugaggaacacagcagagagguauguggggccgucgucaacauccgcaccaagggggacaagaucgcuguguggacgagggaggcggaaaaccaggcgggcgugcugcacguugggugaggagggucucuggcacaggguggggacuugggucucugcuagagggaagguggguggagggggcuuggccugcaugggagaccucugaaagucuccauagccucccucccuucugccuugcccaccuguauggaaggucuggcguucagauuucuaacuuucucuuacggcagugcagcucuccuuuugcauuaagggggucauauuuuggguuuccacauggguaagacacaacagguguggcuguggccagaaugaggguaggagucugguggccuaaguuaucucuaggacccucugaugacuaccugugucucuuuuccucugugucccccgcaccugcaggcguguauacaaagagcgccugggccucuccccaaagaccaucauuggguaccaggcccaugcagacacagccaccaagagcaacucccuagccaagaacaaguuuguggugugaggggggccuuggcaccccuccuauguaaugggacagccgccacugagccucauuacuuugggggauggggcgggacuggggaucagacagccuaguucuuaccuguccucaagugaacaggaaugcaaacacucuuuaacaugaguuggggccugagccuuaggggcuagauggggguagugguggcagucugaggaccuagcuuguccuggggccacaggacagcagcaggguggaaaaaacuccug

SEQ ID NO: 12925 - RNA, 109705 nt, Homo sapiens
caaaguauuagugguauuuuaacaguuaauacaaccaaauagcacaugccugcugguuugcaaguggggguaaugcaagcuguauagcuggucacccauuaggucuuaaaauuuaggaggauuaaacuuaaaaacuagaauaugaaaaauacugacaauggcagugacuuaguaaggcaaguacuugauucccauucuuauccaucauaccucuucccccaauccccugcaauaaaccacagcuuuuaauuuagagcauauuuugagaaaaacccuagacugaaaacuuggaucaaggcagggccuauuaauacguaucagaccuggugcgguggcucacgccuguaaucccagaacuuugggaggcugaggcagguggauugcuugagcucaggaguucaagaccagccugggcaacauggagaaacccugucucuacccaacacaaaaccaucaaaacuugaguaucuuguguuuaacaaucgcaguauccaugaguuaagaaggcacaugcgucauuagugacuaaaugacuaguuuucucaaagcugggucuggaagccguauguucugaacaugggauuaaguaauuacaaucccucaguauuucauuucauaaauugaguaaaugauagaauaaaugcccuauagccuuuuagggcaggugauguucaugaacaugcuaacaaagcuaugaaaaauacaaacauaaauaauacugagaucuauuuuugguccuucagcuucugaccaaaagauggugaaacucuucuacaucuggcacugugcaucaagagaauuuuacuccuugacaucuccugcuucggccucacaaguagcugggacuacaggcaugcaccaccacgcacagcuuauuuucguauuuuuaguagagacagggcuucaccauguuggccaggcuggucucgaacuccugaccucaggugauccgcccaccucagccucccaaagugcugggauuauaggcaugagccaccacgcccggcugacagauuuguuuucaauaugaguuuggcuacuucagaacaggggccaugacuaucugccaugacaauaguuacuuuaguugaaugaucuccagaguucuucaaagugagaagucaaggcuuuggaugauaauccuuuucuagaguauaauguaauuuuuuuuuuuuuuuuuuaagacggaguuucacucuuuugcccaggcuggagugaaguggcuugauguuggcucauugcaaccucugacucccgccccagguucaagcaauucuccugccucagcuucccaaguagcugggauuauaggcaccugccaccaggccagcuaauuuuuguauuuuuaguagagacaggguuuugccaugcuggccaggcuggucucaaacuccugaccucaggugauccaccucccuuggccucccaaaguguuaggauuacaggcaugagccauugcucccggcuguauaauguacuuuuuuuuuguauuuuuaguagagaugggguuucaccauguugcccaggcuggucucguacuccugagcucaggcaauucacccgccucggccucccaaagugcuaggauuacaggcaugagccacugcgacuggccaguacucuugaccacuauuuuuaauacaugacaaacccucuugcuucagauuuuaggaaaugauuauaagcuccaagaaucauuauuuagagaauacuuuauuaguuucuguaaucaaacccauguagauaagaccuuacauauuuaauacagugcguuaccccuguacaaauggaaaaaaauuaaguuuaacguuucuagaccaauauggcuguuaauuucuguacaaugccaacucaacacaguaaaccgggauacuuuuuccaaaguugacagcacagcuaaaguuuccaaaaauucaaauuauauauauauauguauauauauauauauauuuauauaaaaagaccaauagcaguauguuaugcaucaauagcagcaacagcuuuuccagguucugcagucaucugaauaaaauuauagagacauccagcacacuccauuuaaaaaaaaggggggaaaaagguaaaaaacaaaaccccagaaaauugcaaaguucuguuacuguugugguaccuggcaccguuuuuuaaaauuagcuucugaaucaucaucuggaaagaaaacauucuagaauaacaucauuaaaaacagcucugauaaagcacggucacuacuacguaucauaaagcagguacaagauauuuuacauucacagagguaugauacaguacuguccuauaucuauaauacuagaggauacaauuaaaaaggcauuauuugagacuugauucuacuuuuccagcagagggcccaaaggauggcaugacacagcucuguaaagaaaugcaccuucuuaggauuuccuuuaauuaguggcacaguucuagguacucacuguucuucauaaacaccagcuaaaaacugguauaaaaaaaaaaagaaaaaaacccccaaaucaugggauucauacaaagaugacugagugggggcaaggaagacucaaccuaaccagcauuuuaccaaaucugucauguuugaaucgugagagcuccauggaagaaaggagaugcuaaguagcgcuucaaagcuucagaccacaaccaaaacacagcaccauuucaaauagaagcaguagccaaacacugcucacuuugauaugguucaaggaugcugacaucaauauuuaucugcucauucauccaggaagaaggggacaucaguuacuacuguacuuugauuguguucaacucaaucaccauguuauaaaaauagcaagcugccauaauaaaaaauaaggcuccucuauccagcaccaguuaucuucaguucuuuaccuccaagccuacaaaugccauaaccauauccgaagaacauaagggagcaaaaaaaccgcaucugauguaguagcugggaccaucacacuguucaggcugagcuauuccucugcuguguuauuuuccuuauauuuuugguguuucaucuaaucauaaggauuuuuaggucuaaauuauaugcacucaaaaaaaugggugcauacauuuauauauaaauucugacugaagaugcauggccaucaaccaagcacauguuauauaguagguacaagcuugcaaagccucguuuucacugguacagcagcugugugucaguguaaauugcuccuaugucccuuguacaucuccaagcucugaacaggauaaugucacaggccauuuugccccuuuggcugccagcauuaucugacuuaauucuccauguuuucccgccccccucccaauccccugcaauaaaccauagccuuuaagauuuuguuucuucgguuuugaucgccugagguuugauugguccaguucuaacagguuugguggcuauggagggugcaggggguggcuuuucuucuacuuuuuccugacagaccccaggagggucggucaguguuucaggagguuuacuugaaucacuguccacuuucugggcuuugccuccuccuaucuguuugcucuguugcuguucagagaagaaccguugcguggacugaagaaccucugcucucugcuuugccuuaaaaaaugagaaagaacaacugaaaauacugcagcauuaccaaagccugucaaaucaaucuugguucaaauucuuuuaccaaucacaaaucaguuuuccccacacugguuuggccaaagccaaaaguaccucauugaucuuugagcuuuuaaugaauagauuucuuccuauuuuugaaauauuucaugugauuuaaaaaaaaaaaaaaaaccacaggaccaccucccaccaccuuuucaaggucugcccucucauauuaaauuuuauuuagggaaccugcuugcaaaucuaaaaacauacauguaacacuuaaaacuucuaguuaucaauauguggucuacaauaaaaugaaaaggaagcacuuauauuguggcauuaccaacaccuaggaccaaaugucuuguggcugaguccucuucccacagcucucuucugcaggggaagagcaucagaaauuaguaacuacgacuucacuugaucacuaaguucugauagcuccuaccacauucugagcugguaaauaauuucuuaguuuugacuaugugcccccaaaaauauacuuacgucaaaucuguaaauuuuaccacuguaacauucacaauuaaaacuuaaguuuccauccuucuugcauauuaaaaaaaugcuuuauguucuauagguaaccuguacuauccaaagaucugaagcaauuuucaagaaguuuguacccucucccaccccauuacuacuauuaagcucuaauguuauuuccaacaugggaauaugcgaaaaucaagagccaaggagccaggaguagaacuggaauccaaggccaaauaacuuccuaagauuuuuacucacacugguauuucuaauuauaacaaacagauggaaauccuaggcauacagccuuaauaaaaguagauaauuauuuaauaaaaguuuugcugcuggguagucuuuaaauuugauuacucaggaucagaaacacuagggaugucgacccaaaaagacacuuuaaucaaucaaucaaauuuucuaauaggauuaucauaaacauguuucuaauucagaguaaagcauuacuaugcacauuucccuguuugaaagcaguaagcuuuucuuuguucuagucugaucugaugacauauguagugacaaaacaggcaaaaauuacuaagaucccugaaagucaagccuaaaguaaauauagaaauaaacggauucaacuggcuguacuggcagacauguaagguuuaugcuacaaaacuguccccacacagacuccuaaaggcacucuuucugcauuagcaaaccucauguuuaucagugccuuucaucaugaaggaucccaaagugcuuuucugaguucuucaucuauaacugcacaauccacuguggaauacaaccaccucaugugguaggccaauaaggguaugaaaacaguuugagaagaaaacuguacuuugaugacucauaauggaaaaaaguacuaagauaguaacacaucuuacccauuccagaguuuucauauaaccaugauuuacauuuuaagcugcugggaggaggagagucaggggaaaggggggaagaaaauauauauuaaaaaaaaaaaaaaaaagaaagaaaauggggaagucuauaauaauugauauuacuucuuugcuauuccaaaaaaaagugugcaucuaaacucagaucucccucaaauauuuauuugauaacaauucauuuggccacaguuuaagacauuaauucauuuccugacuacaguugcaaaaaaaaagaaaaagaaaaagaaacaaaaagaaaaaaaagaugaaaggaaugggaaugggggaaaaaaaagaaaaaaaagggggaaugaauaaaaguaguuagcuugguuaagucugcuaagacaaugaaugccuggauauacaguuauggguccagaggcauuuuaagacaugguucagagacagauucuugaucuguuggcuguuaacacuguacuaaccuucaugucuuguucagccuucaacgcagccugggccugauuaccucugacuccagauagugauccacaaggaccccuggcuacauguggcaaacgagcauggcucaugaggccuguggucagcggaggaggcaucugacuggccagugccauugguggccucugaacaggcgcugggaagguguuaguauguggggcucuuaccaauggagggaccagguuaggcugggagagaaucugagugaaaaaaacaaaacauacaacauugaacuguuaaaaaaaaaaaaaaaaaaaaaacugccaacuagaccagguuggcucaucccagaguaaaucugugcccauccuaccagugaaaggaaguguacagauugugccauuccauuaacaaggacaaggaauaaacaggccaugcuuggagaguuuaacagaaaaacuaggcaaagcaugcuauggcacuucaguugguccuagcaucucaguuguaaauucugaaggggggauagaaagacuuuuaauuaggcuaucuuuucaaaagguaguugcagaaaaggcacacaccuguaacaaauguaaucugaagauaaauaaaaucaauacuaauucaacaaaugugaauuucucaggaaccaguucuaguuugugagaguucuuaguccuuuuauacgaucagcaaggggaagagaagccaacauuuuuuacauauauuaaaacaucuuuuuggaaauuuuaucucaauugcacauaaauaucuuaacaacaacaaaaaacaacuuuaaaccuagaaaacuucaagcacugggacccuucgcugaaaagucaacuccuuaaaaaaaguuaaaaggaaaaggacucauuaucagagcuguguggggaaucuuuuaacuauuucucuugucugcuuuagaacuaaacaauuaccaugucuggcuauaaaucgcagacuaucuuuauaaaauaaauuuauuguuaaauucagaaacaauuuuuuauuaaaaacuguacuucuuaacugguuaacauaaggcaagauaauaauuuaucagauuagcaacuauuuuuaaguaaauaauacucauuucuuaauuaugucugcccaccuggggugcaaacuguguaggaaaugguugugucauucucacaguggcaggggcugacuggaacugcuucugguagacaaugcuguucauuuugcuggacuggcuguucggacuuguagaaguagcccuuggaaagaagccauuacuagucaguauaguaauaccaaguaaauaaugcuguuagauuuuugcaaacaccguucuugguauuuucaucauacuugguaguugguaaaaauuuacuaugaugauuaccaaaacauucugguagaagagagacauuggaggagcagagguaagaaaggauaccaguuaccaguuagauuggcugguucgagaccagcuuggacaauauuuuuuuaaaaauuagccaggugugguggcacguguauguagucccagcuacucaggaggcugaggcaggaggcuugcuugagcccagguguuugagguugcagugagcuauaaucauggcacugcacucuagucuggguaacagugugagacucugucucaaaaaaaauaaaagaaaaaaagguuugcucuguaacaaaagaauuuacuuaaaauauaguacaauaaacacauuuuaaauaauuuaaaagcuuaacauuuuagacaaaacuaucaaaaagaaugucuuaauaauuccuuuucugcuuggaaaagggauuaugucacacaggacugauaaguauuuaacaaauagugaccaaauuggaauuucauaagcaaauuuaaaugcccauuuuaccggaagggacuagauguugguguggugcuucuaccagcgauuggaggugugccugguuuuauaucaaugccacuuccaaaggcuuuuaguuccauuucagacaucugaggagaagcauaaaauaaacuuaacauuucuuuaauuccacaagcuaagugcuguguuuacauguccuauacgugaagacguaaucuaggaaagggcaaagaaccuuaguacaaaacuccuauaguuaggcuucaaguauuauggaauuaccugaccaaacagacuuauaauuaaauaagcccaagagacacuauaaauccaauucuuccaauaaauuugugaauucuuuguuauuagguaaaaacuagauggggccaaacacauuaaaaguaaauagauaaaauguaaauauacugggguuugagauuuuugcagggugguaaaaacugacgcauuuuaguuuuuuagauaacacagaugcauauaucugaacacacuaccuuaaauucucaaauaaccugugcaaaugucucuuuacuuacuuuuccugugguugcaaucaugcuaugcuguguuccagcaggaauuaauccucugaaaggcuggcuuacuugugcaggacgacucagacucugagccugugcuuggggagugguaugcuguaaugggggcugaagagucugaggcaaagcaauuagagguugcccuguagauccaaaauuaggcaaggaaagcugcgaugcugguaaagguacuguaaccuagaaaauaaguaaagagaaacugaagcaauuuguuucuguuuacuacagacauauccauacaacuauacacaacucuucaaauacuuuugaguaagauuucaaacagaacacaucggccaggugcaguggcucaugccuguaaucccagcacuuuggaaggccaaggcgggcagaucacgaggucaagagaucgagaccauccuggccaacauggugaaacccugucucuacuaaaaaaaaaaaauacgaaaauuagcugcaugugguggcaugugccuguagucucagcuacuugggaggcugaggcaugagaaucacuuggacccaggagggggagguugcagugagccgagauccugccacugcacuccagccuggcgacagagcgagacucugucucaaaauaaaauaaaauaaaauaaaauaaaauaaaauaaaauaaaauaaaauaaaauacauagaacacauccaucuacuaauauauuucacauauuucuuuugcuuagugaugacaaguugaguaucucuaaucugaaaaucaaaauccaaaaugcuccaaaacuuucugagaggcugauaugacaccacaaguagagaauuugacaccaaguccaggcacgguggcucacgccuauaaucccagcacuuugggaggccaagguaggcagaucacuugaggucagggguuugagaccagccuggccaacauggggaaacuccgucucuacuaaaaaaaaaaauaaauaaauaaauaaaauaaaauacaaaaauuagccaggcaugguggugggugccuguaaucucagcuacuugggaggcugaggcacgagaaucacuugaaccugggagguggagguugcagugagccaagaucaugccacugcacuccagccugggugagggagacuccgucucaaaaaaaaaaaaaaaaaaaaaucaacaccugaccuccugcgacggaucagucgaagugaggucagaacuucuguuucaugcacaaaguuauuuaaaauguugcuuaaaauuaccuucagguuauauguauaaaguauguaugaaacaaaggaauuucauguuuagacaggccccucgccccaagacaccucauuauguauacgcaaacacacaaaaaaaaaccaaucugaaauccgagacauuucuggucccaagcauuucgguaagagacacucaacccucaaccguaucuccauucuucuauuaaagguacaacauaguuuaguuaaugcuacuuguagugaagagaauagaaacugaaagaauuaggacuaucuuugaauuuauccacaggacaugucaaauaaucacaaaguaaaugaggacacaauauaagcaguauucacaaguuuccaaacagacauuuuacauaauacuuucaaggcuggucaaaaugagcuaugagaagaacaagaaucucucaguuuucacauaaacacuauauuuaaucugaaugucaauaagauauucaugaauuaucacucccuaaaauagcaaacaacaacaguuauaagaaaaugacuaaugacuuuguucccccaccagcccuccaccacuuuuaaagaauaagcuaaugaaauuauuagagauaguuuuaaacguaccauauacuuuucacugaaaauuauuauugcauucauacacuuaagaaaguguuugucauuuaugcucgaucacagucugccacacuguuguauguauagcuaaccugccagauggucuuugggaggcuucucccuagcacuaauggguaaaccaccuguaucacacuuaauguaacuauauucuggacaaugguuuucaagguuuuauauucauugaauccuuuguuaaaauagaauaaauaauuacacggaaaccuaaguuguuuuuucccccuuaauuaaaaaaaaacaaaaaacaaaaagcagccaggugugguggcucaagccuguaaucccaacacuuuggaaggccgaggcaggcagaucgcuugaaaccaguaguucaagaucagccuggggcaacauggcaaaacccugucucuacaaaaacuacgaagaaaaauuagccaggcauaauggcgugagccuguagucccagcuacacaggaggcugcggugcaaggaucacuugagccugggagguugggcugcaaugagccaugaucacaccacugcacucuggccuaggugacagaaaaaaacaaaacaaaacccccuaaaccaacaaaaaaccuggaagauauaaaaaaacaggaaugacugaaguagggggugaugguggugagaaggggggugucaugagccugaaaccccuucuacguggacccaguggaauucuucaggacaucucagugaacaguuuaaaaaccauccuccaucuugcaucuugguucaauuuaaauucccaaacaauaacaaaagcaauaaaaauaauaauaaagaaaauugaggaaauuuaccaugccauaguuuaccugcuggagagcacuuggugacugggcaguguuauaaaaauuugucugaccaggcuguuguacuuguccagaauaaagauuugaggccuggguaagauuugcucuggccuagaaaaaauuuuuuaagaaaacaugaguaagacugaaaaaaauuucaaauucagagguggagauuaugacuucaaagcaaugucuagcaauuuuuaguauuagauaaaugaaaggacuuuguuuuuuucauugcaucuucuaacauguuuucuuuuaaaaauguuuccuuaaaaugaucuguggcauaggaauacaaugagggugcauugcucuaguccccugacuuaccuggagaagaugugugucaaucagcugggaaccuccuaguccugaugccugccccaguugauguucauacaauauaggaaugggcugaguauuugauguuugcugaaaggcaagaccggauugugccuuggcaaguucuugguguuggacaguuggaaaguugugaauagcaguaccagaaaggaccacagauggcugggauaaacugcuuugcauaaaagcuggcugagaucuacauaaggauuaaagagaaaauauuguuagaaguuaauuucaucuggaaucugaaaaucuuaagaaugcaaaucccaaaugacccaauacagucaugugcugcaugacauuuuagucaacaacagaccacauauauauugauggucccauaagaucauaaggaagcugaaaaauuccuaucaccuagugacaucauagcuguucuaauaucauagaacauaugacucaaguguuuuugcuggugcuaguauuaaauauaaacaaaccuacuacaccuacaguccuaacaguucaguacauacaguuacauacaguacauaauaucugauacugauaaaaagaauuauguuacuaguuuauguauuuacuauacauuuucugguuauuuuagaguguacucuuuuuacuuaaaacuuauaaaacagcuucagguagauccuuuagcggguauuccagaagaaggcauuguuaucauaggacaugacagcucuguauguguuacugccccugaagaccucccagugggacaggauguggagguagaugaaaguauauugaugauccuagcccugcguagccuagccuaauguguguguuugcaucuuaguuuuuaacaaaaaaguuuaaaaaguuaaaaaaaaauuaaaaaauuaaaaaacagaaaaacguuacaaaagaaaaggccagacaugguguucaugcucauaaucccagcacuuugggaggcugaggugaaagggcugcuugaggccaggaauuugagaccagccugggcaagagaacaagacaucaucucuacaaaaaaauaaaaaauuaggugggcaugguagcaagugccuguaguccuagcuacuugggaagcugaggcuggacaauggcuugagcucaggaguucgagguagugagcuguaugugccacugcacuccagccugggugacacagaccuugucucaaaaaaacaaacaaaaaaagaaauacuucugugcagauguacaauguguuuguguuguaagcuaaauguuauuauaagagucaaaaaauuauaguaaguugagguuaauuuauuauugaagaaaaauuuguuuuuuuuuuuuuaacaaauuuaguguacccacaguguaguauagaguccacaguaguguacaguaauaucacucgccacucacucacugacucaccuacagcaacugccaguccugcaagcuccauucaugguaagugcucuauacaugguacguaccauuuuuaaucuuguaugcuauauuuuuauuguaccuuuucuguuuagauuguuuagauuucuauguuuagacacaaauauuuaccacuguguuacaacugccuacaguauuaaguacaguaaaaugcugcacggguuuauagccuaauuagacacaauaggcuguacucuacagccuagguguauagcugcaggcuaugccaccuagguuccuguagguacacucuaugauguuugaaaaaggaugcauacuucagaaugucuccccaucacugauacuuggaugcacucuaauuagcucagaaaucaagaaaagaggcagagaauacagacugugucuaaagcaacuuauuucaagauuuaaagcccuguauacaaggaagcuucacauguaaaaguucugugaaaaggccuguucucccuaagaaguggauugcucuuuccuuuugaacagugagaauaauucucuuuuuguguucacuacaaaguucagaacaaaaucucuuuuucucuuuggcaacauucuaauucauagccccaauagccccaacuuuucuuauuuguauuucauuacuuccccacauauauuuuuaauauaaauggccuagccucaagaucuccauggaauaaagcacaguaguagcucaugucagaguuacccaugaagauuaagcaagcaaacaaacaaacaagaacauaaaccaaaaccaaaccaagccaaaacacacccccucaaaacaaaaccacaauaugccagaaucuaaccccagacuucccuaucaucugagauggaugccuccagucuacacuuuuaagaugcagagauaaagaauaagcaccuaaaucaaaaguaguggguuaaagaacauuaugcuuuguugcuuuguuaaaacugaccuauguggcaggaacaaaagccacuaaggaagaaugcuagucuaggaucauagcagucuuuacaauaccuacuuauaauuuauguuucaaacacgagguaagaaaacaugaauauacugcuauaaacuauccugucuuugcagaaaccaguucagagauucccuaauaaacacuaugcugauuagguuaaggaacaagcaaggaauguuuagggauaaaauaacugcuuucaaaaucuaaaccuguacuuuccaaugugguagccaagugccacaauuauauaugugucuuacauuuuauuucuauugaccacgucuggucuuaaaaaguauaucuuccaagacaauuagugaaauggggauuacaaauauaguacauugcuacuccaccucccacggccuguggaaaacauuacuaauuaaucacuguacucuuuuucacaguacugaaaagcgguugcaaacuuuucaacaguguuucaagcagccaauacaauuuaaaaggagacuggcuugugagauuaaaucuagcugcuauuccugugucagaaauuuucaaguuuuauuuuuaauauaaauuccaagauaaucccaaauucaauacaagacuuccuuuagcuucuaguuggggcuucuaacgggagaaaauaacgaaauuaaaugagaguaaaaugaggagggaagaccuacaacagcuauauaaguaaugauacaggugucuuaaauuuuacuaaagcaucuuuaaucaaaagguaaaaauaaaagccacauuuaugagguuuacuaaugacuaggcucucuguuaagaaaguuucauuagcugaaccuggcuucucuaggaguaucauuaugguaauauaaaacauacuguauuaacugaugacagguuuaaucuauaaaguauagaaauucuaucugaacccacuucugaaaacaaauuccuaaaaacaaaugcacagccuuccuaaacuaaguguccugaauguaacuuauuuuucuuuaugaugauuuaaggccaccaucaugaguauggaugacagcuaugccaugaugcacugcuccuacuaucugacucuuacucacucuucuucccucauuaaacuggaaaccagagacacugagggucugccacuuuauguauaaccucagguuaaaacaaaacaaaacaaaaaaagccucacccucuucaaguccuaacauccacauguuaaaugagggugacuuaucuuaggugguugugugaagacuaaauuuaguuaauguaugugaaaggcugaauaucuaucauauauaaggaaaguucaauaaaaaucaguuuucauuauuucccuaguugcaaagguaacuuacagugcaucugagugaauuuuuggaaaaaaugcuuucuucacuacacagcauauuuaucaucauuacuuccaugcuuugauauuuaccccucucuguucuguuauauuccacccugcccugcacccccuaacaugauguaguuaacugccaugccucagcucguacauagaggagauucagauuuauaguuuuugguagccagauggcacacauacuuuuagguucuuuagcagcuacuuucuauaauuucuaacaguuuugggguugcuguuguucacuacuucaagaggguuugaaaccugacauucuuuaauaagauaugguugaaauuaccagaggcugagguucaugacauauaaucaacaugcucaauuagccaauguaguuuauagcagagucauccuagguuuuuuugggaaggaacaguauggauuacggcaaggaggaucagcaguuacaauguuuucaacaucauuacaaacauaacuuuuaaagcauuuaccuauaugguugaagugaggagcugaacaauuccugagccugggaaacagcagggccagcccccaaacucaguugggcuugaugcugcccuugcaguggugcauaaauagggauuggaaucugcugaacugaaguuggcugcaaugcauugagaaaguauguaaacauauauaucaacaucauacagauaaaucauuaacacuggaauauaaaaauuugagacaugaaaagaguaaaauuaauacuauauaucagcuccauuuuaaaacaaaacugaauguaaacaucuaaauuucccuuucaacccacuacuuauucuacauuauuacuauuaagcuuugguaaauuugggaaaaauuuuaaauuuugcuuauagaauaucaagcuaaucguggguagcuuguaauuucagagucuauuauuuauguuccaagauaacuauuauaaccacagaaaugcgaaggaacaaauacaggauggaagaagucuuugauauuaccugagagagaccugguuggaaacccuguuguugagccaaggauggcggagccaaucgugcauguuggguauugaauaaaugacuuguguccauauagaaggcugggauuugagcuguagaccaucaggauaaacaagcaguaguaaguguccuaauuucagaauuuuccaaacaguaaauaaaaaccaaguuuuguagcagauuccaaauuaagugcacccucugaaaauacagccauggaaaaacuaaaaacgugacaagaugcaaaugugaaaagauggaaaacuucuaguagacagguacacacaaacauaacuaguacuugugaaggcaugaaaaaaaaauuuauauaccgccaaugggguauagauacgcagauuuugucagugguaaaauuucacauaaucuacuaaaauugaaaaugaaucuacccauugaaccagcaauucuacuccaauuuuaaaccuaccuacuagaaucuagcaaaauauuuagaggauugacauuuaauuuuaaaaguuugguauaaauuuuaaacacauuucuauguaugauacauaauauuuggugacuugcuguuuuuuuuuguuuuuguuuuuuguuuugaaacagucucgcuuugucacccaggcugaagugcaguggcacgauugaucccagcucacugcaaccuccaccucccggguucaagcgauucuugugccucagcuaccugagcagcugagugugcgccaccacgcccaaccaauuuuuguauuuuuaguagagacgugguuucaccauguuggccaggugggucuugaacugcuggccucaacugaucugcccgccucagccucccaaagugcugggauuacaggcgugagccacggugccuagcugacucgcuguuuuuauauaguaguauguucugcagaacuccacauauuauuacgacgagacagggccucacuccgccaggcuggagugcaguggcaugauuaucaccuggguucaaaugauucucucaccucagccucccaaguagcuggaacuagaggcaugugccaccacauccagcuaauguuuaaaauuuuuuguagagaugggucucacuauguugcucggguuggucuugaacuccuagggucaaguaauccuucugccuuggccucucaaagugcugggauuauagguaugagccaccacacccagccuauauauuguuuuuaacuugucauuauuagaaauaauacugcaaugaauacccuuacuuaaucucuaauagcuuaaauguauccauaugagauuccuaguuaugaaacuguuacuacaguaaguauguacacuuauauuuuccaagacacuuuuaaaaagaauuaugccaauuuaggcugggugagguggcucaugccuauaauuccagcacuuugggaggcugaggcaggaggaucacuugagcucaggaguucgaggccagccugggcaacacgguaaaacccgucucuaccaaaaaugcaaaaaaaaaaaaaaaaaagaaaaauuagcugggugugguggugugcuccuguggccccagcuacuugggaggcugaggugagaggaucacuugaaccugggagguggagguggcaguaagccaagaccgcgucacugcaauccagccugggcaacagagccagacaccaucucaaaaaaaaaaaaaaaaaaaaaaaaugcgaauuuaaauauuuacagcaauguacuuuaagagccuuaugcuuagcugaaaggguaagaagagacaaaaauaagcauuuuaguaagucuucauuuucuaaauuccuuauauucaagccuaaaaacauuaccugcugcagacugagacacauaaacuugcggauucuguugcugcugggcaauaagggaaggcauacagcuuaacugugaaaaaugacuugcagaaggcaggcugcuugucuguaacugcugagguuucacuuuacaaauauuuggaggguccgaugugguuguagauuuugugcucaaagaagagguaguguauguaccagcuccuauauuuggggaagcaaauaaaggggaaaauagagcauauuuaaaaguguugcuauuguucacaguaccaaccagaaacugcaaaauuaauguuucuacccaucacguacuuauauacugcuucaggccaaaaguagaugagguagcuuauaaaagaaaagguaauuaucaccaaauguaaauaugacuagaaaauauggaacaauaaacaacagaaaaucaaaacaagaaagaaacaaaacacaaaauuaauaaaaugaggcugagagccuauguaacuguuauaguuuagccagaaaugauuuguuuuuuaaucaucacaaagaauaggauauauaaucaagagcuucauucacuuaugaccacagauauaaggacacaaaagagaaaagugcuauaccuuagaaauaauuaugaauauacaugggccuugaaagaucucaacugguccuaaaaugucacauaaacuuaaggcuggauuucucucuccugcaaaaacuggcacauguugaggccaggaguauaagaccagccuggggaacauuguaagauccugucucuacacaaaauuaaaaaauuaguugggcaugguggugccuguagucgcagcuacuugggaggcugagauggaaggauugcuugaacccaggaguuugaggcugcagugaacagugaugacaucgcugcacuccagccugagcgacagagcaagacaucaacucuuaaaaaacaaaaaaaaccacacaacuccaaaaacaacuaaccaagaaacaaacaaaaacaaaacaaaaccaccugguauauaguaauaccuuuaaaacaaauuaaauaaacuacuuaauaaguaaauagaauuauaaaacuuagguguuaggguuaauuuguuuuauugauuagugagcuauuaugacuuuaguacuagcccaaaaugucaauacugguauuugauuaaaaaguaauguauaaguugucauuaucuucagaugauguuccaccugagaguggaccaaaauucaagugcuucuauccuucuagugaaucaucuaccaguaggaugacuaggcaauaagggccuuguuaaaaaaauuauccuagucaagcacaguggaggaaaucuagaccuggggaaacggguuaguuggguuccaaagaaagaacuaggaaccauuauuuccagaucuuccuaccauacucuccuguuuccuuuacaccaccuucacuaacccccccaucccaaaguggacuggggcucaagcuagucuaguaaacauaagugaagaugccuuggcaaaugagugguggaggaaugcuaggaaggguuuuaaagugaaaagaaauauaguuggaacacaguuugauuuaaaauguuaaugcagcguagaaucucgggaguuuguguuaauauauacuucugauuacagacaauaucaaaauaacuuguauaaaccuaagaccagcuuuuugguaccuaaaaauagcacggugggcuggaauacuaaaaagcaauauugaaugagaaccagucaaacaaaguaauuuauaucacuggaaaggagcuuccuacugcuuuggaagcagauaauacugagaaagcuugaaauuaaauuuuauuuuuucaacagaagaaacuugguucuacauaugguaaaaggaaaaggguguacuuuucuagagucaagcauuuuggaaacaucuguguuucuuuaagaaccguaaggccuccaaauaaugagauaguucaaugaaaagauuacacacuaguaaaaauuuaagaaaaucuaaggaaaaagagcaagaaaagcaccuucuaacuuugggcaccaaaggacucuccuaaaaaacaaaauaaaacaaaauccaaaccaaacuaaagccaaauccaaugaauuacaucacucaaauagcagaggcugaaaauucuccaucccuaagucuuuaccagaaaauacguuaucccaacagguuuaggccaacagcaccuucaaauuagauacagauugucaaacauuuaaaagaggugugauucucuguucuuuuugagcugaucuaguuaguuguacauacauaaaaaaugacaaucaaaaggugaacuuccuagaaaaauuuagaggaaaaugacauuuuaaaaagcaauuacuggccacaugugguggcucaugccuguaaucccagcacuuugggaggcugaggugggaagauugaauauuacuauuuucggagggcuagagauaguaaacaagaagagaucauaaaaaauuuuaaauaauguaagauauuuaaagaaacagaacgaaaaaguucuaccugauagugaugcuguaggagugacugaagcaacaggaaucuggggcauggaugcacuugagaacgaauuguaauuagcagugcuugguccacuggcacuacugcugacuccaguugcaauuggaggugcuguggaaguuacuggagaccccuuuucccuuacauuuggagaauucucccaugcuuugcgugcagacuccaucugcaauaaaacggacauuuuauaguaaaaaaaugauguuaauacagaauauacguauguauauacauguaucaguauuuaagugccaaauauaaucuuucaaaaaccacacacacacaaagauauuuaaagaaaaucuaagacccuaagacccuagggauuucagacuuuccauuugccucuuuaucuuugcuccauuacucaaauugggagugugagaguguaucauuuaaacaugagcccuuaucccuaccagugaauaaggaaaggccuucccccaguaaauauccauucucuccauucuuucuuuuuacuccaaugcuucuuaaauggcaaauggcaggcaucuuuugguuggcugcuucaugcucacaguguuuuaaaaggcaagguaacaagauagguuuuaggcuugggugcaauagaaaugcuuuuguuucacauccagaucucaagcauuucauguaccaccagauguaaccauuugcauuuaugaccccugguuucagcuguauuuucuucuccuaguuucuuaaauggcagaaaauggccuuauuucaaucuagagcagcacuauucaguaguuuucaacagauacauaucuaaaugcaaaucaaauauguaauuuuaaauuuucuaguagcuacauuuuaaaaaguaaauacaaauagauuauauauuuauuuugaaaacauuuaauucaacccaauauuuauaauauuauaacuaaaacacuaaugaacauaaauugauauuuuauaaguuuuuuuaauauuaaaauuucauaugcaguauacauccaacauaaucuauaagauccagcugcaaugacuuaugagagaggaacuuuuucaaguaacauauuuaauaucacuguuaggaacuuugugaguccuuaaaguaucaauuucuaaaauuuuauuuugguuauaagaauuuugagaaauagaggccgggugcgguggcucaccccuguaaucccagcacuuugagaggcugaggcaggcggaucacgaggucagaaguucgagaccagucuggccaacauagugaaacccugucucuacuaaaaauacaaaaaaauuuagccgggcguggugugcgccuguaaauccagcuacucgggaggcugaggcaggagaauugcgugaacccgggaggcagagguugcagugagccgagauagcgccacugcacuccagccugggcgacagaacgaggcuccaacucaaaaaaaaaaaaaaaaaaaaaaagaauuuugagacauaguacauauuuuacccugccuuccuuuaaaaacacacuauucauaauuuaaccuuuucuuaagacuaauuguuaucauuagauauuuaaaauacagaacuuuuauauuugagaaaaaucugaaaucuuuucuuuuucucaaaaucacuugguugauuucaaauguguuuuauuuuaaaauagaagucuugggggaauuuaggaaguaagcuagaauauaauuuaccuguaccaucugagauuuugugguuuacggcaaguugacagaguacaaugucuuuuaugccaauuuuguuuuacugggaacauauaaauuaaguuauagcuaaucaaacuuacauaacauacaggccacaaguuugacuugauuccauuccuuaagcagaaagauaauuugaaguuuuuauuuucggaaauucagugaaacuaaaaguacaauuaguuaaucauacucauuuuuuucauauuuugucaaugauguccauaaaaacuuaaugucgucaauagguucuuggaaacugugacuaagcccaacaauguauaaucaauauuuuuucucauacacuuuagaacaaguggcacugaaccaaaugaugcuauucuauggauccaucauacaguuuugcuuaaaguugcaguuuucaugaacccacugauaauaaguaagaauuuacuguguaauauaacuuuucuaugcuuuauguauuacuccaacaaaaaggagauggcagaggaaguaaaaauaaagaaaucagagguuuuaagcuaauguaauuugacuuaaauuuaauucucaauguguauauuucuucuuggaauguuaaaaacaugagugaaaggcaaaguugaauagguauucuaaagaaauaaauacuggcuuaaaaauaauuaaagaugacauuauauuugcuuaugugaaauuagauuauuuaccuugcuaguauaaugauaaaaaccauaaaaguaagacuaaguaaggaacacagauuaagacagucauucaagccaaaagacaacagaaaaggcugaacaggaauuggcaguaaagacuaggcaaagacagggauggcacaaagcagaagcuguugucuuauaaaauuuuaugaucucaaacuuauauuuguuaagccucuuacaaagaaguugggcagacaggggaaaagauaaggggacaaaaguaauaugaguccaaaaugaauauuggccacacuguagaacaacaaaguuccugugaccccaacugaagaucaucaaagagauugucaaccagugcaacaucaggaagcccuacuauauuagagauuaagaacuucccuggauuaugaacaaagaacaucaaugagauaaauagacuuaaaaaaaaucuucccuuggccagguguggugguucccaccuguaauuccaauacuuugggaggcugaggcagguggaucgcuggagcccagaguucaaaaccaaccugggcaacauggcaaaaccccaucucuauuuaaaaaaaauuuuuuuuuaaauuaaaaaaaaccuccuuuaauuccauguuugcacuuuuuuaaacuacugacuacuccaaagacgaacugauuuaaaauacucucaaacaacacaacuguaaaaaaucauuaacauagcucaaaauuauaauagauuaaaaaaaaaggccaaaacauuuugacaucaaaaagcgcugaaucucuuuuguccucuuauuaaauaauuauccaaaaaaaaucaacugaaaaucuucugacaucaucuauaaagcauacuugucaauuaucuucccauaaaauaaucauacaguguucauucaauucacacauaacuuacagggaagacaaacaacauucuuacuauuaucaguacuuaauauuuugguaacaaucauaaaaacaugaaauaauuaagauuuuauuuuuuguauacaaacccauauauccaaaaauuauuaagaucucugggaggaacuuaacacaaacauggaaaaauacucuccuguauuuuuaagacaaaauucacaagcauaauaggccucacuuuaaauaugaggauaucacgucaccacuuagugguaucagaagcuaauaaaacuguaagguauaauuugacagcacucuauuuccucagcuuaguauuguugcuuaccacauaaaucuaguaaaaauaccccacgaauauuguuaacuuauguccccuugcaugcaacaauuaaggacucuuagagauggauguuguacauaccuugaaggugaggcugaaaguagugggaggaacugaaguuaggcuggagcucuguuguauagucucccucuuagggaggggaaggguguugggcaggggcaccugaaaagguaggcaacacauaucacaaucuaacuaugugucuacuacgaaagccccauuaaagacaaugcuaagguguucuaaggguaguguuuauuuuucaucagagcuaacagaaauaugugauuacuuaagagucacauuguguuuauaguaguugguaauuaaggauaccucagauaaaacuucugaagggaaauuauuaucugccuuuuuauacguuaaguuggcagaaagagagucugcaccagauauaagguguauacucagaaggcagugcuucucauauuuuaauauguacauaaaucaccugaggaugcugauaaaaagcagauuuugauucaauuggucuauguuaaggccugaaaugcuggguuucaaacaaguugccaggugaugcugauggugcuggucuacaggcugcauacuguguagcaaagcucuaaggaauaaaaccuucaccauauaucuacagguuccaccagaaguauuuaacaugacagcaaaaauauaaaaaauuaaucucuuuccugcaauaugguuaacuuuuauaacaagauucaagaacaaaaguaaucuugggaagaaaguauggacuguuagcaccaucucauuacaauaaaacuguucugcuauaguaauaauuauggcaaauauuguuagaaacuuuaagauauuagaaacucacugccuuuaucucuggaucuugggacuuuauuauguauuacguuuuggaugguucguucaguuguucaggaaaaauaacugggaugcuugagaguuuuaagauaaucacuuugugauacuauggacuaccuaauggagauucuuucauacauguugaaagcagcugugcuaugauaauccaaaaggccaccugcauuuaaucuucaagacauucaagauacaagaugauuguacuacugaguaauacuaaccaacauguaucaguuaagaccauaaaaaaguguauuaagccccaauaagagaaauaagccauuuucaaguauaauuaagaaagacaaaaguucuaugugcaaaauggaacccccaaacagacaagugaaagaaaaaaggacaucucaagagguccuaaauuuuuucccaugaaggacauucguuuuuaacucuacauugaguucagaaucaccaacacacuuggcacaaguaagcaacaccaugaaauccuuucaaacugaugaccauuuauaaugcucccuaacccaaacugaucuuucugcuuucaaacauacccuggcuacacugcuaacaacugcaugcagacuauucaccuauauaugaggcugggucuguugucuccaguaguuaccaguauauaagucgcuccauuaauuagccuuacagaucacacagaaaccaucaaaaugcucaucuggauauuuucaaugaauuuuaaggguucugagaauaauaauuuuuucuuccuuauuuuauauauuuuauaaaucauauuuucagaggguaguuucgcaaaaagcaucauauacuuuaaaaaccacuaucguagaaauauucuguauuuuuuaaaaaugagaaaagacacaaaguauaauuaaacuuuauugagaucuuacugauugaauauuucauaaucuagacagugauaucacagcacuuaaacugaaaggaagucuuuuccuccuucccaagucuuccauuauuuuucacaggagguauaaggaguuaaaaaaagaaaaaaaaaaccauauauauauauauauauuuaaaccacuuucauaaaaguggggggugggugggaggaaaguugaacaaaucacauuaaucagcuccuagagagcucucaacaccaagaaaaaauaugugacucacuccuuucuauuccuuuucucagcuacauauuuaguacaguccuucagcugaacuacaaaaauuggauuaagugaccccuaaugcagcucaccuuucuaaaauuccauauacuugaugcuagagggaagaauagaaagcauagaaaaaaaguaagaagauaauaaagauuuuuauaacucaaaaugauaguuaaagcucuuugugacagaccuuuaaauauuuaucuguaaaggauuuuuuuaaaaaaaggaugaucaacauuuuagucugauagccuuuacuuauuacagaaggcuauauuuaaaacagagagcacuaaccaaauuuccaucauaccucucuccaaaauaaggaccaugcaaguaacuuuuaaaauguucuucuaaauaaaugacacuguauaacuauggcaagcuaccuaauguuucugggcuaacaauuuuucaucuaucagacagugagcuaagcaaaaugaugaacuguacagacuuuuaacacaaccuugaauuauauuaguaacaugguugcucuggaaaacuagguccuaaguuacaacaugacuuaacaucaccuuauauuagagcauaucagaguguuuggcguacuuauguauacaauacaauauagcucaaucuacacaacaagaauguuguuaacacgcugguauuuuuucuuuuuuaaagacauacuugauucuuugggaauucuauaguugucuuuuaauucuaauuuuaguuaucuuaaauaaguuggguuucacugaauuauaaaaagguuuuauguaagaacaaaaucaccaaccguucauguuaaauuuguaaaugugagagcuaaaacaacuucuuaccaauaccagguuaauaagauuaguauuuacacgaaaccaagccuacgcaccacaaaccuucaucuuaaauggaaagcagauggcuuucagaggaaaaauaaaaaacucagcuuugacuauuuuugcuaauuauauuacaguacuccuaaacacaaauuuacuaucaacucuuucccugaguuaaauauugaucacuacaguaaauaaaacaugaaauaaugugcuugauaauaauagccagguuccaauccaaacuugccacaucucaaacugauuacuuacauuauuaaccaaaguauccuccaucuuuguauuauuaguagccacgguguuaggcaaagaagaagaggguguaguauagucuguuacagacuccugugaaguaguaauagaaaaaaaauacauuuuaaacugaauuaauugcucacuucuuccucuuuuuuuugagucucgcuaucaugcaggcuggagugcaguggcaugaucucagcucacugcaaccucugccuuccaggcucaagugauucuugugccugagucacugaaguagcugggauuacaggcgugcgccaccaugacauuaauuuuuguauuuuuaguagagaugggguuucaccauguuggccaggcuggucucgaacuccuggccuuaagugaucugccugccucagcccaccaaagugcugagauuacuggcaugagccaccacgccuggccaaauugcucacuuucuaaugauagccuaauaguuguaaaguuguucuggaagaaagcaggggaagagagcagacuuuaagacucaacucacucaaucaacuaacaauggaauaauacaacauggacucacgaucaaaaugauagcauuucaacuacuacugcauucuuguacauuuaguacuaggagacugucaacaguaccaaauauuuauuucuguagguuauuaaaagaaucuuuuguguguuucccacauucauucuuagcuuacuaucaauuaccaagaucuuaguuguugcaauuacucagguuuuaggguacacuccuuguuuccugucacaaaucucauuuugaaauauggcagaguaggaccacauaagcuauuacuuauaugaauucagcuguauggcaauuaaaaagagacuaauauucagauaauauaaaaaauugcauguaacuuuuucucagaguuuaugucccagagucaauauaaaaucgcagauauguuugcuauucccaugagugucuguucccauggucaaucaacauaucuugucuuaaugagcauuuuuagauacacguuucauucaauguggccccuaaaugugagucaacagccuccaguguucaaccaaagaaacaguaaucuguuccaacuaugaaaaaaaacuggcuauacuggaguuaguaaaagucugccuuauuuccugacuuuagaaugucaccagugggcaagauaaagcucuacuguaauucuauuuauauuaaaagugauauagagccaucuuucaaaguauucagauuuuguauagauguuuuucacuuuaagcuacucaaauaguccagaauucagaguaaauuuccucaaaaagaaauauaauuugcuauaaagaacuucuuuagauuacauaugcaaaucaugaaacaaaaucuucuuugcggaaauaaucuauagaguuauaugccucagcaggaaaaaaaaaagcagacuguugcuguucuucucguucauuuuagacauggcuugcaucuguugaacugguaaucccuacauguggcuuaccuuugcauuaguaccauauucugcagaugauaccgagaucauuguuccuauuucaguagacauuucugagacugcuuuagucuccuuugucgugacaggaucugugcuucugacuguagcugggcuugguuucucuuguccuucuggcuccaccuguugggcaucuuuuacuuuucuauuuuuuaaugaacguuccuuuccaaugggaccagguuuguguucuuuguuuucuacuggacucaaaucuggaagcuaaagucaaauguuuaugauaaaacuauguuuaugauagaugaguaucuuucaucauugcaccaugaucaaagauauucauuaaaauuaaguucacuuuuaaaaguauuauuugcucuucaugucaguggccuucauaaaauuuuaucuggauuauaaaguauauuuaccuucugggcuuugauagguccugcucguggcugcuucugccgcuguucuuuagguucagguauuuugucagcagauuuuuccgaaagcacaggaacaacuucauuuucauuuccauuugaggcuggagcaccaaacugaauugugucaguuccaauuucgaguccacuuucuugaccauucuucgcucccuaguaaaagaauauuuuaaaacuugcuugcaaaguauaguucagaugugacugauuuaugaagcacuauacaguuuaaguacaauagaagguuuaagacaaucuacauauuaacugagaccgacauuaauuauauuuuaggauaauuuucucuuaacuguuguuugucuguacuagaaaacaacugauaagaugaaacuagcacaagacuuaaguuuuuaaaguccuggcucucaugagugugaucaugggcaaagcacagcuucaaguuguuuccucauuuaaaacaaacguaaaagcaacacacaaagacaccacuaccaacaaacagaugaauacacuggaaauaaaagacaguaauaagugucaccugcuucucagaagucugcuuugaaaaugaaauuuaagaaauauaauaaaaacuuugugauugguaacauagagcaaacaucuaagcaaucaauccaccaauuaaacaguuaauuugggccggguaugguggcucaugccuguaaucccagcacucugggaggccuaggugggcggaugaugaggucaggaguuugagaccagccugaccaacauggugaaacucugucucuacuaaaaauacaaaaacuagcagggcuugguggcaugugccuguaaucgcagcuacucaggaggcugaugcaggagaaucgcuugaacccgggagguggacguugcagugagccuagguugcgccacugcacuccagccugggugacaaagcgagaccugucucaaaaacaaacaaaccaacccagcuaauuuguugagcaucuucuuugugcuaaucagaugugcuaaucagucuaauugcacaauuugcauucuagcaggugaagcaaauaaagaacugaaaagucagauaaggaaucugcaaaagcaaaauaggguuaagagaccagcuacuagacugguagacagagaaagccccugaggaggacacacugacauugaaucuagaagacaagaucaguggaaagaguuuagggagaccacauaccuaggguaaaggucaagaacaaaaaaaggucagugaggcugaagcauagcagguauggggaacaguuguagaaacagacaagcagauuaggugaccuagggcuuuguuacaacaauuaaucuuuucaugaaaagacaaacauaaaaagcaaaacuagggucaaaauucaacuaaagcuuguuuuaauaauugaaucacuacuccaugucauuuuuggcauuccuaaaccuagcauggucaauuacuacauaagguuaauguuauaucuacccggauauaaugucaagaguaugaacaacgcaugcaauucagauuuacuuuuaauauuuaaauagucaccuucaaauacagucaugugccauauaauggugauguuuagccaaugauggaccacauauacaagggugguuccauaaaauuauaauaucguauuuuuacuguaccuuuucuaugcuuagaaacacaaauacuuaucauuguguuacaacugccuacgguauucaguguaguaauaagcuguauagguuuguagccuagaagccauaggcuauaccaucuagguuuguguaaguagacucuaugauguucacacaaugacccauuucucaggacguaucucuguuguuaagcaaagcaugaauguauuggaaaauacugaugcacauuagaauaaaaauuucuuugcuuuagucaauguugaaauucuacagucaguuaaauguaaguguacaguaguauuagaaaagaaaauaaugcaguaaguagacugugaaggcuauuaacuguauauacaaaaauguuaagaacuuguacauauuuaaaugaguagaaaaauaacugucaaguuaaugacuguuagagaauguuauauccuuugaaaugaaaguguuuaugaaauauacauaacacaaagaaugauaaaagcuuagacaauauuauaauaucaagucuuuguaaggcuaguugguguaacuaacguugauaacuuuaaguaaaauaaucauuaagaguucuauuucacuagaauaaucuaagaaaaaguccauuagggaauucuuuccauccuaugaaaugucaacuuugcuaauacaaaauuucuucaugaggaaaaacuccaaaauaauguaugacauucacaaaaaaucaucuuccauccagaaaacauaaagaacacaaagacaaugaagaaaaagguaugagagaaaaaugagacaccaauaaaauaucuugcuccaccacugacugaagguaagcguaaacacccauuuaucacuguaaacuuguagaaugccugcaagaaaaaucuugugguugggaaacaaacuuccacucuuuccuucauaccagcaugaaaaauccugaaaugcucucuaugacuaaucaugaugcuaauaccaacaggcaaaggaaaaauuauuaaacugagacucuuaaauauugaaugcagugacucuugaguuuuagaguucucugaagaaucuguaacaucaaaacagaugaugaagccuacucuagaccuacuaagucagaaaacuggaguggagacagaaguagcaggaagacuucuuuaaagaaaaaaaaaucuuuuagcaccuauaggcuauacaaaaauuaaaaucucaacuauaucuucuuuacugccccauuuuuuucuguacuccuuuauagcaaaaugacguucaaguucuuuauacaguuggcucuccuuauuugcagguuccacaucuguagauucaacccaguauggauggaaaauauucagaaaaaaauuauaaaugguugucagugcuauacaagaacagacuguucuuucuugucauuauucccuaaauaauaugguauaacaacaauuuacauagcauuuacauuguauuagguauauaauuaaucuagagaugauuuaaaguacacagggagguuaugcauagguuacaugcaaauacugcuucauuuuauaugagacuugagcaucccuggguuuugguuucuaugguggugagaaccaaucucuacagauguggagagaaaaugguacucaucuuuccuuucauuuccucuuaaacucacucuuucauccaggcuuucaucccuacuacuccaccaauaauguucuuaucaaagucaucagugaccaucauguaacucuaucaauugaacaccuauauuacuugaccuaccagcagccaucugacacacuuaaucuaucccuucuuugaacuuaucuuucacuugacuuuuaggauacuucucuaaucacuuagcuucucuaauuccuacauuuccuggagucagaaagccccaagacuuaauuuuugauucucuuuccuaacuacucucauucucccuugguaaccuuauaccauuccaucacuuuaaacaucaucuauaugcuaaugacuucaaauucauuaucuucaaacuagaugaacucuucugaacuacagacucauauccaacuacauuuccacucagaggcauaauaagcaucuuaaaucuaacaugucaaaaacuguccaaucucaguuacugaaaauucuaguauuuccuacuguucaacccaaaaacuuuggagcuaacuuugacuccucugucccuucucauacuccauuuaacacuuuaguaaaucuugucagcucaaucuucaaaauacucagaaaccaacuauuucucaugaccuuucaugccacuucccagguuuuaagcuaucaucauucaauuauuguaauaucguaacuucuacucuugccaccuaugaauuauuuuucacagacaacccagaauaauuugaaaagucagauccuguugcuccuugcucaaaacccuucagugucuucccaccucuuccauaggcccuacaggauccaccugcuacucaggugugacuuccaacuucaucuauucucuuuccaucucuuacuucauuccagcuacauggacuucccugaacuuccucaaacaaaccaagugugcuccugucucauggcauucauauuugcuauuaucugaaccuggaaucucuuuuccucagacauuugaauagcauacucucuuauauccuucaagucuuuaacucaagcauuaucuaaguaggcuuucguggucacccuauauuaaacugucuuugugaaccuuggaaaauuccuuauguaccuuuccugcuucguuuuucuccacagugcugaucacgauguuuuuuuauuagugguuucuccucacaggacaauggaagucccaugacaguagggcuuuuugacuguuuuuagucccaguuuuguaagcccgcagguuagaacacuaccuagaauacugugagugcuuaguaaauguucauucaaugaaugaaugaagaaucacugacccccaacagucauuuaccaauaucacauuugagaaauuauguuagaauaacuaucugcuauaaacaguuucuaaauacuuauacuacuuaaguccucaagauagaaacaugggagaaaaguccagaaaacaauaauugcacuuuuauuuucuguuucauuaagaucuuucuugagacuaaauugaaaauaaguguuuaaugucuaaaagugagacacaccuuauaaauguaaagauguagcagcaagaguaucacuugggaaauuguuagcauuuauucaaaccucaacccagaccuaauaagucaugaacuauggacauggggcucagcaaucuguuuuaauugcccuccaaguuaauucugaggcaugcuauaagcauuguuuugcuuuccagguggggucuugcucuaucaccuaggcuggaguacaguggcacaguuaugacuuuacuguagccuugaccucccaggcucaagugacaguccaaccucagcuccagaguagcugagacuacaagcacaugccaccacaacuggcuauuuuuuauucuguauguagagacagggucuuccuacauugcccaggcgggucucacuauguugcccaggcuggucucaaacucccggacucaaguaacccucccaccacgcuaggauuacagguguaagccaccacacccggccacacugaaguauuagggaaaauccagcacaccuaugcuguuaaaagccuauucuuaccucugaugaaggagcugauccaaacgauguuaagggcuuauuccaugcacugacugaagguggcugugguggacuaaugggaccuacuggaaagaagaagccauaaaaaacaugauuaagauuuagagucuaauaaucucuaacccauuuaacccuuuccuuaaucuccuacuguguagcuauuacuagccagggaauaaaacaaucacuuuucaaaucagacuuacaaagauuauuauguaucaacauacaggcauaccccagaaacauuguggguucaguuccagaccacugcaauaaagcaaguauugcaauaaagcaaaucacacuaauuuucugguuuccaagugcauaucaaaaguuauguuuacauuauacuacagucuaauagguaauagcaucaugucuuaaaaaagauguauacuuuuuaauuuuaaaaaaacuaccgcuaaaaaggaagcuaaucaucaucuuagccuuugaauuguacuuuuuuugcugguggaaucuugccaguggagauguugauggcugcuaacugacuaggaugguguuugcugaaagcuagcauggcuguggcaguuacuuaaaauaagacaacaaugaagucuguaacaucaacugacuauuccuuucaugaauucucuguagcaugugauacuguuuacccauaugguagaacuucuuucaaaacuggagucaaaucccauuguuuaaucaacuaaguuuauguaauauucuagauccuuugcugucauuucaacaauguccacagcaucuucaccaggagauuccaucacaaaaaacaacuuucuuugcgucagaguuauuuccuccacugaugucuugaauuccuccaagucauccaugaggguuacaaucaacuucuuccaaaccccuguuaauguugauauucugacauccucccaugaaucacuaauguucuuaaaggagucuagaaugguaaauccuuuccacaugguuuucaaauuucuuugcccagauccaucagaagaaucacuguguauggagguugcagccuuagaaaauguauuucuuaaauaacaagucuugaaagucaaaauacuccuugauccaugggcugcagaauggaugccauguuggaaggcaugaaaacaacauaaaucuuccuguauaucuucaucacaacucuagggugacuaggugcccugucaacaagcuuauauuuugaaggaaagcuuuugagcauuuuucccccugagcaguaggucucaacagugggcuuaaaaauaauagguaugggccaggcaugguggcucacaccuguaaucccagcacuuugggaggccgagguggguggaucaccugaagucagggguucgagaccagccuggccaacauggcaaaaccccgucucuaugaaaaauacaaaauuagccaggcauggugacgugugccuguagucccagauacucaggaggcugaggcaggggaauugcuugaauccgggaggcggagguugcagugagcugagauugagccacugcacuccagccuaggugacaagagugaaacugucucaaaaaaaaaaaaaaaaaaaaaaaaaaaaaaacaaacuugguaugccauuuuguaaacagaugugaugucaucuaggcuuuguuguuccauuucuagaguacaggcagaacagauuuagcauaauuuuuaagggcucuaggauuucaaacaugguaaaugagcaggggcuucagcuucaagucaucagauacauuagccccuaacaagagaguuagccuguccuuuuaagucaggcauugacuucucucuagccaugaaaggcccagauggcaucuccuuccaacagaaggcugcuucaucuacguuaaaaauuuauuauuuaauguagccaccuucauccauuaucucaguuuuggaucuucuggauaacuugcugcuuugccuugcacuuuaaugugauagaggugguugcuuuccuuaaacuuccugaaccaaccacugcuagguucaaacuuuucuuuggcagcugccucaccucucucaggcaucacagaauugaauagagauagaacacuugcuuuggauuaggcuuuggguuaagggaauguugugucuggauugaccugcuauccagaccacuauaacuuuguaucagcaauaagacuguuuuacuuucuuaucauuaguguugauuacugaaguagcacuuaacuuuugaccuaucuuggcuuuuaccaugccuucuucaauaagcuuagucguucccagcuuuugauuuaaagugagacguacgugacucuuccauccacuugaacacuuagaagccaccagagaguuauuaaucggccuaauuucaacauuguuguguucuuaaagaauagggagguccaggagagguagauaucagggaacagcuggucaauggaguggucagaacacacaaaacauuuaucaauuaaguucacuaucuuauuuggguguucaugguacccugaaacaauuacaauaucaaagauaacugaccaccauaacagauaaaugaugaaaaauuugacauauugcaagaaugaccaaaaugugacacagaacaugaaaugaccacaugcuguuggaaaaaugacaccagaagacuugcuugacaguuaccaugaacuuuuaauuuuuaaaaaugcaguguccacaaacuguaaucaaaugagauaugcauguacaagacccccccaaacauugccuauuauuuucucaucaacacaaaauuauuuccauaaaauauaauaugcuuguuaaacaugcuuaaaacaaaaauuuuaagaaaguugagaggauuacuauuacuuuuuccuacaauaaaaaaugagauggcuagaaaacacuuaaagaguauauaaauaaaauugaaaagaaaccucaguauuccuaugccauuccccaccccucacuucucuuuugcaacuuacauuucuuagagauaucauucagcacagcugguggggccaccuuguuaucccauaauucagcugucagagugccaugugacuguggggucuggauggauuuuccugaggcuacauaaucugugccauuagguguuugagcugaaggcagccuaauugaugguggugguuguuuugaagacugagauguagucuguaguggauucuggacugguuugugggucugugccugagucugggcuggggcagguggggcaggauuuggggcugagacugggguaggggcuggggcuggggcugaagcugaggcaggggcaagugggacugaggcaguuggggcugaggcugggauaguuggugcugugaugacuggggcagcuggggaagaggcugcuggggcuggcguuggagcugaaguugaugcuagggcugaagcaagaaugggaauugaggcugaggcaagaauggugacagaagcugggguugaaacugaggcaaggauggggguuggagcuggggcugaggcuggagcugaagaagagguuauagcugcagcugaaguagaggcuggaacugaagcugagacugaggcugaggcugaaacuggagcuaagggugaggcuggaacuggagcugagguugaggccagaacuggagcuaaaguugaggcuggaaccggagcugagguugaggcuggaacuggaguuaagguugccggaaguggagcugagguugaggcuggaacugaagcugagguugaagguggaaguggagccgaagcuagagguggaacugaggcugaagacugugcuugcuggaucccuguagccuguuuuuuggcaaaucuuggaggaagcuuagaagucuggcuucuuccuuuuucauuugcauucuuuuuguuccagaccuuaaaaaauuaacggggaccauuuuugucaauaaugcagcugaaugcaacaguucauaaaugcaacuuuuaacaacucccacuaacuuggcuccuuuacuuuucaaaauagguacucaaaccacaaaaugucaggguugcuaauaagauuuugaaugaugagaagccaaaaugauauugagacaaaagacaaauagguauuguacauucuugacauacagguacauaauucugaaauucaagaacuaagaaauuuugcaguaaauucacuggcagcaaaacuuaccugagcuaacaaaaugcuacucacagucuuaacucauauauuugccacaggcauuaauuugggcaguguggcugguacguuaugauauaggguagaugcacaacuauuuuaccuuucuaaauaaaugacuucugaaaauuugguuccaaagguuauaggcaauuaaaugaauaauuuaccuugauucauucuguguauuuaaaugaacuaauauaaauuacaauagauacuuuuguaggccaggaauccaaaaucuacugguucgugauauuuguguucauuagcuuuccaagauaauuuaaaaucaacucaacuuugccuuggggcaaauaaggugucccuagcauacgauauguuguuaaaguaaagauggucuugaggaaguagucguugccauuccaagacagcugaauaggaacagcuccagucugcagcucccagugugauugacgcagaagacgggugauuucugcacuuccaaaugagauaccugguucaucucacugggacugguuggacagugggugcagcccacggagggugagccaaagcagggcagggcauugccucacccaggaagcacaagggguggggggauuucucuuuccuagccaagggaagucaugacagacuguaccuggaaaaucgggacucccgcccuaauacugcacuuuuccaacggucuuagcaaacggcacaccaggagauuauaucccacgccuggcucggcaggucccacgcccauagagccuugcucacugcuagcgcagcaguccgagaucaaacugcaagguggcagccuggcugggggagugguguccaccauugcugaggcuugaguagguaaacaaagcaacugggaagcuugaacugcggggagcccaccgcaguucaaugaggccugccugacucuguagacucuguaugcucugggggcagggcauagcugaacaaaaggcagcagaaacuucugcaaacuuaaaagucccugucugacugcucugaagagggcagugguucucccagcacgguguuugagcucugagaagagacagacugccuccucaagugggucccuggcccuguguagccuaacugggagaccgaggcuuccagaggaaggaucaggcagcaauauuugcuguucugcaauauuugcuguucugcagccucugcuggugauacccaggcaguggaccuccagcaaauuccaacagaccugcagcugagggaccuggcuguuagaaggaaaacuaacaaacagaaaggaauagcaucaacaucaacaaaaaggacauccacaccaaaaccccaucuguaggucaccaucaucaaagaccaaagguaaauaaaaccacaaagcuggggagaaaccagagcagaaaaggugaaaauucuaaaaaccagagcaacucuucuccuccaaaugaccacagcuccucgccagcaacggaacaaagcuagacagagaaugacuuugacaaguugauagaaguaggcuucagaagguugguaauaacaaacuucucugagcuaaaggaggacguucaaacccaucacaaggaaacuaaaaaccuugaaaaaagauuagacgaauggcuaacuagaauaaacaguguagaaaagaccuuaaaugaccugauggagcugaaaaccauggcacgagagcuacgugacacaugcccaagcuucaguagccgauucgaucaaguggaagaaaguguaucagugacugaagaucaaauaaaugaaaugaagcgagaagagaaguuuagagaaaaaagaguaaaaagaaacgaacaaagccuccaagaaauaugggacuaugugaaaagaccaaaucuacauuugauuaguguaccugaaagugacggggagaauggaaccaaguuggaaaacauucuuccggauauuauccaggagaacuuccccaaccuagcaaggcaggcuaacauucaaauucaggaaacacggagaacaccacaaagauacuccucgagaagaguaaccccaagacacauaauugucagauucaccaagguugaaaugaaggaaaaaauauuaagcgcagccagagagaaaggucagguuacccucaaagggaagcccaucagacuaacagcugaucucucggcagaaacucuauaagccagaagagagugggggccaauauucaacauucuuaaagaaaagaauuuucaacccagaauuucauaugcagccaaacuaagcuucguaagugaaggagaaauaaaauccuuuacagacaagcaaaugcugagagauuuugucaacaccaggccugccuuacaagagcuccugacacuaaacauggaaagcaagaaccaguacuagucacugcaaaaacaugccaaauuguaaagaccaucaaugcuaggaagaaacugcaucaauuaacgggcaaaacaaccagcuaacaucauaaugacaggaucaaauucacacauaacaauauuaaccuuaaauguaaaugggcuaaaugccccaauuaaaagacacagacuggcaaauuggauaaagagucaagacucaucaaugugcuguauucaggagacccaucucacguacagagacagagauaggcucaaaacaaagggauggaggaagaucuacuaagcaaauggaaaacaaaaaaagcagggguugcaauccuagucucugauaaaacagacuuuaaaccaacaaagaucaaaagagacaaagaagaccauuacauaacgguaaagggaucaauucaacaagaagagguaacuauucuaaauauauaugcacccaauacaggagcauauauauucauuuaagcaacuccuuagagaccuacaaagagacuuagacucccacacaauacuaaugggagacuuuaacaccccauugucaauauuagacagaucaaugagacagaagguuaacaaggauauccaggacuugaacucagcucugcaacaagcagaccuaauagacaucuacagaacucuccaccccaaaucaacagaauauacauucuucucacuaucacaucacacuuauuccaaaacugaccaaauaguuggaaguaagcacuccucaccaaauguaaaagaacagaaaucacaacaaacugucucucagaccacagugcaaucaaauuagaacucaggauuaagaaacucacucaaaaccacacaacuacauggaaacugaacaaccugcuccuaaaugacuacuggauaaauaacagaaugaagguagaaauaaagauguucauugaaaccaaagagaacaaagacacaacauaccagaaucucugggacacacuuaaaacaguguguagagggaaauuuauagcacuaagugcccaaaagagaaagcaggaaagaucugaaauugauacccuaacaucacaauuaaaacaacuagagaagcaagagcaaacacauucaaaagcuagcagaaggcaagaaauaacuaagaucagagcagaacugaaggagauagagacacaaagaaacccuucaaaaaaaaaaaucaaugaaucuaggagcugguuuuuugaaaagaucaauaaaauugacagaccgcuagcaagacuaauaaagaagaaaagagagaagaaucaaauagacgcaauaaaaauugauaaaggggauaucaccaccaaucccacggaaauacaaacuaccaucacagaauacuacaaacaccucuacgcacauaaacuggaaaaucuagaagaaauggauaaauuccucgacacacacacccucccaagacuaaaccaggaagaaguugaaucccugaauagaccaguaacaggcucugaaauugaggcaauaauuaacagccuaccaaccaaaaaaaguccagggccagacagauucagagcugaauucuaccagagguacaaagaggagccgguaccauuccuucugaaacuguuccaaucaacagaaaaagagggaauccucccuaacucauuuuaugaggccagcaucauccugauaccaaaaccuggcagacacaaugaaaauagagaauuuuagaccaauaucccugaugaacauugaugcaaaaauccucaauaaaauacuggucaaccaaauccagcagcacaucagaaagcuuauccaccaagaucaacuuggcuucaucccuaggaugcaaggcugauucaacauaugcaaaucaauaaacauuauccaucacauaaacagaaccaaagacaaaaaccacaugauuaucucaauagaugcagaaaaggccuucgacaaaauucaauagcacuucauacuaaaaacucucaauaaacuagguaucaauggaacuugucucaaaauaauaagagcuacuuaugacaaacccacagccaauaucacacugaaugggcaaaaacuggaagcauucucuuugaaaacuggcacaagacagggaugcccucucuuaacacuccuauucagcauaguguuggaaguucuggcuagggcaaucagggaagagaaauaaauaaaggauauucaauuaggaaaagaggaagucaaauugucccuguuugcagaugacaugacuguauauuuagaaaaccccaucgucucagcccaaaaucuccuuaagcugauaaacaacuucagcaaagucucagaauauaaaaucaaugugcaaaaaucacaaguauuccuauacaccaauaacagacaaacagagagccaaaucaugagugaacucccauucacaauugcuucaaagagaauaaaauaccuaggaauccaacuuacaagggaugugaaggaccucuucaagaagaacuagaaaccacugcucaacaaaauaaaagagaacacaaacaaauggaagaacauuccaugcucauggauagaaagaaucaguaucguaaaaacggccauacugcccaagguaauuuacagauucaaugccaucuccaucaagcuaccaaugacuuucuucacagaauuggaaaaaacuacuuuaaaguucauauggaaccaaaaaagagcccgcauugccaagauaauccuaaacaaaaagaacaaagcuggaggcaucaugcuaccugacuucaaacuacacuacaagucuacaguaaccaaaacagcaugguacugguaccaaaacagagauacagaccaauggaacagaacagaggccucagaaauaacaccacccaucuacaaccaucugauuuuuggcaaaccugacaaaaacaagaaauggagaaaggauucccuauuuaauaaauggugcugggaaaacuggcuagccauauguagaaagcugaaacuggaucccuuccuuacaccuuauacaaaaacuaauucaagauggauuaaagacuuaaauguuagaccuaaaacgauaaaaacccuagaagaaaaccuaggccauaccauucaggauauaggcaugggaaaggacuuggugacuaaaauaccaaaagcaauggcaacaaaagccaaaacagacaaaagggaucuaauuaaacuaaagagcuucugcacagcaaaagaaacuaccaucagagugaacaggcaaccuacagaaugggagaaaauuuuugcaaucuacucaucugacaaagggcuaauauccagaaucuacaaugaacuuaaauuuacaagaaaaaaucaaacaaccccaucaaaaagugggcaaaggauaugaacagacacuuuucaaaagaagacauauacgcagccagcagacacaugaaaaaaugaucaucaucacuggucagagaaaugcaaaucaaaaccacaauaagauaccaucucacaccaguuagaauggcaaucauuaaaaagucaggaaacaacaggugcuggagaggacguggagaaauaggaaugcuuuuacacugcuggugggaguguaaacuaguucaaccauuguggaagacaguguggugauuccucaaggaucuagaacuagacauaccauuugccccagcgaucccauuacuggguauauacccaaaggauuauaaaucaugcuacuauaaagacacaugcacacguauauuuaucguggcacuauucacaauagcaaagacuuggaaccaauccaaauguccaucaaugauagacuggauuaagaaaauguggcacauauacaccauggaauacuaugcagccauaaaaaaggaugaguucauguccuuugcagggacauggaugaagcuggaaaccaucauucugagcaaacuauugcaaggacagaaaaccaaacaccucauguucucacucauagguaggaacugaacaacgagaacacuugcacacagggcagggaacaucacacaccugggccuguugugggauggggggaggggggagggauagcauuaggagaaauaccuaguguaaacgaugaguuaaugggugcagcacaccaacauagcacauguauacauauguaacaaaccugcauguugugcacauguacccuagaacuuacaguauuuaaaaaaaaaaaaaaagauggucuuugcuguaagucaaaauauaaggagcuacaguccuuauauuuuauuuaaaauuuccuuugauucuggucaaaaugauuaaaaguugggaagaugaugucacuuuuaacacuugaauaaugaaaacagccuugacaaguauaaaaaccuugaacauuugcugauacacuuugggcaacaaaucuagauaacuagcaacaaguugaaacaagauuuaaaccuguaugacuuguucuuccuucuuucggcguucuucauccuguaaacguuuuuguuguuuuuuggauaccacuucaguaaaaccaucaucauucaaauuugacuggggaucuucaauuacuguuacuucaggaugaucaucaauuauaacaacaccugugggugugggaaaggauuuaagauauuuucuguuuuucaaaugaaaauuaauaaaaauguuuaguacaguaguacuuaaaaaaaaaaaaaaaacuagccaaaggccuaguuccuauaacuuauaguguauaaccuauuucucacccuauugcauggccauucauuguaaagaucugaaaagauuucauacucuuaaaguugaaaauaaaaauccuaaaacuggccaggugcaguggcucacgucuguaaucccagcacuuuuggaggccgagaugggcauacugcuugaggccggaaguuugagaccagccuggccaacauggcaaaacucugucucuacuaaaaauacaaaaauuagauguguguggugguauauaccuguagucccagauacucaggaggcugaagcacaagaaucacuugaaccugggagguggaaguugcaaugagcugagaccgugccacugcauuccagccugggugacagagugcgacucuguccaaaaaauccuaaaaauaccuguuuugaaugauauaggucuuuuuucuuuuccuuaaguaauauagaaguaaugccuuaaaaaagaaaaaaaaucaaaauuauccuaugaccuaaccuccaucucuuagccucagacuguauagugcuuuaaaagaucuacaaagcauucuaccucauuugcaucuaaccauucuaagagguggcuguuacuauuauuucuccuuuucaaaaaaugaaauaaauuggcuuagugcuguggcacaugccuguaguaucagcauaaugggaggccaaagugggaggaccauuucaggccaacaguuucacaccagccugggcaacauggggagaccuugucucuacuuuaaaaacaaacacauaaauaaauaaauaauguuuuaaaaaaugaaauaaacugauuuguuuaagguaagaugaccagccuagcuggucuuaugacucuuaaugucucuguuuuauguagacccuugucuacaguguggaguuguuaaaaauaaauauauguuaugggcaacacagugaaacccugucucuacaaaaaaugcaaaaauuagcuggcgcaugccuguggucccagcuacuuggcaggcugagguaggagaaucacuucaguuggggagguugagacugcaaugagcugagaucaagccacugcacuccagccugggagagcaagacccugucucaauaaauaaagaaaugaauaaguuaauuaauuaaaauaaauguguaagcugugugugaauguaagauggcauaggugaacacauaccagaaucaucuaggugaugaacaacucaagaucauuuuuuaacuuauuuuccaacuaaccaauuauuuuggcuaucuuaaaauuacccuauaucccagucaguaugugaaauauaaauccaucaaauaauauuuccaagaaaaauuaaauuaccucaggugauguaauuuuuuauuauagguauaaugucugaauaauaaguaucaagaaagagugaagcaauuuaaagaaauuauuuaauuuucaaacaauauaccauguuuuaauuggaaauuacauauacaauaaaaauauuuuucuuggaaacgauaaguauacaauucaggauggugauaacuuguuagguacagcaacaagggaaggugauacuuguuagcuauggcaacauagguaugaucaaggaaguggucacagagaaacuaucuacaaacauuucuucuaaaauaguuaaaacuuagcauuaacauacucugagagaugaaaugaaaaaugaauacuggcuuucacuccuuagaaacuggcugggcauggugguucacaccuguaaucccagcacuuugggaggccaaggaaggcggauaacaugaggucaggaguuccugacuagccuggcuaacaugguaaaaaacccucucucuacuaaaaauacaaaaaauuagcugggaauaguggugcgcgccuguagucccaccuauucagaagguugagguaggagaaucgcuugaaccugggaggcagagguugcagugagccgagaucacgccacuguacuccagcuugggugacagggcgagacauuaccauuauuccauuuuucuaauagaaacuugauuucagccaggcacgguggcucaugccuuuaaucccagcacuuugggaggccaaggugggcggaucacuugaagucaggaguuugagagcugccuggccaacauggcgaaacccucuacuaaagucgcuacuaaaaauacaaaaaauuagcugggcaugguggcaugugccuguaauccuaacuauuaaggaggcugaggcaggagaaucacuugaaccgaggagguagagguugcagugagcugagauuacaccaccgccuuccagccugggggacagagcaagacugugucucaaaaaaaaaaaaaaacaaaaaaaaaaaagaagggaaacuugauuucaaaagaaaaaaacccaguuuauucugauuuauaaaacacuucuacuuguuuuuaaaauccuuuuaaaaaucauuaacucuguaaaaugaagcauauucucauuuccaugaaaggucuaagucaaacauuucaaaggaugucaugcacacauuacuucagacugauggaaagaccucaucauaauucuaauuucaucucaguuuuucacuuacacuaaaauguguguguguaaagccuaucuuauuauuucaacuuccuuaguucacccaacuacauguagcauuuauggaaaauucgaacacuacuuuuuaguuuccaauguccucuucuuuuuaacauuuuagguuagagauauuacuuaaaaacaguguuaccaggaaaaagaacuaaagacgacuaacucuuaaagauaacuuuaaugaguugaaaugaauagcuuaauuucuaucaccacuucagaaauauauauaguuuuuaucuguuuuuacugucuuuuuuguuuuguuuuguuuuuacaggcaugcaccaccaugccuggcuaauuuuguauuuuuagagacaagguuucuccauguuggucaggcuggucucaaacucccaaccucaggugauccgcccaccucagccucccaaagugcugggaugacaggccugggccacugcccugggccuauuaugucuuaauauagcaauauuauggcugggcgugguggcucaugcccguaaucccagcacuuugggaggccaagguggguggauggcuuaagcucaggaguuccggaccgaccuggacaacauggcgaaaacccauuucuacaaacaaaaauaauaauaauaauaauaauaaauuagcugggcaugguggcucaugcuuguacucccagcuacucgggaagcugaggcuggggaaucgcuugacgucugggaugcagauguugcagugagccgagauugcaucacuguacaccagccugggcaacagaguaagucucugucucaaaacaaacaaacaaacaaacaaaugaagaauuugcauugcucacaaauuuccagguaaugcugaugauguggggaccacacuuugagaaccacuggucaaaaaauaauguccaugagcugugcucaaaucagagcuuaauauguacaaauaacaauuaggcagaugaaagaaaaaccucaucuauaucucuuauacuagaauaacugcaacuaacccaacuuuccuauuacuacuauuauuaccacuauugagcuaucuggucuuaacuuaguaaaucucucaauuuuauucaguauuuccaguuucauccaaaugaauggcaaauaguacauuuuacauguacaaugucuauacacagauauuccuugucuguuuuuucuucauccaauauuuucuuguugcuuguauuauccuucauauuugauccucuauuacuucauggcuuuccuauuuauccacagugacacugccucucguccuauuauuuauucuguauuugccacaucuuagacaccaauuuuaccaaggacauaauuauugaguuuaacauuuaguuccuuuuguuuuuaauaauacaucuauaccaauauaacuaagaaucaaauuucugugcuuucucaaaucuggcaaaguagagugguuacugaauuuucuuccucuuuuuuggaagaacagugcaaugcuguuggauuauuuuuaacaaaaauuuuauuaagcauucaaggcuacgcuaaaagcuggaguuauuuuaguuuaaguucaaucaguuaguguuucauaaucagccacuauguauaccuugaauguccaaaucuuuccuucuuggaaaacuucuuuaauuguggcaucuacauuuuaaaauguagcaaauaaauaaauaaauaaauaaauaaauaaauaaauaaaaugaaagaaaccuaagacauacuugcauaauuguugagaucaaacugugauagagcauccacuuucucuuuugguuuuuuagggccugguuuggggucuucucuuuuuuucccaguagaaucuuuggaguucuuuuguccuguaccauuagguacuccuuccugauggugugcagagcugccauugaugaggucaaccccaguugugccugcaggcuggucaucaaauggccuacaaaaaaauaacuugagauauuacuauuuccaccuacccaaacaaaagaaaaaugcucuuauuggcaguuucuaaaguucauucuaagaugaaacacuguugggauagaaaacucuuaacuguaaccaaacaagcauuaguaacuuuuguucagcacaaccuuacuaaaaccggguuucccaagaaaguagacuagcucccuagaguucuuuccagcaauuaaauucuagaauucuaguuauaccagaaguucuuagagucuauuugucuaucauauuauaaaugagcuaauuaacacuguuuauagcagaaaauuucugugauccaagcaaguucaaaguauucacaaauggaugcucuccaaaagugggcagcauaugaaaacaaaaauuuuuaaaaagcauucuauauuuacaacuauguacauuuaaaaaaauguaaucagauuuacacauugauauaauuauuuaaaaaacuuuaauauggaaauaauucacuucacaaaccaaauguauccccuacaguucuuaauaguucuuauuuccuaaaagaauaauuucagguuguuuuuuuaaauuuccaagugaaaaugaucaugggaaauggguuuacuaauucauuugcaucuuagccuauaguauuacucaagauaaaagcuuaccaggucccuggucauaaccugaaacauuuuaagaaugaguucauuucuucuauauggugcucuuauaaaaaacauuuaauuauaaucgucacugccauuucuacagguucaaaguuguuguuaucuaucuauguggcacaaaaaucuugcuacauaguugagauuuacauggcacaaaaaucuuaucaaaauuuucccugaguauuguuacuuaaaauucuaauaguuugguuacgggaaauaaacuauucuguuuauuuugguuauccugauucucuuggaauuuuaagggaauguucaaauuccaaguaaaaauuuccuuuuucuaaauuaucuggaacagcaaacuaaugcugugauuugaacauaucccucaaaaguucauguguugggccacgugcaguggcucacaccuguaaucccagcacuuugggaggccgaggugggcagaucaccugaggucaggaguucgagaccagccuggcaaacauggcgaaucccugucucuucuaaaaauacaaaaauuagccgggcaugguaguguacgccuguaaucccagcuacuagagaggcugagccaggagaaaugcuugaacccagcgggguggagguugcagugagcagagauugcgccacugcacuccagccugggugacagagugagacuccgucccucacccacgcccucaauaaaaaaaaaaaaguucauguguuggaaacuuggucccuaauggcaaugcagcaguggugagaggugagaacuuuggaaggugauuaugucaugagggcucugcccuucugaauggauugauugauccuuaacagguuaaugaauggguuaucaagggaguugguuaguuaccaugaacgggucuguuauaaaagccaguugugccaucucuugugagcccccucaccaugugauaagcaugcugccuugggacucugcagagucucuaccaacaagaaggcccucaugagaugucgcccccucaaccuucgacuuugcagccaacagauuugcaagaaauacauuucuuuucuuuauaaauuaccagaucucagguauuuaguuauaucaacagaaaauagacaaauauaccuuauggguauaguaaucugaagugcuaaguauguaaaacuaaggaacucagauuaauaccauacaguccaaauaaauucuuaaauucuuaucagcucaggcugcaaaccuggcaauugcucuaaaagcagggcacacauaauaaugauuacuuacuauauaccagguauuaagugcaucacaaguaucaucuuaguaucuucacacauuaagugcuauuauuuucuccccauuuuagcggugaggaagcaaaggggaagcaacuagaaaguacuagagccgagauuugaaccuaggcauucugaaucuuaacugcuacguuauaaugcuaacacuaaauaaauaaaucaauacuagcuuacuauaaccaacuuuuuuuuuuuuuuuuuugagacggagucucgcucuguggcccaggcuggaaugcaguggcacaaucucggcucauugcaagcuccacucccaguggcgccugccaccacaccuggcuaauuuuuuguauuuuuaguagaggacgggguuucacuguguuagccaggauggucucgauauccugaccuugugacccgcccaacuuggccucccaaagugcugggauuacaggagccaccgcaccaggcccaacaucugaauaguuaaaaaaacaggccaagcaacaggugcaguggcucacaccuguaaucucagcacuuugggaggccgaggcggguggaucacgaggucaggauaucgagaccauccuggcuaacacagugaaaccccgucucuacuaaaaauacaaaaaauuaaccaggcaugguggugggcaccuguagucccagcuacuugggaggcugaggcaggagaauggcaugaacccuggagguggagcuugcagugagccgagaucacgccacugcacuccagccugggugacaaggcgagacuccaucucaacaacaacaacaaaaaacaggccaaguuuagcuuacuugagaaaaaauauuuuuuuaaaaaaauccauugccauggcaauuauguuauugguguccuugguaguagaacagggauuuguuuucugggccucucucuagagugacaaaguauaugguuauaacauuaauuuaaaucucagaggacaccuguguagcauuagagguuuauuaggagaaacugagaaagaagggagggcuacucaucagauaacuuaccaaauaaggacacaguacaugucccuccuuagaugugaacauuuucccaaagcuacaaguuuccaagagaacucuucuggaaaauguaacguagcaggcaaagacuccuaagacaccuuaaccucucuuccuuaagcacccuuacacuuugagaacagagaauaaagcauuugggaagaacaauguuuuuugguccuuuaucuagacuggcucuuugcauaauucaaccaagaacucuacuuuuagcuucuuuaaaggugcaaaagcaacuauauuuaaaacaaaguacucacccucucuucccacuuuuugauggugggccacuucuccuuucauuucuaggaccugagaaauuccuuccugauuuggguggaccauuguugccacgucgauucugacgaucuacuggucucugacuagaaaaacuucucuuugcaauuucccucuuuggagguagaacauucucuccaaccuuuacaacuguuugugcauucaagucagcauuuuuuuuuucaucccucucucgccucucauugaaaucacugcuuucagaagcuguuucccauucuucauuugccugaucugaagaguucugauuagauaaaucuggugucuuauucccggaaauauccccaagaguauuaacugguucuugagccacauuauuaacugugccauuugugggcacugcuaccaccucauuugauuuugaagcagccucccucucucuuagccgucuaaaucgagguggcuugucuugccuugguggucgaguaggacgcugccuucgaggccuuucucuagcugggucaaauuuucgcucaaauuuuggaggucguuuaucugcugcuauaggaauaaacugcucaugucuucuuggcggcucuccaucuucugguuuaggaacuucugacugccuuggguuccacugauugucccgauaagcuggucuucguaaaguggaagggcgugauggacggccuccaggaucccuuccaccacgccugaauguucccccucugccucuccuuguaggcucuccuuuaggaagaaagccugguuuagcuuuaucgucaucccuuacauaaggcuuuucuagcagucuauuaucuauucgaacaugauuaucaggcuugaaagaagaaugaggcuuuacagguuuuuuguuuucaggccguuccucucuuuugggaaguuugccuuuacuuaaacuguccuugucacuugcacuuucaugaauuucacugucugugucagucucugaaccccgcugucgucuucuuuuggggacaacuucaaaaucagagcucucacuccguguuucacuuucuucucgcugucugagaggcccugaggguauaugcucugcucuuggcuuauugucucuauacugaggauaaucucgaguguguccccuaccaccccugccacgcccuccauaagaaccucuauagcuucgaccucuggaguaauauucaccucggccucgaccucuguauccuugaucuggaaaccaaucucucucucuagcuucuuuccaauagguccugggaggcaaaguugauucuuuuuuaacugcuggucuugaaucuggucgaggccucucuauaacaaggucuuugcugaugacuuucucagguuguuuuucuucuuugacuacuggugcugccauagucuguugguuuacagucuuaacugcaggcucuaccugaacaguacucacagguuccagaggcuucucaguauccugagaugguuuuugagccaaaguugcaguuucuguugaaggaaauuucucugcuucugguugaauuggugguggaacugacuguggcugaauuggugcugguggcugaggugguggugggggaggaggaagauccuucuuuuccgucuuuucaggcuuuacaacuacuuuuucagugaccuuuucggccuuuucuccuucuuucuccuuccucuguucccguuccucuuucauaucucuaaguacagguuuuuuaaugggaccugaucuucucacaggucuaucauuaacuucuucccuucuguuagagcuuggucgugggccccaacgaguuucugauuuagauuuauauacuuuuucagguuuugguccuucagaagaucguauaaagccuuccuuuuuugguuucuccucuggccuuucuauugguucuuuugaaucaaugcaucugcugguuacuuuaggaaugccugcagaugguucacuucucugcucgucugguuuuugcguaugguuagauccaugggaaacacuucuuuuccgggaaggcugacuuucuacagcugaaauccgcuccucuugaggagcggauaaggucuuuugaucaggugcuucaaaacaagcagacugauuauuugcaucaguauggugaggucuaacaucuuccacagaucugcuuaaaaacuuuuguacuugugccucacuugauucucugauaaagucugccuuugggugagccucuaauugauuauguucuacagaauaagcagcaguaaucuguuccugguccaacgcagcuucagaccuaugaugauaagaauucaaagguauaaucaacaaagcaaucuuucccaugcguaaguauauagcaaaauaaucccucuaaaacagaaagcaaugacucuuaaccauaaugagaaucuuucucucgcuauauaaaaaguuuagaggagaauuacucacaauagccaagagguggaaacagccuaaauauccaauagcugaauggauaaagaaaaugugguauacacauacaauagaauauuauucagggauaaaaaagaaggaaauagugucauaugcuacaacauggauaaacccugaggacauuaugcuuaagugaagucagucagucaggacaaauaucuuacaugaggaacaugaaauaaucaacuucaucaaagcagaaaccauaaugguggcugccaggggcuaggaguagggggaaauaggaaauauagguauagguauaauauaggaaauauagguaaagguaaauauaggaaauauagguaaagguaagaauaggaaauagguauaaaguuucagucaugcaagauaaaaaaaaguucuggagauuugcuguauaacacugcuuacaguuaacuacaugguaccauaugauuaaauuuuuguuaagaggauauaucuaauguucuaagugguuucugccacaauuaaaaauaaauagggccgggugcgguggcucacgccuguaaucccaauccucacuuugggaggccgaggagggcggaucaccugaggucgggaguucgagaccagccugaccaacauggagaaaccccgucucuacuaaaaauacagaaucagcugggcgugguggcacaugccuguaaucccagcuacuagggaggcugaggcaggagaaucgcuugaacccgggaggcggagguugcggugagcugagauggcaccauugcacuccagccugggcaacaagagcaaaacuccauuaaaaaaaaaaaaaugggccugaagcgguggcucaugccuguaauccuugcacucugggaggcaggaggaucacuagggccccaggaguuugagaccagccagggcaacaugaaaaaacccugucuguacaaaaaauacaaaaauuagccggguaugguacugcaugccuguaguccaacuacucaggaggcugaggugagaggaucacuugagccugggaggucaaggcugcagugagcugugauugcaucacugcacuccagccuggcugacagagcgagacccuucucaaaaaauaaaaauaaaaaauagaaauaaauaaaugaaguuuauuccuuaaggaaaaacaaaguuaagaccaugcugaugugaauuucuaauccaucaagaccaguaauuuccaccuagaaugaaagaguacacuugaguaagcuuaucugucccaguuaauuacaaauaauuauaaaacauuauaaaacauuaccaaaaaaauauagcccauaaaagggcaggaaguuccaacuguauggcuauaaauuauuacagucaucaccaauugugcgccauuucaaaguuaacuuuguauuauuguauuucuccuuaucuuggccuuaaaaauguucccuaaaauacuguuaaaaagaaacaucucacuaauggaaaaauuacaucuagcuauauuauauaagcauuguagauacaccuaaauuucuucacaccuacucuacaauaaagacaucccaaguggcugcacacgauggcucacgucuauaaucccagcacuuugggagguaaggcagucagacugcuugagcccaagaguucaagaccagccugggcaacacggcaaaaccccaucucuauaaaaaauacaaagauuaucacaaggucaggagaucgagaccauccuggcuaacacggugaaaccccgucucuacuaaaaauacaaaaauuuagcugggcgugguggcgggugccuguagucccagcuacucaggaggcugaggcagaagaauggugugaacccgggaggcagagcuugcagugagcugagaucgcgccacugcacuccagccugggagacagagcaagacucugucucaaaaacaaaaacaaaaacaaaaacaaaacaaaaaaccccacaaagauuagcggggugugguggugaacgcauguagucucagccacucaggaagcugagguaagccgaucacuugagccugggaggugaacgcugcagugagccaagaucauaccaacgcacuccagccugaauaacagagcaaguuccuaucucaaaaaagaaccuaccaauuucaacaucuaauacuaaauuacagcauacaauugaguacagaaccagguuacaaaaugcccuaaugaauacagagaauauguccaaagaguaagcguagcaugcuaaauuaaauagaaggaaaccagauuuaugcuucaguccuaaauuggaaugaucuucagaaacacuacacaguuuuccuuuuaccaaaauauucuguaucaucuauuaaauugaaauaauuuauuaccuuacauccucaggcucuucuguugcuuugggaguaguugcuuguugaggcucagcaugaggauagggaucugacccccacagcauacgaggcucagaaagggaaauugcgugaucucuugcagaucgagcuauaugcucaaaugacucagaacuguucggugacccuuccaucuggucucuucucauuaaugguuuaggaggaaucauuccuguaacaaaaguucagaaaaaggugaaaugaggauuuugaaaaaugaacgaaacaaaaccaugauagacauagaauacagguuauuaauuguuagguggaauucuccauauuaaaagcauuuuuuuccugaguaaaagauugguggaaauuauguaaggguuguucugugaauggaauuuuauuacugcuguuaaauaaaaauugcauuuaagaacugaggaagcaaaauaagcaaaaucacaauagcagccuguuuuacuucaaaagaaagaaaauauuaugcauauaaaaaucagacaccaaguacugugacucuggaugucaauacaaacaucaugaaaauuauacuaugauaacuuucagagaaaauucuuuccuaaauuccauuaaccuaccuuaguuggucaauauucuacaaaauaugccacuuaaauuuccaaauaccaguauaaauguaaaaaucaaaacaugauuugugaucagcuuaucaucccuaaauuuuccucuguaacauuuugguaauagauuaucuugauuuauucugauggauuccauaaaagacugcuaauucacuuuuuuucccccuaaccuaaaaggaaauucaaguguuagguugguaaaugauggaagaagaacuugaaaaggaauauauauaacauauggacaaaauucaaacgcugaaaacacuuuaaagaagaacaacaauguagccaauaacaaauacuguuaauaacacauaauuauuuccaucugaaguuuuaaauaauacuuacaaaacagaaaugaacuaguauuuuguucuugccacauaaguaauaugagugucagauauuuaauuacucgaugcugaaaguuacaucauuuugauuaaaaaucggagguuuaaguuuuuccuagauuacaacucucaaaggaacugaaacuaaaagcagggaaaaaaaaauuuugauccuguaaaacuauaaaugcaaauucaacugaccaggaugaauggguggaauauccauagcaggucuuccugacaucauucgaggauccauguaggacugcaucaugagccaccuuggaucaaaacccauagaagccaaaugcugaggaugaggcugcauaggcugauaaagaggucugugugguggaggagggacaguacuacuggacgguugugaaggaacagucuguggaaguacaccuugcuguugcugcugcugccacugcugcuguuucaucuguuccugaaaaaguaagaucccauaucuugagaguuuaguuccacaugacaaauuaacauaaucaaucauaucacaaaauaauggccuguuuugaauccuugaaggaaaaguaagaguucaaaagguauuuaacaguuaagaguuggcaagacaaaaaacugaaagaugaacuauaacauuuuaccuuauacucaagcacuguaugaucuaucuccuagaaauggaagauggugucuauaaaugaggcagaagaucaaaaggaaugacacagaaggucaagguaaaacccacguuaacuuuuauuuacaaggaaaaauaauuucaagggaacuuugugugcuuuacguauuaucaguuuuaugucuaauuucccagacuacugcauaauaaaccacuucaaucacacauacaugauaaaauauuuuuaucauuaccugcugccgcuggaaucguggagguaaagacuucugaaacuguuugaaauagccagauaauacagccggccgagguugagacccugauucugguucuguuucaugcaccacugguguggcuuccuuuucacugcgauugcugucuugucuagugaaaacggguuccuccucugcucaaagaaaaggugaaagguaauaguauucaucuaugacacuuaucaaacacaggauuuuuacaaagacugagguauaauaaaaguuaaugaggaagaaaauauccucgacacucuaaaacauuauuuucuacuuuaacauugguaguuaucaaugagguaacauuagauuaucaaaaccuuagauuuccuaaaagcugcauucuuagagauggagagcagagauccaaaugcuucaucauauaaaaucuauguuuuuuuuuuuuaaauaaugaaacauuuccaacuccacauauuuuuuauuuguuucaauaaacaucaauguaauugucaguauuuacugguaguucauuaaaaucuacaugaaaacacaaauggccuauaaauacuuaaaaagagagcauguugguuuauuuaguuauuuauuggguaaagggacuauuaucuguaaggaaaacuaaugaguuuaagucugaagacaacagagugaucacuaguuaucuucaaacauaauucauucuagaaugucauuugucacaauuacaaauccacgcuuguuacaaauucuuuucucaaaugacuaguaaugaauuuaaaauggaaguuuaucucccaauguaaaagcaugcuguuaagaaucacaaauaacauuuuuauugcuuggauuacauucaauauuaagaauguuguaaaagagugagcaggucaugguggugcaugacuguaauaacaguaacucaggaggcugaggugagaggaucacuuuagccugggaguuugagaccagccugggcaacacagccaaaaaaaaaagaauggaaaauaauauacuggaggaaaaagagccacauaggcacugacuuuaaaaucacgugugucuugagaacaucucagagagcauuaaaacaaacaaaaaaauuguaugugucuaguaucagaauugaggggggaaaaaaaaaucacauggguacaucucacugauaaacaagcuaaaauuaaauugccaugagagagaauauauaaaaugugaaugaaaauaaaagcacaaauaaaacuuauuaaacuaugauaauguuuuccuuucucuugugaacacuuuauuucacuauuuugguguuaugagcaaucuucauaaguacuuauguaauauaagcccacuauucaauagcaaagucucucuagauugauuaauaugaaaaaaaucugaaaucuuagagucuuaacaaaugguccauacaggccuuauuucauuaaaaaaauuaaagauaaaauacucauacuccuuuauaguuaaauuaagagccaaguuugaagguaacccugcauauaaauaaaaacuuuauuuuuaaaaacacauucuuauuauuuuaagcagcagugccuuguagaaaagagcaugagacgucagguuagaaaacuuacaauauuuccacaucagaaaauacacugaaauaaaacugcauuucuauuuuaauucaagucguucauuaaaacuaaacuuuaggcugggcgcgguggcucacgucuacaaucccaguacuuugggaggccgaggcaggcagaucacgaggucaagagauugaggcuaugcuagccaacauagugaaaccccgucucuacuaaaaauacaaaaauuagcugggugcgguggcacgcgccuguagccccagcuacuugggaggcuggggcaggagaaucacuugaaccugggagguggaguuugcagugagcugagauuccgccacugcacuccagccuggagacagagagagacucugucucaaaaacaacaacaaccaccaccaccacaacaacaacaaacaaaaaacgaaaacccugaacuuuaacuuugccaaggcuuuauacuauauuugaaugccauuaaucagucuacaagccaacucggagaagaacaaaaaaguugauuagaucuagaaaaagaauuuuauuuuaaaguauaauuacuccaggaaauuacaguuuaauagcauaucaacuacaccauggaagcuugcauguuuaaacugauuaaacagcaaaccugaaauuaugaacuaggugcagucauuuaauuaugauaauccaacauacucauuaagcucuaugccaguucaguuuuagagguauuaaugcaugugaacaaaugagauuuuguuuaguuaaaugucuuggagucagaaaaaagcagggggagaaucaguauaugugacuaugaagccaauacaauucugcagauaaaacagaaaugaagcucaucuaauaacugagaaacacuucagagacgucuguucauauacagaauuagaaaacacggcucuagcccauauuuuguacugcaaaugcuaucauaaaacaaucacuuuuauauugauuacauauauuuaaaauauacaaaccccaaacuguaaccaacauaaagcucuuuguaaaguuuuuaaaagagaaugaagaauacuaucaaaccuuuauuacagcuguuuucacuuucuuguuuuucuaccaugggcucuaaauuagguucucuggguucaauuuucuccucuaauuuuucccuuuccuucuccagcucacauuccuuuucuuguucuuucaucuuuuguaguucuuuuuccuuuucuuucugccguucuaguucuuuuucuuuuucuugcuuucuuucuuucuccauuucucuuuguuuuuccugcuccuucuccagcucuuucuccuuuuccugcugucucucucugucuuuuucccucuccuucucucgcuccuguucuuguucuuuuucaaguucuuucucacgcucccguucuuuuucucgcucccuuucccuaauuuccucuggagaugguuguuuuuccaggaugccaagcuucucauccaaucguuucaguuucuccgcacaagcugccuuccuuuguucuuccauucuucgcucuuccucuucacgccguuuacgagcacguucuacugcugcagaaauuucugauuguugucuucgucuuugcuuccauauuucaucuucaucagcuacuugcugcuuggagggaaaggggccuggucuuccagguacugccugucgaucuggagguggaugcugaaacauuaagguaucagaugaguuaugacaacucuauuucugacuaacacuggguaucaggcauggagaaggaaaaaccccacaaaaauaucagaaauuucucugaugaacauacacauuaaaaugaaaacacauaagaugggaaauauauuacaucuagauaauucaccaaacuaagaccagaauaauuaauccagcgguccaauguuuacugaguauguaccuauuauugugccagacguuguugcucauucaguauuugcugaauaaaacuagaagcacaacagugaaucucaaaaucuaaauuuagagacaaaggaaauuuagcauggauacuuuagaagcagcugccagaguuggaaugucuaagggagagaaaugaagguauuaaauauccaaaaugauggcaugugagcccugagaaaauuaagguacagcuacagguaaaaagcacagagccaaagaagcaaagugaaaaagacagagucagugcuguaaugauaccccaaaggagaagaaauuccuacaaauuagucugggugaagaaaaguucuaucuuuagacugaaagauccagaaaagcguaucuagaacccggaguggagaaucggaggaucaucugaaacauccaaguuucaaugacuaaauuuucauuaauguguuauaaaacaaugacagguuuuaaaaucacugcuugcaacuaugcaaaaacaauaaaaguaauuaaaaaaauguuuuuaacauauugauuuuaaaagcuacuagggugaagaaaucuuaagagccauauguaacccagcuggaaugcuuauaaaaagauuaaacaaugacacaacgaaaacacuugacuaucuuuuuaaaugaaugcagacuaccauuuacuaauagugccaucauaugcaaauuacuucaucucucuugugcugaguuucuucauccacagcucagagauaagcugaaaaaccaaauauauuagugccuaauuuacacaacucacuucauaaaaguaaaauuuacauaaaaugugcugugcugcacauauuuuaaguguauaguuugaugaguuuggacaaaugauacaccuguguaaccacugcuccaacgcagacacaacauuuccaucacuccucugccucccccuguggccccaagcaccccaacccuaaccuuguauaguucuguuuguccuagaauuuuauauacauguauaaaauuauauucucuuuugugcuagcuucuuuugcuaaguauaauggcauugagguuauuuuauguauaaguaguuugcuccauuuuacugcuggauaguauuccauugugggcacguuguuucauguaugauagacacguggguugcuuccaguuuuuaaacuaugaauaaaacagcuaugaacauucaugcguaagucuuuguguaaauguauguuuuccuggcuguuggauaaacagcuacaagugaaaauccugugucauaugguaaauagauauuucauuuacaagaaacugccaaacuguuuuccaaagugguuauaagguuuuccaauguauaagggugccagcugcucuauacauccuugccaacacauggugucaucagucuuuaauucuggcagugcaguaaaaucucagugguuuuaacuuguauuucccuaauaacuaaagacacugaauaucuuuucaugugcauacuggccauucuuacauuuucuuuugagaaacaaauguucaagucuuuuuguuuaacuacguauuauugaguuguaagauauuaaaaaaaaaauaaaaauacggcccaggcuagacacgguggcucacaucuggaauuccagcacuuuaggaggccaaggcaggaggacugcuugagcucaggaauucaagacuagccugggcaacauggcgaaaccccaucucuacaaaaaauacaaaaaaauuagccgggcauagaggcacaugccuguggucccagcuacuugguaggcugaggcaggaggaucgcuugagcccaggagguuuaggcugcaaugagcugagaucuugcuccagccucggcaacagagcaagacucuguugcgcaaaaaaaaaaaaaaaaaaaaaaaagcccagcuacaaguccuucgucagauguauuaggaauauuuuuuucuguaacauaucuuugcauucuuugggaaauguucuccaaaguccaacugaccagcugcuuuuccuuucuaauucguggccaaggucuuauuuaucgaagaaaacuuugucagcuccaaguucaugaacacuugaucuucuauacuuuuuucuagauguuuuaguuuuaguuucuguguacgcagaaauguuauaaagagcuuucagugguuaugaggagagggauugcuggaaacgauggugaugguugugauauguacagcuaucacaguagggugauuacagaaggucuggagacccugaucauaacaacgauuucaggaaaagaaaaucugcuaguuagaaagaagaacaaguaaaaaagucaagaagagcaauguguaugugguaagaacagcagaugaaauuagaaaaguagacagagaucugaaagaucaugagaaggacuugaacaaggaguaacggaccuaauccauaguuuuaaaaagacaacaacuacuacagaagaauaugggaugaagguggcaagugagcaggcagcauaagaggaaagcaguaucugucaagaacccacuccaauaguucaaaggaaauauaaaaggugguagcaaguagucaguguacauuuugaagguacaggugacaaucugcugauagauaaagcuagauguaggguaaaaaaagaagaguuaagaguaacuucuaaguuucagccuuagcaaauaugugaaugauaaugccauuaccugaaaugggaaagacaggagaagcagcacuguggguaugcaggaaagguggggguguguguuaugguuuggacauauuugagcuguuuacuagagauccaaguggagauguugaguugauuguugaauauaugacucuuaaaagucagugcaaagcuuuucaggcuaaauguacauuugaaugccaucagcucauagaagacauacccaaggaaaaggauacagauuuuuaaaauggacugagaaaaaggcugagugcuccaacacucgaaguguaggaggcccagaaggaauagaaagcaaagaaaaacaaaauagcgaggugucucagaugcaaguagauaaaaaaguguuuuaaggauaggccagggaugguggcucaagucuguaauuccagcacuuugguaggucaaggugguaucuugucuaggaguucgagaccagccugggcaugaaggugagacccugucucugcaaaaaauuagccuggcgugguggugugcaccugcagucccagcugcuggggaggugagaggaccccuugagcccaggaguccagguggcagugagcuaugauuacaccacugcacuccagccugggccacaaagcaagacccugucucuaaaaauauaugcauauacaaaagaaggauagagaaaucaacuaugucaaugacucagcugagauuuaaaugagaugaagacaagaaaacugaauuugucaagauggaagucaucacugacucugauaauaauaguuucaaagguagagugggaaaagaaagcaugccuggagagggcuaaugagagaaugagcagcaaaagacgguaaguauaaauaguucacuaaaagaauuucauuggccgggcgcgguggcucacgccuguaaucccagcacuuugggaggccaaggugggcggaucacgaggucaggauaucgagaccguccuggcuaacacggugaaaccccgucucuacuaaaaaaaacacaaaaaauuagccgggcgugguggcgggcaucuguagugccagcaacucaggaggcugaggcaggagaaugcugugaacccaggaggcagagguugcagugagccaagaucacgccacugcacuccggccugggcgacagagcuagacucugucuaaaaaaaaaaaaaaaaaaaaauuucacugauggagaacagagaaauaggguagacacugcaaugggauggaaagugggauggaguaauguaaagagagagguuuuugugaaguuguuuuucuuaaaauaugagauaacauuaucauaaguggaaaaggauacaaggaaccaaguaaaaaaguguccuuagcaccaaaaacaauaggaagaaaaaguauacgggcagugagagagaaaaaaaaaguuaucuccuagguacuucuuauuuucuuagugaaacuugaagcaugcuuaucaacugagaaugaaaaugaaaaggaugaagaguaagacauguaagagucacaagguaaaaaguuaguaacuguuucauaaaaguuuugaauaaaaaauuuggugucuuuccaccaaaacaaaaggucaaauaaaauauauaauccauaaacaagcacuuaaaauuuaccugcugugcaagcaacuuuggaggugguggcagaugugaagauguuccacguuccuauuauaaagaagaaagaauuauucuuauuauuuuggagacagucuugcucuguugcccaugcuggagugcaguggcaugaucuuggcucacugcaaccucugucucccggggccaagcaauucucaugccucagccugcuaaauaccugggauuacaggcgucugccaccacaacuggguaauuuugcauuuuuaguagagacaggguuuugccauguuggccaggcuguucuugaacuccugaugucaagugaucugccugccuuagccuccuaaagugcuaggauuacagaugugagccaccacaccagcuugaaagaauuacuuaaaaagaaccauguaagaaaaaauauaucugcugggugcggugauucacacguguaaucccagcacuuugggaggccgaggcaggcggaucaccugaggucaggaguucaagaccagccuggccaacauggcaaaacccugucucuacuaaaaauacaaaaauuagccaggcgugguggcgggugccuguaaucccagcuacucuggaggcugagacaggagaacugcuugaaccugggaggcggagguugcagugagccaagaucaugcuacugcacuccagccugggugacagagcaagacucugucucaaaaaaggaaagaaaaagaaaagauauaucuauuagaaauauuucagccgggcacgguggcucaugccugugagccuagcacuucgggaggccgaggcaggcggaucacaaggucaggaguuagagaccagccuggcgaacauggcgaaaccugucucuacuaaagauacaaaaauuagccaggcaugggggcaggagccuguaaucccagcuacuugggaggcugaggcagaagaauugcuugaaccugagaggcagagguugcagugagcggagaucacgccacugcauuacagccugggagacagaucaagacuccaucucaaaaaaaaaaaaaaaaaaaaagauauauuucugaauguaaugauuuucucaauaccauaagauugcuaaacaucuuucuccucucuuuuuaaauaaaagcauaucacucauuacaagauuacuuuuaugcaaucacucugcuauuucaguaagguuagaaucuuaaaugcacuuuacaauaaaaauuuuagccaggcguggugccucacgccuguaaucccagcacuuugggaggcugaggcgggugggucauuugaggccaggaguucaagaccagccuggccaacauggggaaaccccagcccuauuaaaaauacaaaaauuagcugggugugguggugcaccacuguagucccagcuaguugggaggcugaggcacaagaaucucuugagcccaggagguggagguugcagugagccaagaucgcgcaacuccauuccagccugggugaaagagcaaggcucugucucaagagggaaaaaaagaauuuuagucuagcuguucuggaauucugauccagcaaaucugacugaggagaucuauaccucuaauuacuaaauuuuauuuauguaagcucaauucuuuucuaguggcaaacuaaaaauaugagauuuaucuuaaaaaaagaaaaucuaaaacauaauggaacaaaauacaugaaacauucacuugcuaauauaaacugucacaugacugucacaaaaaagucaaagacaucaagacauauuccaucuauuccucuauucuuucaugaaaaauucucauuccccauuaugccaauaaguaaaaagucacacaaaaaaguuauuaaaauguuauuuaaaaaauucuucuuuuucaggguucauaaauuuauucaauggaucaucaaugccuuaagauuaaaacccucauauagcauacauuuuaaagaagugguucuuacauagcucucuuaccucucuccuauaucaaacuacuuagaauuucuugaaugugccauguuuucucauacuucucuacauguguuuccacugcuuguaacagcuauauucccuuucuauacugccuaaaucaugcuuguuuaagaauuagcucaaguacuuagucuucugcagccuucuaccuuaaaugaaugcucaaagaauuuauuuuguacccucuaugauuacgccacuuagcacacuguaacugcuuacugacuuuuuuuccugucaaggaaacuguuagcuaccuccuuuuagcccucagaagggacaaguuccuccaucuauuuuguaugaauccaacaaauacaugcuaacuauacugauuccuuaauaaagagauaaguggacucccuugaaaguaguccuuuuuauucccaguuuauaaugcagcuuuugcaaccauuuaccaucucagaagugggaucaaauaucuguugcacacacauuucccuucauucacaauguucuucaaaaugauucagacuuuagaucucccuacucacuaugugauuucccuacagauaguguaccauucacacaaaaagacugacuaguauuuaaguauucaauaaaccauaaagcacuucagcaauguuuauuuuauuuuagaaaaauauuaucccuacacuuugcuaugauugagcuauaucauaagguaaaaaaaaugugaagcuuuaguuuucacuugauaacuuuagcuacuguauugauaauuccgguuaaaugcaauaaaaauuaugauagauucaagacuauucaagaaaaaaauacacaguuuccuuuuucuaagucccguuccacucugugguaagaauaauuauccauaguauuacacaguaauuacaauaaggagauccuugcaauaacaaggaucuccaugaguccaacaaaccugauuaaaugaagguccuuucccauagggaacuuuugcuacugaugguugggcagguauuugggaagaugauuuaguguuggaaacuucaucuguuucuuuuuuguuuucguuguuuucagaggcuuuugaaccuugauccucacugaaaaaucaaaaugcagaagaaauaaaguggaccaacuguaucauaaguacacacauuauuuuugcaauuaaaaaaauuauuucuguaugguuucuggggggggaaauguauuaaggaaugagaugggugugugacccauuagugcuaauuuguucuuucaauaaauauauacuaugaaagugcaauacaguaguugucaaaucuaaacacacaugucaggcauauauccuggcaaaagaauauaaucacaucauuuccuaucuccucuacauaagaaauacaauccaaauguaacuggguaauauuggaauuauuauuuaacugcauucuaauuuauucugauuuaauaaaaagauaaaucaaacuacaguauuuuuucaaagccacgacaaaccacagguaucucuuaaacgaucauaaaacgauguuugucacaaugccauaacugaaaaauuauaccaaaugugcuuccaaacuuccauauauuuuaaaagcccaacuuuuaugauauauaacccauauauuccugacuggugcuccaauauuccagaaugaaggaaaaagaaauaaaaagcuccccauuuuccaaggcccuaaugcaguuuacuaaguuuuaagaaaucgaggaccugaaaaagcuguaguaacccagggaauuauucuccaauuuuguaaauacagaucaggucaagcaaguaacaguuuaaaaaauuguuccuaauaccaguucucaaaagaucuccaaacuaggugccaagcaucuaaauaucuuuuuuuuuuuugagauacagucuugcucugucacccagacuggagugcaguggcaugaucuuggcucacugcaaccuccgccucccggauucaagugauucuccugccuuagccuccugaguagcugggauuacaggcaugcaccaccacgccuggauaauuuuuguauuuuuaguagagaugggguuucaccauguuggccaagcuggucucgaacuccugaccucaagugaucugccugccucggccucccaaagugcugggauuacagaugugagccaccgcacccagcccuaaauguuuuuaaauaaacuuucuugagacgcaucaaauuuuaauuccuugauuagcuguauacuguauuaaucuagcucauuaagcacccucuauucaguaaaacuucugagaauauauaaauucuacaaauaacaaacaauugucuauuaacaaagcuucuuugcauaaguagcuaauauuguaucaacaaauucauacuguuauuaguaaaagauaucacaacuuaccuguuauucucuuuaggacuguuacuuccuuguucaucaucaucacugaaauucaguugcucuguauaaucuacuuccaucugagcaccuauuaaauuaaggaaaacucagacuggcugcuugaaagcaucuaacaauuuaaaggacuuaauuaauuuugccucuuaccugcccaaccuucaucagcuucagcaucuagguuaucaaauuuaucaagcuccuucaguucugaugcacuaagaauggaugggcguucaggcucagaggcccaugaaggaggugggccucuuccucgaaggccucuaaugaaaggcaggucauggaaaagauacaaaaguuuaugauacuaaacugggagaauacuaaaagauuggaauuuaguucauuucaacauuaguguuuucuacaccaagauaccuaauauguucugcauggacauguguaugaaaaaauuaauauuaauacauaaugauaggauaauacguaacucuuaaguaacagcugacaaaguuuuuaagaauucucaaauauuuaagauaaaacaaauauguuaaaaggauaacgauaugaauaaaacuaacuucaaaauauauauuuugaggaaaauaauucaagaggauguucaagucucauauaauaagcaaaaaaaaaaaaagaaagaaaauggggaguccauaauaugaaaggaagaagagaaaaacaagugucaucaauuuuagggccauguuuuucaguuuucuuuuuguuuugagacggagucuugcucugucgcucaggcuggaguguaauggcacaaucucggcucauugcaacuuccgccuccuggguucaagcaauucuccugccucagccucccgaguagcugggauuacaggugcacgccaccacguccgacuaauuguuuuguacuuuuuuaauagaaacaggguuucaccaugcuggccaggcuggccuugaacuccugaccucaggcgaaucgcccaccucggccuuccaaagugcugggauuacaggggugagccaccguccccggccugguuuucaguuuucaaaauccuauguaaauuaauuuaaaugcuuaaaagaaugaauuauuucuguucugucuuauaagaguuagccaauuauuuacuaaugacaacuguacugugaggauaggaaaacgaucaauuacacaacucagaaucacacaauccacucaaccuucaggaaaucuuaacaagcauauauuccuuacagacuuuaaucauuuaauagccuuacuuguuuguuucagauaaagaaggugggaaucucaugggaccauguagaggaggauaugucauccucggauacuguuggaacaucugaaugaaggaaacaaaaaauugugauaaauuuagcaaccuaguuauuuuaaaaaauuauauauauauauaaaucugagccuaggccugaaguuacaauuuauaaaacaaugauuuaagugaauaaaacuauuaaugacuguuaucuguucauccucaauagcaacccauuuccaaggccauugccacuagcaacucuuuauaaauagaauaacuagagcacauaugaaaaacuucuguauuauauuaauaaaauuacauuaaaguaacuaucaacaagauauguacacauuaaaguaacuguaucaaugagauauguaauguaaaauuacauuaaaguaacugugucaacaagauauaaauuacauuaaaguaauuguaucaacaggauauguacacacaugcacccuagcaaacggcaaagugaaaauauuugaaaagcaaaugcuguuggccuuccuccauaagcaggaguagaauaaucagaggcagauuuguggauaaggaggauaacaucaguccccagccccagcaccucaaaaagaaaaauguagggguggcaggcguggggaagaacucagcucagauaaaauuaaaagacaguccacaauccaaggaagugaguuggaaaagggggacagagagcuacccagaaauuuucuauguauauggcauaggugaauucucaaucaaguuacugcacagaugaucauuauaaacugucccaaacagguccagauacuguucucuguaggaacuuggcucugggaaacuaaacuuaagagaagacauaagauagauucugggaacaaauaacaccaagggauucauccuaugauuuugaagggaagaagggucaaagaaugucuuggucauugacuauaugcuuauauccaagucaaauuauguaaauaauaggaaauuauauuacuguaaaaacauaauuuauauccugaaauagaagacuaguuuuucuaaaaaguaaguaguaacuguguguuagauaagaaaauucuuacauuugaaguaaggcuauguuuauaugauuaugcugucuaaagaagaaauuucucagccaggugcaguggcucaugccugcaaucccagcacuuugggaggccgaagcggguagaucacgaggucaggagauggagaccauccuggcuaacauggugaaacccugucucuacuaaacauacaaaaaaauuagcuagguguggugggcgugccuguaaucccaguaacucaggaugcugagacacaacaaucacuugaacccaggagguggagguugcagugagcugagaucgcaccacugcacuccagccuggcaacagagcgaaacuccgucuuuauuaaaaaaaaaaaaaaaaaaaaaaggagaagaaauuucucuuaagucagguugaagcaauguuaauuaagucaagcaacagcugaaacucagcuggggaaacuuugagggauacucuggagaauuuucaguugcaucacacuucuauacugaaguuaauaaagacacuacuggaggcauauguucauagcuaaaguugcauuaaauccuucaucuggucauuccagacauaauuucauguggucuuaaaaaaugcuuaaaaucuaggaauuugccagaaaauucauuuuagaaacaaauuuuaaauucucaguauacaguagugauauuuaaauguuuuuguuaauuaguggaacacuuuauucaaauauaaucacugaugaaagugggaaugaugcccacgugguuuccccucuuuccuauccuacccucucacaugaaaguucaggggucuuugguagcacaauuugaaaaugauuagaaaaaaaguaauuggguauaaaucauuuuucaaggccaggucagcauacucccaaacuucuuuuaggaaaacguuuaauggccaggcacgguggcucacgccuguaaucccagcacuuugggaggccgaggaggaaggaucaccucaagucaggagaucgagacuagcccagccaacauggugaaacccugucucuacuaaaaauacaagaauuagcugggcgugauggcgugccccuguaaucccagcuacuuggaagguugaggcgggagaaucgcuugaaccugggagguggaggcugcagugagccgagauggugccacugcacuccagccuaggcaucagagcaaaaaacauuuaacaaguaauuguauuuaaucauucaucucccucuguuagucuagaaugauuaaaaaauaguaauguauaugcucacuuuggcagcaaaauuggaacaauacagagaagauuagcacagcccccgcauaaaaauaacauacaaauucaugaagcauuccauauuuuuaaauaaaaucaacaauaugaaggaauggaaaguaugauggauauuuaggauucaaauauuaggaguuaaacaacaaacuaaauaaauaugaccuagauuuuuguuuccuaugagaguaaugagucuucuggaaaacuaaauggauguauccaggcacaugugacuuguuuuacaacuucacauugggcugaaaguaaacaaagaaugaggacaccaaaucuaacuaauaauuuagaaaauguggugggagggcaggggugggugccagaguauauaauaaaugaaauuaaagauaguaucaacaaaauccaaaaucugaggaacuucacagguuaacaaauuauaacagauaagcuccaaaggaaacaggagauagaaauaucuauagguaacaagauucuuaaaagaaauaugaaccaaucucaacgaauggauguugccuggauccuaauuaugagacaacuacuggaauacuaacauaauauuugagaauaucaaggaauuaguuuucuuuuuauguauaacagcauugcaaaccuucuccccaagucuuuauccuuuaaaauagaacuuaaaauauuuacugaugaaauaucuuggauuugcuuuaguaauccaaagugguaggaaaagagcgggcauggugacucaugccuauaaucccagcacuuugggaggcugaggcggguggaucacuugacguuaggaguucaagaccaaccuugccaacauggcaaaauccugucucuacuaaaaauauaaaaauuagccagguaugguggcgggcagcuauaaucccagcuacucaggaggcuaaggcuagguuaacugcuugaaccuaggaggcagagguugcagugagccgacaucaugccacugcacuccagccugggugacagagcgagacucuguuucaaaaaaaaaaaaaaagugguaggaaaagaggcagauucauugcacuguuaucuuuauuuuuguacauguuuaaaauuuuccauuaaaaaaaguuuaaaggccaagugagguggcucaugucuguaaucccaacacucugaggggccaaggugggcagacuacuugaugccaggaguucaaaaccagccuugccaacauggcaaaaccccaucucuaccaaaaaaaaaaaaaaaaaaaaagccaggugugguggcauaugccuguaauuucagcuacucgggaggcggaggcacaagaauugcuugaacccagggggcagagggugcagugagcugagaucaugccacugcacuccagccugggcgaaagagcaagacucugucuccaaaaaaaaaaaaaaaaaaaauugaaaaaaaauugaaaaaaaauugaaaaaaauauuaaaaguacacaaauaaaaacuuugaaacuacggcaaguguucuuuaucauuuuuuccaugaaccaccccuuuggcagucugaugaauccuauggaccuauggaccuccucucaggaaaacauuuuaaaugcauaauguaaaauacaaaaauauugcaaagaagaacaauuauauuaaacagaauguuaguguaauuguucucuguauuuacaaaauaaaucugugguaugguaacguacgugcuucuuuauuagaucauuaucuaugggucuaauaauuauuuugaaguaauguugaauguaaugugauaugaaaauaucugcaaucccugguaauaauaaagauacugcugauuuguuuccuaucugguacaacuacacuuaaccaaauaaaacagcuagguguuucugcuaagaaacacugcgugguaacguuucccggauagcccaaaugaucucuaucuucugguguuuacaccauguguagucccuucucacaauauaccauacaauaaaagagaaugcuaauuuuuaguuagauguuaaugaaaacaaagaccuaaacuuuucccuauaacaauucgcuccuuggaccccagaucaaaaaccacuuguuugaaugcuuguucauuuaacaauacucacauaaggaggcaucauagcucuauacugggaagcgagagcagccugcuguccauucaguuuagccuguggaggaccacaagcuauccucuuuuccaccacuuugaggauaucauuuugcucugauguuccagcugugcuuucauccuggccagggagcuuuucaucuugaucagaugacgaaggugagccagcagccuuaccaccaucucuccaacaagcaacaucuaguaugaaggcagagaaaaaaggaaaaagauaaaaaucugaaaauggaacaaagugaaaccaaaauguauuucaggaaaaugaaagcaaguaagcagagugaaagagcaggaaaagucuaauccagguccuacuaaugcuuucaaguuguuugcguaguaguggcuuccaaaguggagaggauguaccucagagggugucaccacaagcaaauacuggggugggagaagaaaauauuagaacuucucuaugaagcuuuaucaauauuugguauagaaauuaaaaucacuguucuccauauaucagauggccauguuucagagugacacaccugagguuuccugagggaaggaagaugggacuucuacaaucuggaaggguugacagugauauucucauuugucuguuuccaguauauuauuguuaguuacagaugcccccaagugaacagauugcgugaaauuaucugguguaauuacacuuaaccaaauaaaacagcuaggugguuuugcuaagaaacacugcaugguaaccagucuccuggauagcccaaaugaucuuuaucuucugguauuuacacuaaguguagucccuucucacaauauagcaggguuggucuguguaaccuguagaauauggcagaagugauagcaugucccucuccagauuaaguuauuaaagacugugggcuucugucuuggguggagggugucugucucucaucauuuauucugcagaagccaugucauaagcagccccacuaagagaccaugaaacuaaagagccaagagcuacaccagucaguuuggaaguacagccccagucaagucagcuucagacagcuucaucgcggcuuugagagagagucccuuggccagaaccucaaacuaagcugacccuggauuccugaccuucagauacagugggauaucauaaguauaguucaguuuguuguuuuacauugcuaaauuuguuaugcagcaauagacaacuggugaaaauucaacugaacaaaauagaggagucagcacaucuauuucuaauacaaaugcaccaaccacauuaugacgcuugaaaaauaagauuuagauuuauuuacaucugacaagagcuaaaaaaugugaaauacaucagguuuuuagaaauauggaauuuguaaacacuucugucauagacgaaccuccccauguaaacaagguccuuuaagauacuugguaaugacaguaugaagcuaucacaauuaagaagacauuuaaaaaucccucgaacauuuuacacuuuuauuuuuaguuuuugcuuuguaauguacauaaacuaucccucauuauccaaaauuauuuguuuccucaguuugagcucagaaagugaggaaucaccgaauauuaauacaguaguaaguaaauaguuacacauuagggaagccugcucaaaaacuaguauaaaaaaauccaaauauugguauacaugaaagucaccuggacaucuuguuaaaauguagauuuugauuuaguaaguuggaugcgaggcccaagaugacacauuucuaacauguucucaaguuacagugauacugucggugcaaaaaucauaccugaguagcaagugacuauaguacaaagucugccuuuucgaaguaggcaaauaauauaugcaacagcaagcaggagguuguauugcaagauaauacacaaauaugaucucauuuuguauuaaagagaaaguacucuuacuugguggacguaaacuggguccagguccauaguugucaucauuuguuuccuuuucuuuuuuuuccugauccccagcugccugcaggcugggaaauucuugcugaaacugacuauucacuuggauuccuauagauuuuuuuaaaaaaacauuaaagguaacuuuuauacugaagauaauacaaaccacccucccaggauagagcucucugccucuuucucuuaaauuauuccacauuucagugaugacuguucauagccauaucacuuuaaaauucaccuagacuccuuugaaaagcuaaugaucagccaugaggagaugaaagucuaagacaguaaucuaccaguaccauuccagaggacucauuuaagaugaccaugcaagugaagagcuuguuucucuuucauuaugacuccuuacauuuucaauacacaucaaauuccucugcuaagaauucucagaauucguucaaaucauauuacugaaauaguguuugaugaauaaagaccccaagaucaagaugaggcuaaaaugccuuuauuuaauuuauugcuucauuuacuuuacuuugauuuaauuuacagcuaagauuauuacaccucacuauucacccaacuuccuaucuaccuauuuuuuguacuucuauaaauuaaaacagcuaguuuuguuagcuugagggcccagauugguucuuccauagaauguuuuauagacaguuccuguuucgaaagugggaaaacuaaauucugcuggggauuccaucauuccuugggggaaaggggaauauuacagcaguggugcuuuauggcuacuuucuagcucuucuccucucaggaaucguggcagcaugucugaaacaggagauguuggggacauagaugaaaaaugaguaugguuucuaacaaucuaugcgauggcuggauacuuugaagguacaagcuuugcuuggauaugcagagguaaagauaaaaugauguggggcacaggguaucuuaaagacuccuuuccuuaaccaauaucauugacucauacauggcucuugacauuggaacuuagcuagcccaagagauuuuuuaaaaaaccuuuuuaagagccuugaguauauccuuuaacaaugcuuuauggcucuaccaaaacacaguucaccccuuaucuccugcauggcuguucaguaacuaucaagccuaggcagcuuccccaacuaauguccacuuaccaucuccuugcccaccuugcuuguuacuggcccaugauuugggagcaggugcuacuucugggggagcugcaaccccagguuuuggcugugcugguggcacuucugguguucuuaaaaaaaaauaugaauccauuauuucagauacuguauguuuaaauaaaaucaauauuauauuuaagguaaaccuguguacaaauuauuuuggcuauauguuuauucauugguaaaucuccaauaaauguuuucucucugcaacauuccuuuaaaugaauuauggcuauuuuuaucgucuuucaucucuaccuuugaauaacccaaugagaugaguuuugcuuguuuuccauuuuguuuaaaacacacacacacacacacacacacacacauacacacacacuuuuaauuaaacacaguuaccaaauaucuguuuugaagaagugaacacuuauaauuaaaaauagcaguauaaacauacauacagucuggacuggugaaauuaguugagggcuaaagcuaagcaaacuccccaccuggcagucaacaggaucaccacuguacuuacuacuguuauucaaagagguaacagcaaccugccuaaugcauucacaugaguaaaagguguuuugaaaggguguacaguuuuauucaauucuuguaaugagguaaugcuuaaaaauaagaaaguaguuaagaggcucacaaaaugcaauguguuucugggacacucauaccuauaacugacucauuacuauaaaauaauuuuacuacagcuaacaagcauuuacguauuugauacauuacuacagaaguagucaaauuuacuauauaaaucuccccaggcaggaguauagaauuuugauaagagauaggcaagaaaacaucaaguauccaauggcuugucuuauuuuuuuuaaauuaccacuauuuaggcuuggucauucaauuagcuaagagucuggcaaaauccuugacauacagaagucuaaauaguuguugaaagaaggaugacuaagauggacacuauuaauucuauccuaacuuucuugcuacaguauauacaaauuauuacuugagcaccuaugaaacaucaggcaguuucaaugcuggagauacacaguaaauuggcagacagacauccuuaguaucauggaauuuagguaucggagucaacucuuaaucauauuggaaagggaauaccugaguuggugguaguaugaaagcggggagccuaauaaaggcuaugacauaagcaagguugugauucccaauucugucaucuguucuacccugacaaauugaaauacuuuuaauagggaaaauuaaccaaaaguuacuauagucaaaagacuuuaaagaguauaaaauauguaauauguaauacagacagcauaacacuuagcaaauagcagguacucaaacauaaguucccuacaaagaaaggggaagggcuucauucuuuaacagacuuugacucacuuuucuucuucauguugcucuuguuuugaugcccacccugugccaucuuuagguacaauguuuacauuaggaucauugccuuuguuuucugcuuuaagacuugggagguuagcagguggaggcauacgccgugaaauaccgacuuuuccaagacucuguaauccaugucgagcugcaacuaaagaucaauaacaucaacuuucuuagaacaucuauuuuauuacccauuuuauuccucaaacaauauagaaaaacaauaggaauuaaugcaaucccugaaugauuuucauucauguauuuuaaaauaauaauuuuaaaacuaagcuacacaccugcaacacauuucaguguagaaaucaagccauuuaacagcauuuaacagauuccuuaaaaaauuuaacaaugcaauucaacacacuacagaaaacauugauaauacugauauuuuuucagagaaucuauuucaaacucaaaacuuagaauguuagagaauaaauguauugacuguauguucauaaagaauacuguuaauaugccaugcaugauuuucaguuuucacuauauucacuaggucacaguaucuaacacacacacacacacacccccacacacgaaacauaagacuuucucuagucuauaauuaaaaagauacuaaauucccacuaauauauaggucugugccuaucaaucucauugacugaguuuccccuuuagagccacacaguucuaccuuuuuucugcugacaacagagaaaaacaaaaauauuuuuaaagggcucuaugaaaguauaaauuuucaauuauaagauguuuaucacauauccucugaaaaaugugugcaugcauaaaaacgcaaauguaaauagcauuguauuaacuuggguacauccuagcuucucauagcagcagguguaucacuuauaguaacaaaacaaaccaugaaaaacauaagugucacuugauuuuacucaccugugguuuucuguguuucuaaugauuuccccuuguaaguauuaaauaaacugaguguugcauacuuuuucccauccuuugcuuuugugcucuggccugacuucuccgacauuucgguggaaacucaucgaguccaaaaccuccugccacaccccuuaaaaccccaguccuuaagauguacauaagaaagaaaaauaaggaugaaaaacucaguaaauucaaauguucacagaaauucugaaaaaacuucccauaucaaugauaauuucauagaacuuuuuaacugucaaauuccaauaaccaauacacaacaaaauugaucacaauaagcuaucaugcacuugugaaacauaucaguuauauaugguuauaacugcuuaacucuaucauagagaauaaggguuauaauuccaugcugucgugaauaguuaaaacacagugaacccacugagacugucuauuuuaaaaagauauauuauccaauuuaauaugcuugaaaugacugacacaucaaccuaugcacauggaauccaaaugacaggacaacaucuucauuccccuacauauuacaucccuguaucaucaucaggcaguaugugcccaacaaagcucuauuaacuuuaacaguuuagaacagaaacaacguucuauguucucuucauuucguaaaagguaaaacaucucacaaacacaagguauauaaaaauaaccuauuucaucacugaggacuaaauauucaaaaaauaguauccauuuuuuucaaagcauauauaaaguucccuuacauaugagaaguuguuagaaauaaauaacauuuucauaagcauucaaauacaaagagaauccucaucuuuagagcuaauguacccucaucuuggugaugcacccuaacuuagucuauuaauagauaggcaaaaaagaaaaauuaugucucaugcuauuucccuucaauuuaauuaaguuguagauacauaucaaccuaacgguuguuuuuguuuuuguuuuugagggguuauuguagcaguaggguagaagauggcuaauucuaccauagaaacgaucaauagcugaaaacauugagaacugaaacacaggagccaaagauaguauagaauagguauaccaagcaaaaagcaucaaaguaaagccuauauccacuuuacuuuuauaaauuucguuucauccguuaguuuuauauuugucaauuacagaaucagcagagaugucauuuuauaugcauguaaaaugccacccaacguuuguauaguuccauaaaauuuaucaggcauucucaccucuauuaucucauuucagucaaacaacuuuacaauguaguuacugucuugauuuuuacacauaaagacuaaaucagauugaauuugaaacuagggugucggguucaauccauuacacuaugcugccuccucccacauaacaguguagauaaccauuucgcuuuucacguauacguuuacaauaaaccaucuuuccuugagacaaccgacaaccugaaaaaagacugaccuacaaccaauaggacuacacuaauacaauuugcuacuauauguagaagaauguauacaauuaauuuuaccccaagaccgcuaaugaugaugauguugugaaaagagaauguacuaccaaaaucuauccuauuggcaaauuuaccaguaacauguacaaagauauagaaagaauauucaucuacagugacaaaagaggacaguaaauauucacuaccugacaaaauuaaaauucaaagagcuuuuucaucaggugaaaaaaaaaggaacugauguaucaagaaaaacagucaacuugcuuaaguuauuuaacuaagaauccugaaaucuuggacuuuucugaacaccauuauuacucaagcagcacucuuggugaagacccuuucuguauauuagagagaaagcaacaucaugagaaaagaacuccuuaaacuuccuaggagcaaaucuccaaaccaaccuguaucuaacauccaaacuuuccuuccuacaccuacugcuacugcgguucgcagaaccauguuucuggccgggcacgauggcucacaccuguaaucccagcacuuugggagacugaggcaggcgaucaccugaggucaggaguucaagaccagccuggccaacauggugaaaccccgucucuacuaaaaauacaaaaauuagccaggcaugguggcaggcaccuguaaucccagcuacucgggaggcugaggcaggagaaucacuugaacccggaagguggagguugcagugagccgagaucaugccacuguacuacagccugggugacagaccaagacuccgucucaaaaaaaaaaaaaaaaaaaaaaaaagaaacaauguuucugagacaugugauucuagagaaaccauguuucucuagaaauaggauaaaaaugaaaauucucaggucccaacccagaccuacugaaucaaacucugaggaaggggcccagcacucuauagcaagucuuccagauugacuaagacuuacaaaaauguuaagaccuaccgacuuauuauaagcagauauauucuaagcagugauucucaacucuugcuguauacaaaucugggggcaggggggaaacugggcaucaacucuuuuuuaaaaaaaaaaauucuucaggugauucuaacugaaaguaguuugagaaucacugcaauacagaaaguuuaucuuucuucucauuccauuuaaggucaaucuuuccucuagugcucuucauccuauccccacuucccuucuuaucuaaacucuugucuaggaaaucucauuagcuccuuuggcuucaacuacuaacugauuaccuucagcucaguacuccugaggaauauauccccacacugccuguuuacauuucuuuguuuugaaugaaguuucacuuuuaacuagaacagaggcaucuauuucauggcaaaacuuuaagaagcaagccuacuaaacauucuguccagcauaagagaaaaauaaugguuaaaaaaucaaauugggccgggcacgguggcuuuggccuguaaucccagcacuuuggggggcugaggcagguggaucgugaggucaggagaucgagaccauccuggcuaacacggugaaacccgucucuacuaaaaauacaaaaaauuagccaggcaugguggcaggugccuguagucccagcuacucgggaggcugaggcaggagaauggcuucaaccuggaaggcggagcuugcggugagcagagaucaugccacugcacuccagccugggcgacagagcaagacucugucucaaaaaaaaggaaaaagaaaaagaaaaaaaaaauuaaauugauggucagugaagaaaauaaucaacacuugacaaaauguaaauauguuauaagaacucaacaaaucaaagcagcccaaagaguaaagcuuugaacagacaauucacuagagaaauguuaguaagcaagcguauuaaaauguccaacguuacaacuaaacaaaaaucaaaauaaaaugucaaguucagcuucuccauauucuuaugaaggaacacaaaguaguaauacacaauuuaaccacaggguuauagaacauccgauuuaacucuagccaucgcagaacacucaagcuuaaaagaaucauaaaaugaaccuuaacuucccuacuuaaaaucaagacaauaccaauccuucucaauaacacauuaaaccaaguuugauuuaucccuagaaugcaagauugguuuaauauaugcaaaucaaugugauauaccacaguuuaacagaaugaaaaguaaaaaccaaaugaucaucucaauaaaugcagaaaaccacgugacaaaguuuaacauccuuucaugauaaaaacucucaacaaaacagguacagaggaaaauuccucaacauaauaaaggucauuuacaaaaaucccacagcuaacaucaaaaucaaugggaaaaaccugaaggcuuuuuccugaaaucuaguacacagcuagaauguccacuuuuaccauuucuauucaacacagugcuggaaggacuagcaacaacaaucagaccaaaaaaaggaauaaaagguaucacaaaucagaagggaaguaaaacuaucccuguuugcagaugacaugaucuuuuaaguagaaaacucuaaaauuucacaaaaacuguugaaacuaauaaaugaacucaguaaagcaacaggauacaaaaucaacauacaaaaaaucaguugcauuucuuuucacaaauaacaaccuagaugaaaaggaaaucaagaaaacaaucccauuuacuagagcaucaaaaagaauaaaguucuuaggaguaaucuaaccaagggagcaaaauacccauacacugaaaacuauaaaauauugauacaagaaaucgaaauaaauagaaagauagcccacauucacagauuggaagaauuaauauuguuaacaagccagcaaagaaagaccugagaggaucagaggggaacagugccugaaguucauaaagggcugggaauaguaccuguuucacaaccaagacuaaaaagaugacaugacaugcuucaccaggcauuagguagagauuuuuuuuuugagacagagucuaacucuguugcccaggcuacuuaaguacaguaaugcaaucucagcucacugaaaccucugccucuuggguucaagugauccuccugcuucugccucccaaguaguugggacuacgggcgucugccaccaugcccggcuaauuuuuguauuuuuaguaaagaagggguuucaccauguuggucaggguggucuugaacuccugaucucaggugauccaccguccucggccucccaaagugcugcgauuacagacgugagccacugcacccaacccagguagaguacugagcaaagccuugccuccagcagugggugaaaauuacccuaauguaaauacugcucugaucuugucuaacaaaucuuuucuucuuuuuauguuaaauaaaugagauggagucucacuauguugcccaagcuggucucaagugauccucccaccucgguucuucccaguaggugggauuacaggcaugugucaccacaucuggcuugucuaacagaccuuaaagcuacacuugaaaagaucaaacaguuucccaguaacuuaacugaaucccagaaucaagggggguggggaggggaaucaagcaagugaaaccaaccuagucuugacuauugauguuagaauuaguggacaaaaauguuagaaguuauuuuucuuaugucaccuugucuaagaaaaagcuacuuuauaacuguauucuauauguucaacaagcuaaagauugaauacaaauagagacacaaaagacaugaaaacaucaaaacauagagaaaaaaauacaccaauugguauuacuagcauuuuagacacacugccaaaggaaacaauacugcaggcugcaacccuuuaugaaaaagaaaacuccccuuuccaauuaaaacacacacacacacacacacacacacacacaaagaaaaaaaauagugaaucugaagccaucaauagaagcuauccaaugggaaagauaaaguggaaaaagcuuaaaaaaaaaaaaaagaccuuaagugaaccuuaagacaacuucaaacagccuaaucuauguguaauugguguuacacauagaggggcuugagaaagugaaaaaacaauggccaaaaugguacaaauuugaugaaaacugcaaacccagauccaaaagacucaacaaagcccaagucuaagaaacgugaagaacccacaccaaagcccaucauaaucaaaguauuuaaaaccaaugauaaagagaaaaucuuaaaaguaacaagagaaaauguugcuuuacauacagagaaacagaauaacagcagaauccucaugggaaaugcugcaagcaguagagcuacaugcuuaaaguacugaaagaaaaaauaaaaacagaauucuacaugcagcaaaacaucuuccaaaaauaaaggcaaaauuggcugggcacgguggcucaugccuguauucccagcacuuugggaggcuaagguggacagaucacuuaaagucaggaguucgagaccagucuagccaaaauggugaaacccuggcucuacuuuucaccacugugucaucauaguguguacuuacaaauguagauggcauagccuacugaacaccaaggcuauaugguauagucuauugcuccuaggcuucaaaccugcacagcauguuacuguacugaauacuguacacaacgguaacaaaagcugaaauauuuguauaucgaaacaugucuaaacauagaaagcguacaguaaaaauaugguauuauaaucuuaugaggccacugucauauaugcggcccacuguugacugaaacaucguuaugcagugcaugauguggaugcagaaaaacuaucugacaaaaaucaacccauuccugauuugaaaaacagaaacaaaacaaaaaccucaauaaauaggaauagaagggaacagucaaaaguuuguaugcuugcccuucuguucccuucaaugaagagaaaugagguaaggauauccacucucucuuaacacuucuuucuguucaacacuauacuaaaaguuccacccagcaaaauaagaaagaaacaacaaaaaaaaauucaaauuggaagggauaaaguaaaauugucuguaauaguuagcauuauaugaucacauauguagaaaaucugauaucuuaaaaaaccuacuagaugggaguuuacaagagcauauaagaucaauacacaaaauucaauuguauuucuauacagcacuaaacaaucagaaacagaaauuacauauagugccauuuguaauagcaauaaaaaaugaaauacagccggacacgguggcucaugccuguaaucccagcacuuugggaggccgaggcagguggaucaccuaagguugggaguucgaaacuagccugaccaacauggagaaacucugucucuacuaaaaauacaaaaauuagccgggugugguggcacaugccuguaaucccagcuacucgggaggcugaggcaggagaaucacuugaacccaggaggcggaguuugccaugagcagagaucgugccauugcacuccagccugggcaacaagagugaaacucugccucaaaaaaaaaaaaaaaaaauugaaauacuuagggauacaucugacaaaagauacguaagaccuacacauugaacacuacaaaacguuauuuaaaaagcuacacaaacauggcauaagaacuuaugccauguucauggaucacaagacccaauauuaagaugucaauuauuuucaaguuuaucuacagauucaaagcaauccccaacaaaaccucagaagaaauuuauuggaggacaaaaguugucaagcugauucuaaaauuuauaaagaaauggacuggcucuagaacagcaccacccacccccuacccuccaccccgccagcuuugaaaagaaugaaauuggaaggugaauacuacuugcuuucaagacuuaaggcacagcaaugaagacagugugguacugguguaaaaauaagacaaauaguucaguggagcagaauagagucuagaaauauaaauacacauaagcauuugauuuuugacaaaugcaaagaaauucaguggauaaaggacagucuucccaaaaaugauacuggagcaauuauguguacauaauauuaaaaacuuaacacugauucauaccuuacaccauauaugaaacucaacucaaaaaugaaccauagacaaaauguaaaaccugaaacuguaaaacuuccagagaaaacauagaaaaucuuugugacacuggguuuagauaaggacuucuuagauauaacaccaaaagcacaaucuauaaaaaaugaaauuuauaaacuggacuuuugcuuuuugaaagauaauguugagaacuaaaggacaaacuagagucuggaaaaaaaauugucaaaucauagaucugagaaagaacuuuuaucaagaauacauacaaaacucucauaacaaccaacccaguuuuuaaaaaucggcaggagauuugaagagacacuucaccagacauauacaaaugguaaguaagcauaugaagauacucagugauaugguuuggcucuguccccaaccaaauuucaucuugaauuguaccucccucaauucccacaugucaugggagggacucgguggaagguaacugaaucauggggacggguuuuuccugugcuguucuugugauagugaauaauucuaaagagaucugaugguuuuauaaagggaaguuucccuguacaaguucucucucuuugucugcugccauguaagacgcagcuuugcuccucuuugccuucugccaugauugugaggccuccccagccauguggaacugugagucaauuaaaccucuuuacuuuauaaauugcccagucuuggguaugucuuuagccaugugagaacaaacuaauacacucagcaucauuuguauuugggaaaugcaaauuuaaaccgaaauaaaauaccuccacacauccaauacaauugcuaaaauuauagaaugauuauaucagguuuuggcaagaauauuaaagaaccggaaaugaaaauagcaccaucacuuugaaaaacaauuuggcaguuucuuuuuuuuuuuuugagauggagucucacucuguugcucaagcuggagugcaguggcgcgauccuggcucacagcaaccuccgccucccggguucaagugauucuccugccucagccucccaaguagcugggacuacaggcacgugccaccacgcccagcuaauuuuuguacuuuuaguaaagaugggguuuugucauguuggcuaggcuagucucgaacuccugaccucagaugauccaccugccucauccuccuaaagugcugagauuacaggugugagccaccacacccggccuacaaacacauuuauaugaacauucacugagcacucuaucauuaucaauaagccuccuucuaccaccaaagguguuuaugguaaugccucuaguuuuugugcaccugcaugggaaccuaacccacaccuguaacacuguuuccaagggauaaaguauuuacuucucucuuauaugccuuugccauuggacauuaaaaccuuagauaacaaaaccaaagucggcuuggcgcgguggcucaugcuguaaucccagcacuuugggaggccaaggcaggcgaaucauuugaggucaggaguuugagaccaguucugccaacauggugaaaccucaucucuacuaaaaguauaaaaacuagccggguguguggugcaugccuguaaucccagguagucaggaggcugaggcagaagaaucgcuugaacccaggaaguggagguugcagugagccaagaucgagccuuugcacuccagccuguguacggagcaaaacuccaucucaauaacaacaaucaacguccuuuuaaggccuacuagaguaguugguauguucucuaaaauauaauuuagcaaaacaauucucuacagguuacacagaaacaagccuuuuuugguguuucagauauuaggauauguuaugaaaauacagaugaugccccugccuucauggaacuuuuaacaaaacaauaaacaaguaaauaaaaauguagaaaugaaaaacucaacuggguaaaaaggggcagcaaagagguaaaggggacuuuggauaggauagcaaagguccagaagaccucucugaaaaggggacaggaguuaaggaaaaccaaucagugguuuucaacuuaggcugcacaguuauccaaaguuuuaaaaaaaaauuguaugucaaggccccaugccaggcaauuaaaucagaauuucuugggccaggccuggcaauaguauuuuuugaaaaguuccccaagugucucuaaacuguacccacaguugagaaccacugaaaagcaaaccaauuucaaucuaagaacguucaaguguaaaagucaugucucagggagacaggcaggagaugaaaucagaguaggcaaaagucacauuuugcagagccuuggauuagaaguguuauccuugaguuuauucuaaaugccacaaaaaaagcuggguguggugguguauaccuggagucccagcuacugagaaggcaggggugggaugauuauuugaguccaagcccagccugggcaauaccagcaagacccccaucucucauuugcaauaaaaaaacaaaaaagguuuuaauggcaagaaaagccacuggaggaaaaagcuaguaaaaaaaucucaauugcugaguaggcacagaugcacucagcauaaccacauuuaaguaacaaaaugguacaauuuacauaauuaguaaucccaaaacccuugaaacagcaugcucaguagcauuugccuucagcuugccagcucugauuucaaaacccauccacacaguuauagaggauaucaaaauaaguauacccucuaccuauaucaauuuuaauuuugaaaagcuuuuuuauuacuuuuacaauguuaguacuuuuuauauuacuguccuacuagccauguaucuaaaaaucucaaucauuaagggcagaggaucagccuguaaaaacaaaaccuucugaauaacacaccuuucuuucucuguuuaaggaagagaaaaucauuauuuuaaguucaagguucuaugacugacugagcaaugcugguaagaaacuagcauuuuucauuguaauuagauguaucaaaacagguacaccucagcugggagugguggcucacaucuguaaugccagcacuuugggaggccaaagcaugcagaucacuugagcucaggaguuugagaccagccugggcaacaugacaaaacucuguuucuacaaaaaauacaaaaauuaacagggcauuguggcgggcaccugcagucccagcuacucaggaggcugaggcacggaggacugcuuugaguccaggaggucaaagcuguagugaacccuguucacacaguagcucaugaguaguaaccccagcaccuugggaggccaagucaggaggaucacuugagcccaggaguucaagaccagacugaaccgguagugagacccugucucuacaaaaauaaauaaacuagcuggguaugguggcacacgccugcagucccagcuacucaggaggcugaggugggaggacugcuggagcacaggaagucgaggcugcagugagccaugauggcgccacugcacucuacccuaggccaagagaguaagacccugucucaaaaaacaaaacaaaacaagacaugugcaucugcauuuuccauauuuuguacagcaaauauuaccuuguaacaguuuuguuuuuggggggaggaaaaaaagaaaugaaagaagaaguuuaggaggaaaaaaaggaagccagggauuuuaaagcagauuguuuccaaaaggucuaaaagaaauuuggaaggcagcaguuuaauauauacauuaaccuuuuaaaaucaaagaaugacacugaacagugauaacaaaaggacguuuuucaugaaaggauagcuauccuagauugaaacucucuggagacaaccugggcaacauagugagacugucucuaacaaaacaacuaaaaaguagccaggcaugguggcguguaccgguaguucaagcuacuuaagaggcugaggcaggaggacagccucagcagaaguucagggcugcagugagcuaugauugcaccaguccacucaagccugggugacacagcaagauugucucuaaaaaugaaaaaaauuacaauuaaaaagaagagaaaaucuggaagaaaaaagucuaagugguuuccacauuuguuaaagagauuagcuauggucucucaaauuccuuugguacucaaaacuauaagauucuaguuuuaauacugaaaaccuuauuuuaagcaauacugaaaauuuaguauauuuggaaaaauaacccccauacuucggcaaauugcaauuugcuaaauucaacugaaugacauaacuuucuuucuggccacaauggguuucuaaauauccaagcucuguuuaccguucuuuccucauuauucucaugaugagaguucaguuccccuggaaaauacagugucccccagauuuaaauaguuaacauuaaaaaugaacgacaacaauuuccagagaaguauacucuacaaguguuuuacagaacauuuguaaaucaggaaauaauguguauuaacuaauugauaauagucaaguaucacauauaaauauaaaaguuaaauagcaucuguguaaaccauuuucuuugguuuccaugacuaugacagcuuucagccucguuacuuuuuuucugucucuucuugccauugcucccuuuucuguuucgucuuuuuuugagucccacuuugucgcccaggcuggagugcaguggcacgaucuuggcucacugaaauuucugccucccagguucaagcgauucuccugccucagccuccagaguagcugggauuacaggugucugccaccaugcccggcuaauuuuuguauuuuuaguagagacaggguuucaccauguuggccaggcuggucucgaacucccgaccucaagugauccaccugccucggccuccugaguaguaaucccaaagugcugagauuacaggcgugagccaccgugcccggcccaucucucccuuuucuauuaauaagugcuuucuccuuuggccaucucaucugcuguucacugcuucaaauauuaucaguaaggacaauuccaaaacuuuccuucaagcuacaaucuuuagauacacaguuuuaaugaucuacaaaacaucacuuacauuuccuguuggaacuucaaacucaaaaugauuaguuccccuauucacucguacaaauauuuacccagugucuaccauauaccaggcacugcuaggaacagaugaacaagagacgugcuuuccucauccacugaguggaggcagaauuuagaaauuugaggaggcuggaaaagguuugaaaagcaaaugggagaaugugaaagacagccaagacauugggaagaagcacugaaagcuuaguagggcugagugucauggcucaagccuauaaucccagcacuuugggaagccaaggagggaggaaugcuugagcccaggagcuccagaucagccugugcaacuuagugagagaucuuggucucuaaacaaaaugaacaauuggccagguaugguagaguauguuuauaguccccgucccagcuacucaggaggcugagguggaagggccauuugaacccaggaguuccaggcugcagugagcgaugaucgcaacugcugggcaacaaagcaagacccagucuccccuccaaaaacaaaaaaaagaaagcccaguagaagcuggagagcaaggguauacagaauuuccaaguuugugcaguuacgauucucuucaauguccaguaggacauccagggaguugggagugguaggaagcacaaaagcagauggacugaaucagagauuagaguugcaccaguaaucaguaaacuaguaaagaaaagcaagguggaugaagauacugccagaauuucuggaguaauguuuuacugaagucuaauccagacagugaaagaaaaugguuugaaugccuauguuucuuccaaauuucaugcugaaacuuaacccccaaugcaacacuuuuaagagguggggucuuuaggaggugauugggccaugugggcucugcccucacagaugugaugugugccuuaugaaagggcuggagggaacuagcuaugcacuucugucaucugaggacaugaacaaggugccaucuuggaggcggagauccugccugucgauaacuugaucuuggacuuuccagccuucaguaccaacagaaauuaauuucuguuauuuauaaguuacccagucucaggcauuuuguuacagcagcaugaauggacuaagagaggaagucagaagagaaugaggaggagagcagaaaggacuggugauuucaguuaagguugacuaaaagcucuagcaauaaaauaguaauuauuggcagggcauaguggcucaugccuguaauuccaggaauuucggaagccgaggcggaaggauggcuugagcucaggaguucaagaccagccugggcaacacagcaagacuuugucuuuucuuaaaaaaaaaaaaaaaaaaaaaaaauuagcuggguaugguggcucaugccuguagucccagcuacuuggcaggccaagaugggaggcucacuggagccuaggagguugaggcuacagugagccaugauugugccacugcacuccagccugggggacaaaaggagaccuuguauccccccacugccccaccaaaaucugagcuccaaagauauaguauaacguaaaaauacccgauuagggccacgcgcaguggcuuacaccuguaauaccagcacuuugaaaggcgaaggugggaggaccacuugagcccaggaguucaagaccaaucuggguaacauggugagaccucaucucuacaaaaaauaaaauuuagccaggccugguggcacaugccugucucccagaugcucaggagacugagacagaaggaucgcuugagccuaggagguugaggcuacagugagccaugacugugccacuguauuacagccucggcaauagacagaguaagacccugucucaaaauaaauaaauaaaaauaaaaauaaaaaccagauuaggacuaagaagggcuuaaagccuaaaucacugaaaauuaccaaugaagaagcaaucuuagagaaguaaaguaauuugcucaaaacacacagagcuggaaagugguagagucaagauuaaauccaggcugacuucaaagccagugcccaacauaaucucauuauuuaaaaaaucaggauugaacuuucauuuugagaaauuaacaaacugaaauauaaaacaauaaaugucacuuaagagacccuaaaugauucauguuuucauuaucaaacauacugcauuacaauauagaauaagauaucaaagauaaaacacaauagcaacaaaacauagcaacaucucuauuaacaaauguauugguggggcaugguggcucaugcuuguaaucccagcacucugggaggcagaggugggaggauagcuugagcaauggaguuugagaccagccugagcaacauggagagaccuugucucuaccaaaaaaauagccaggugugguggcacaugcguguggucccaaccaggagauugaagcaggaggaucgcuugagccugggagguugaggcuacagugagccaaugauugcaccacugcacucuagccuggguaacagagugagaccuugucaaaacaaaacacacacacacacacacacacacacacacacacacacgccccaaauguaucgauuugcugcuagaaaugucauuuuguaauacaaguaaggaauaagagcuugugaaauaaauuuaaaguuucuggugaugacaggguuuagacagcagccauuaaaaaccaagcacagagugcaugugugugccuaugugcauacuauacagaaaauaauaaaguaaauaugguaaaauauuaacaaguggggaaucugaaugaaggaauaugguaauucuuuguauuauuuuuguaacuuguaaaaaacaagaaucaggccaggcgcaguggcucacaucuguaauccuagcacucugggaggccaaggcagguggaucacuugaggucaggacuuccagaccagccuggccaacauggcaaaauaccaucucuacuaaaaauacaaaaauuagcugggugugguggcgugcaccuguagucucagcuacuagggaggcugaggcaagagaaucgcuugcacccgggaggcagaggcuguagugagccaagauagcaccacuguacuccagccagggcaacagggggagacccugcaaaaaaaaaaaaaaaaaaaaaaaaggcacaaaaaucaaagcucuaaaaaucguaaagggggcaggggugcugauggacugaugggugccccccugacauucauauguugaaucccuaaauccccugggcugauauuuggagauggggccuuggugagguaauuagauuuagaugagguuguacgggccaugaggggauuaguguccuuauaaaaagagauaccagagcuugcucucuucuccauuagagaauacagucagaagguggcugugugcaagcuaggaagagcccucaccagaacuacuaugcuggcacccugaucucagacuuccagccuccaaaacugucagaaauaaauuucuguuuuuuaagccauccagucuauacuauuuuguuauggcagccugaacuaugaugaggggagacugaugcauuaacuucaaaaaccagaauuuuaucacucaaauuuuaacuaaauugcccauuuaaaauaaaaaagcccaaauauucaccacacuccuaguuccaagugaaucagcauccacaaaauauaaaccuuaaaaaaauuuagucacuuccuucccucaauccacuugauuuuuuaagacuacugaaaguacuagucauuuacauacuucuccuuaaauaaacuuaauacaaaugagaaucacacaauguuugaaguagaaaaucauuuuauauuuaaaagaauguggucaauaugaaauaauuuggccuggauauguuggacccuguccuuuuccaugucaauaacuugaauaaagacuuggaaaguaaacauggcauaugaaauaauauauacaucugaaggaguaccaauguauuccaugaccaagauuuuuaaaggucuuagaaugcuaggcagaauuaaacaauuaguuauacagucauauuaacaguucagaaacuggauuucauaaaugcagaauacagacccagacugucaugugaaaaagguucuagcugugacagcuaguagugugacaauacugcuuuauaaaauuuuaauagaaaucuaaugcacagauuuggagucauaacaguuccacugaauuuuauguuugucacaguauguuuagaguauuaugcucaacuccaggcuucaugaagacaaacauuaacaaacgacugaaugcaaaggaaaaacuguucaguuuauccauaagugaguaaguuacauuaaacuaaaacuuauagcauuacuuuaacaauuugccaaauaacccaaagagcugugaaaugacguguaauuuugcuaaagcacaaaauguaacuaacaugccaugagguaugcaucuagaaaauaagcuuggauaucccucaccacuccuaaugcugagaccccaggcccagagcuuuguuuucuuuuaggggauacaauaacucuuacaaagagaaaucuguuucuuucuugagggaggggggcaggguggggaagagcagugaagaggaggccaaauccuaguguagaucacggaaggcgaaagugaagagguuugaaugcuaaauacggaaauuuguaagaucuuaggacauaugcuuugugaauguuaaggggugacuguaguaaccuacuaaucaucagauggauccaagcaaaagcaagguaagccugucagaaauauuauaaagauaauucuugcuuugaguaagaaguugaauuggccacuuacaaggucucuuccauuucuaguaguuaaaaugaacuaguaauucuaaggucaaauauuuuaagaguacauuugccacuauaauaguaaagcuaagaauaccaccauauguugaauucuuuuacuacaaauagcaguucggcaaaaacauccaaaauggucauuuuuuaaaaaacaaaguguaauauaaauaaaucugcuggaguucuaaucaggauaguggaagggcucaggcuguuccuggaaacugaaacaugugaauuaaguuuccggaguaggauaaagccuuaacaaucagaacagaaauguagcuaucaaauuuucuguacuaaaaacugcuguccuuaaaaaguacagcuguucugucuaccgauuacuuaaugaggugauugccagggcauucuuuuuaacaacuuauguauuuuaaaauuguuaaaauuacacaacuguuucucuuaaaacuguuuuuguuuaaauucuagcucuaauauuuaguagcuaggugaccacaggcaaauuacuuaaucucaaauuuuuuacuuccucaccugggugggcuauaauaucuacuccaauacuauuauaagauuuaauuaacaaaguguguauaaagcucuuagaauaguguaaagccuguaacaaaaacuuauuaagugguaaucaauauuugcaaaacuaauauauuaaaaagaaaaacccaagcauagauaauuucuucucuuuuuuuuugagacagagucuugcucuguugcccaggcuagagugcagugguaggaucuccgccucccaggcucaagcaauucuccagccucagccuccugaguagcugggguuacaggcgccugccaccacaacugacuaauuuuuguauuuuuaguagagaugggguuucaccauguuggccaggcuggugucaaauuccugaccucaaguaauccacccaccuuggccucccaaagugcugggauuacagggugagccaucgcuucaggcccaaagcauagauaauuucuuagucaaccuuuauuuauuauuuuccuuuucaacaguuuuacucugucacccaugcuggagugcagcagugccaucacuuugcaacccugaacuugagcucaagugauccuccuaccucacccuucugaggagcuaggacuacaaguacaugccaccccauccaguuaauugaacuuuguuuuuugcaaggccaaaguauguugaauguuaugagagugaaagagaaguacuugcuccaagaugcucaucuagcauuaugaauuaugguuaaucuuuuggaggaccaaaggguugccuuuaaaagucagaauauuaauuuuaaauuuauuaaguguagagaauugguuaacaucccuccguaucauuggcccucuucuucuaccacugaaauauccagucuuaagacauguaaaccuauuuccuuccuucucuucuuuuauuauuuuauuuuauuuuauuuaaauuccccggccaggcgcaguggcucacgccuuguaaucccagcacuuugggagggcgaggcagguggaucauuugaggucaguucaggaccagccuggccaacacggugaaaccccaucucuacuaaaaauacaaagauuagccaggugugcugguacacaccuguaaucccagcuacucgggcugcugaggcagaagaauugcuugaaccugggaggcagagguugcagugagccaagaucgcaccacugccuccagccugggcgacagagagagacucugucucuaaauaaauaaauaaauaaauaaauaaauaaaauuaaaaaaauuccccuacccucuugcuuuuaauaagaaacagggucaccuuaauguuguccaggccggagugcaauggcuaucccacuacugaucagcaugggaguuuuaaccugcucuguugccaaccuggaccaguucaccccuccucaggcaaccuguuagucccccacucccaggacacccuauugaugcugaauuuagugcagacacucaguccauauguagaacacagugcgcuacccuccacaacuccugggcucaagagauccuuccaccucagccuuccaaguagcuaagaccacaggcacaugccacaacacccaacuccuucuuuuucuuucuccuacuuucauucuuucuauguucaaguuugucauaaauauaacaguauaaucaaaauauuuuuucuuucuaaucagaaaacaaaucauucagcauggguaggccauucuuggcuuuuuccaucccucuuuaauaguuauuucuucaagagaauuucccugucuccaaaaugccagaagacucuaguucuacaguugggagauguuuuaucuuucuacauucuguauccuaguugugggggcuacaaaaauccauacguacuaaaacuuaaagaacuguacaccacaaaucaaauuuccaaauauaaacuuaaaauucaccugucuaaagccuccuuuguuuucaauguccucuguuuucaaaauaaaaugccacuguuccauuuuccuaaccuucagaaguaacuguguaccuucccuauugugcuucuucaauuaagagcuauaaaauuuauauagcuuuaauuauaaaaccuaacauuaaaaaguuacuuauauauaaaacuaccagccacaugaccaaaaaucuaaauuuuaauuuaaaccccaaaauuacaaaguuuuuggguaagauuaaauuguguuaaguauuguuuuacucuuaucacucuucuuugaaauaugauaaacuaugauauuuaauauaguuucuugauuaauaaaaauauuuaauaagcuacaauacagaucuuuaaaguacacuggauaaaugagaauucuguacuugcccaaccaccuaacccaucucagcaaaaaguucaaagcuuuuuguuccuuagugaccauuucuccaauuucccaauuguuuuugauguuguucuaaauguauccuuaauaugucuccuuaaggagucuuucagagcauccauugcucuccauagggccuuuauguaacuaggaaaaauacauccuucuggggaaauacagacacuuuuggcaaggagcugaugccuuggagagagaaguggaggcacaguucccucugcgaggccuaagcuggggcacaggacucuguaagcagaacacaggcugacuuguugcuuccuucaguccagcaucuuugggcaguauacaagcugcauaaccauauauagcagcccuguaccuucagauuguucacuggcaaacagggaagaaaaaaugaauuauuaacuuaucuagauacccauucuccaaccacauacauguauccaucucuuauccuucagacucaagauuuauucagaagggaucuuccaaccuuauagggaacguaucuuccccuuuaucuuuaauuuucccuuuucgugguucucuuuucugcuuuaaauauggucaagacucaugucuugauauuguguaauaucaaagaauauuaaauucagaagauauauagaaauacauaaauguacucuuugcaauaguccucugagauaggggaaauggauauuauccuuguaucacaaaucaauauauuuaaaacuuaagccagguuaacuugccccaaaauuaacagcuggcacaaagugacaaaaaggacuaaaccuagguuuuaaaacaauuagucuagaguccacuuugaguauucaauauaucuaaaaaucaagagauuuucccucuucccccuuuaaccuuccacuuuuguaacuugaccuagauuauuuuaaggucaccaaggauaucacagccaaauccaaagacuacuugucacauauuuuucugaacucugcuacauuuagcucuaauaauccuguuuuuagauuauccucuucugcccugauuucuauagugacuuccuucuuauuuugucuuguucuucccuugccauagacuguccuagacauccuauuacauuucucuaucuaaauaaaccuacuccuuugcgguuuaucaugaaagugguugucucaaguauguaguuaagacuaauucauaucucuauuccuguaaugcugccauuuccuauuuuaucaaucuauuccauucuaggcuuucgaccuucauuaacuguaccuguggccugauccuauccaguauucauuucuuauagcaguaaugucccaaaggguggaauacaaagacugguaguauacuggaugauuuuaagugauccacagaaaauuauguaaaaucauguuuauuuuaaaacauguuggggggaagcuaaugccaaauaaucauaaaaauuuccuuuuaaacggcaggaugcaguggcucacgccuguaaucccagcacuuugggaggccaaggugggcggaucacgaggucaggaguucgagaccagucugacaacauggugaaaccccaucucuacuaaaaauacaaaaauuagccaggcgugauggcaggcaccuguaaucccagcuacucaggaagcugagguaggagaaucacuugaacccgggagggagagguugcagugagccaagauagcgccacugcacuccagccugggcaacggagugagacuccaucuaaaaaaagaaaaaaaaaauucguuuaaauucauuuaauuaaaagacagcaaguugaauugaagaaaaauauuaaguaacaggcagaugguuugggacgaagcagaaauugugaaugauuuaaguuuggaaaauacuggccacuaggaaacccauguaguugaguuaggcacucaggcucuggaucaauaauucaaaugccauuucuaccacuuaaaagcuaaguaacuuugagcaaauuacuuaaaucucuuccuuuuaggcuuucugcaauauggauuuaaauagaucauucaaaaaauagucuuaguuuaguaacauggcauaguaagugcucaagaaauauuaauaaucacaauuauucuugauuuuucuuagacaucacagcuucacuuauaaucaacuaggaacucaaucuguacuaucuguaauuuucuguaccaaauuucccuuaccuucuuauacaccuuuuuaucuucuggcaugaauccaaagacuacaagauaacuuuuaacauuaauccuuaaggcugugaacaccuugggaguggaccaaaugccauauugcucugauucacugggccuuacaaaauuaaaagaaucuucaaucuuuguugaauaagcuaaaaauuuuaaaaaucagauguaaauaaaucucacaaugcauauuauuuaacacaaacucuucgaagguuaccugugauacuauucuuagagguaaaggaaaaaaaaccugacagcauuuucuuuugcuccaauaauauacuuaucaguuaaucuugugggucuauucuuuuguguuucucacccucauucauucaauaacauauaaacucuagguauacgccaaccaccauacaaggugaugaggacauggaaacagucuaguagaggaaaacaaacuaguauuagaacacagaaaacagaaaaauuaccagauaguauguaguacauauugcuauguaguaugcuacauacauaauacccaauaguuuuuuuaauacuagacgugcuccucaaaugauauuccaucuucccuuaauguugagcacauagcagcaccacacagggaugaguauaucacacugacuauaauucacauaauaauuucauuacaaucuuguguucagacucuuaguuaacagucuaagagucuaguuaaucaugucugccaaucagauaaaaauuuccgguugaaacuaaguaacaguccuuguuugacuggauuugccagcaaauacauguagucacaggccccaaaacaugcuuucugauaaucuggaggaaaauaaggacuagaaauguaacuggcaaugcugggagcaaugguaggcacuucuagucccagcuaccugggaggcugaggcaggagauucucuugagcccaggaguuggaggccagccagggcaacagaguuaggucugucucuuaaauagaaaauuuacuaaaguuacccucucuauagaacgcuuuuauccacaaagguguucuggcucaugcaucgaugagauuagcgaggaauuuaaaauguuauuacucauaaaacuaacacaguaacucucagacuuguaagcaacaauuaacauagacugagauaagcuuucauuguguuguccuauucauaaggugacaaaaucacgauuuaccgaaaugaaagugugucauaacucagacacaauuuuuguauguccuucacuguaagaauacaauucuguacuaacuuauguaacauuuuaccaaugaucaauucuugucauuuacaaauaugacauaaauagcauccaaaacacaaguuaccuaacuaacaaacugaaguaguguuuagggguggcacuuggaggcagacagggauauaauauaaucuucaaagacauuuuaucacuaaagagggugggguggggguaagaagaagagagggggcuggaaugagccagaacuucugcauuuucagcuaugaacaagauacucaucccagggauauuuacuguagagcauaaagaaaucgcuaagaagcaaaauccugcauauaaguagacauaucagggauaaggggaggugaaauuuucuuauguaccuaaagaaauauauacaucacccugagaauuuacagauuauuuauugcuuggaagagaguauuuucuucuaccaauauccuaccauucucccuccacuauuaguugaccuuuuacuaugcacuaagcauaguaauaagcccuuuacauacauuauccauuaucuuuuuuuacuccuauaaaagccucugagggaaguccuauuaucaucaccauuuuacagaugagggaauauucuaccaauaauauagaucagacgccuaaauuuaaaaauuauaucuacgacaugguagaguuaguuuuaaguuaucucuaagcacucaaauagaaaaggacacaaaaaaauuagccucuaccccaaguccaaaguggauauauuccauuuuuacaacuuucaaaacuuuaaccuuagcaugcaacaauauucauauacuagucaagcuaaagaaaaacuacuaguuaauaaugcuuuaucuuauuuaguuacuguaguuuauaauuuaaaaagcagguugaagguuuagagcauccccuuuggguucagacaguauggaauugaaccuacacaauaccaccaauaacugcuaugugaccuuggucagacuacucucucagauuucauuuccucaucuguaaaauggggaugaucuuaauagcacuuuucucaaaggucuguuguggagauuaaaaaaaaaauguaugaaaaggacuuauuacugugcucaguguauagcaaaaggucaccuaauggagaacagccacacauaagcuaagcagagcaaacacaaucacuuaaaaaggcuauauucugaaaauccacuuacagaaaaggagagaauuacuauuugacuacaugcuaaagacaaaauucaaguucaauuuauuccuaauuuuuuaggggaucaaugcauuuggggugagccagaaaagaugcugcagugcaucugugacacacaccuaaaaauggcuccagucaaagcagcaucuuaauuaccaauaugggaggugaaaucuaguuuugaaaaauggugggguuaggcuugguaggugcuuaguaucacccuauuauuuuuauuugcaggaguaagcuauuaaguacucaacaaucaaaaaauccuccgauucuucuggugcauuccaaaugaaaaucuuacagcagagccgccuacuguacaauucuaaguacucuaacgagguaugaaucuaugaacccaggcugaaaaccagccaaugcggaaauccagguagcuuuauaagccagcaaacaucaggcaugucagacccucaaaagaucccaaauaaugucaaaacacacauacaucccuuuaaauuaaagguacuccucucaugcaaaggaaggaagacucuaucaaugucucuauaguggccccaugcccuuuucuucaguccuaaaacggggccuuuacccugacaccaccaauaucaacgcuaucucaaagacagggagcuaccgagauucaccacgcaaguuagaggauggagcggccuagagugugaaaagacuacccaaauccuccuccggaguugggcagcacuucccuagcggaaguaggguuggucuugauuccccgaagagccucucaucuaaccaggucuuuaaaccagacccucccauacauugcucauugcaagucccacccucacuacacaggaagagguagacagugaaagccccggcugaguccuucaguuguuuggggaaacgcauacccgacacuaaaaaaaaaaaaaaaaaaaaaagacuucacguccgccaguccaggaagacggaaacccccuucgcuuacccggcaacaugcguaauccccucgcagggccaggacuggggucuaggugggagcaagacagaccgguccagaacucccgcugcagaccacauggggcgggucugacuccgguuucccgcuccccaagcuggaggccgacuuccccagacacagagaugaugguaaccaaacagaagggaaaugcccggacccaaggcccucuccacgcggcccccuagccuccgggcgccagggucugggugcgcucccacgccccaggccgcacucuggccguucccgauggggcccucuuugaucgcggcccccacacccucgcuuuccuuaccggucagggugagugucaaguuugcgcacuucgagggucuccgccgaucucugaucgaaagaagggggagggaaagcugggguuaaagggguggccggaagggccaccagacuggaaaagccgaagcugcggauggacaaaccgccaaagcacuuucgcagcuuuccgagggggagcgagcgagcgagaaaaagaagcaagauggcggcuagccagccccuacguacuacgucau

SEQ ID NO: 12926 - RNA, 1054 nt, Homo sapiens
ucuuuuuuuuuuuuuuuuaagaaacugauguuuauuuuccgccaaucauuuuuccguguugcuuaagagccuaugcaagaacagcuuaagaccagucagugguugcuccuacccauucaguggccugagcagugggagcugcagaccagucuuccauggcaggcugagcacuccugucuucaguagggaacuacugaauaggcacagagggcaccuguacaccuucagaccagucugcaaccucaggcuuaguagcagugaacucaggagcuggagcaguccauucacccugaaauuccuccuuggucacugccuuuucaguagcagccugcucuucuuuuucaaucucuucaggaucucuguagaaguagagaucaggcaugaccucccauagguguucacgagaaauggugccacgcaugcgcagaacuucccgagccagcguccaccacaucaaacccacugagcgagcucccugguuguugcauggaauggcaauguccacauagcgcagaggagaaucuguguuacacagagcaaugguagguagguuaacauaagaugccuccgugagaggcugguggucagcccuggggucaguaaccacaagaagccuuggcucccagaagucugccuggaucugguuagugaagguuccaggagugaagugaccagcaauuggaguggcuucaguggcagcagcaaacuucagcacagcccucuggccaguauuccuggaggauauaacacugacaucagcaggguuuucaauagcaauaauagcacgagcugccagcagaagcuucucccagguccucuucagauuuaugauauagaugccaucacuuuuccuuuuauagauguacuguuccaucuggaagucaagauuggugccaccuaaguggguuccugcuacaaggaacuuaaggacauccuccuccuucauuugcaggacaucaagcgcuccagacauugugaaaguuucccuuuaaguuacgacgggaauccagaacgacgcuguauggaccccucuguagguagcgcggaaaggcua

SEQ ID NO: 12927 - RNA, 45159 nt, Homo sapiens
aaaaggaggaaaaacauaguuaugaacucucgagggauagugugaaaggcaagagaauccuucugucuuucaaaucgacauccucagcauguucucccgcugucuccuggugcuuggguggcugcugcuguuacacccacagccauuuccuuuaauagggaggaaaaaccuuuccuaauccacugucuaucuuccucccaacuucugcuaugucucaccggccagaacuugugaccacccuagcgggaaaguaggcucagaaagugaucuuuuugauuucuuaacuucuuuaucgaaggugaacaagggagaagggggugaggagugggaauggauguuggagcuaguaaaccuagggucuauguguuguauuucuuuucuaauucggucucgaggucucucucugggagugguuauaaacguuagcucuuccgugauggggcuuggauauuuacagugugccuuccauggaauacuucuuuauccuggcagacggccuaaauccuaggugucugacccaugacaggaggucccucucacaggaagcuuguuuauauuagcaggcacauuuguggcucuugucugccccgugucugguuuauuccaaccaagacagccacucucuaggagagcccuaaccaggaaacaagucagguguggguguauaggucaggugagacacagaggaggugaacaaaacaugugaaauaauagaagcaguuucauuacuuacagauccauaauaagaggacagcaugccucacagggccaaugagaagggggacacacaugcucaaccagugggagggggacgagacagagagagggacuugcgggccaaagccuucacugugguccuggguccaacaucuuagucccacugugacuaagagguggucacugaggcauaucugcaaaguauaugugggguauaggggucaaggggaugaagcaagcagcuuguaccugaugguucgauagggagguggucaccagaggcggucauacaaggcagaugucuggacugaccacauagaggaagugggaggaggcacagaacuagagacuguccagggugacuaagcccugcuucuaguuugagaagguuaaaccuguccucagaauggauagugaggccuuugauauguucucccaccucuucaucaagcauauugacaaauccuuuuucaccaacuugucuugcuauaaccgcccaguagguucaccuugccgucugccuagauagagccaauuuaucaagacggggaauugcaauagacaaagaauucaugcagagcuggcuguguggggggccagaguuuuauuauuacucaaaucagucuccuccagcagucgaguuuuuaaagacaauuugguggguggggaggggcaguaagucagggagugcugauugguugggucggagaugaaacuauggggcaucacugucuucuugaacugagucaguucugggugggggucacaagaucagaugggccaguuuaucaucuggguguugccagcugauccaucaagugcagggucugcaaaacaucugaagcacugaucucaggagcaguuuagggagggucagaaucuuguggccuccagcugcaugacucccaaaccauaauuucuaaucuuguggcuaauguugguagucuagaccccaggcaagaaggagguugguuuugggaaagggcuuuuauuguuuuuguuuuaaacuguaaauuauaaacuaauuuccuuccaaaguuaguucagccuaugcccaggaaugaacaaggauagcauggagguuaaggacaagauggaguugguuaaauuggaucucuuuaacugccuuagucauaauuuugcaaaggcaguuucauugcuaccugaaugauuuuccuaacuuauccaucaaucuccuggaagccuuucuccuuaaccaaugucuucaacucugccagacauguggcagcuucuucaucagcagauguggccucuccaguuauuuuuauguuuuucaguccaaaccuauuccugaaucuguguagccaucccuuacuugcaguaaauagcuuggugugccuaauuucaggggaucccuuucuuaagucuuccuauaggcucaacacuuucuggcaaaacuuacugcggucagcugaaauacguuuucuguucaugucucccacccacaaauguaaugccuuuuccgucuuuugcuguugcaccucaaacuacaaaaguuacagccacagugcaugauaggugcuuaguuaacuagcacgaaucuuuuuccuucuucacaauuucauggauaauuuguucuuaucauagauuuuggcaaccucagcauaugacucuuuuucuuuccuuauuaaguccagagcuuucaccuuuucauuuaaaggaagcacuuuacagcuucuccucggcauauccaaauugucagcacaauuccugugcuuugcggccauuauuaaguaaaauaaggguuaccugaacauaagcaggugguaucucucauuaucucugcuauacuacgggugcaucuguuaaccaaagcagcuacugaguggguaaugaguggauacuguacacagcgcggcuaccugcgacagaugauucgcgucaagggugggacagaguggauggcccgagauuuaaucgggcuacucagaauacaggcgguuugaaacuuaagaauuguuuauuucuggaguuuuccauuuaacauuucugaaccaagguuugaccacagguaacugacacugcagaaagcauggaggggggcaaaacuacugcauuaauauuaaaauuuucaaauauuacuuuuugcuaaaugaaaugugauucaggaccuucccucucaaagaucaagcgagaucaccacgaccuccgccagcagcggcucugcacgacuccacccucgcagcccagccaaucaaagcuacagguugagugacgucacucuccugaaaguccucgcuaauucccguacuccuuuucuccgcccugcaccucuacuguuugcuacaaguggccagcagccauuuuggauuugggcggaaaugaaauuaaaacugugcuguuaaaagccuaaaaauucaagucaagacaaacuuaagcauucgaccaacacaucuagaaagggggcaucuucguggacuaacuagaccacuggggcagugagugaaacucgguaucgucgcggcgcccacacuuaagauggcaccggccugagacucagcugugcggccucucuaccucgguuccugguuaguuggccucauugguggcgucggagggaggaaggugggccuucugucccguuuccggacccgucucuaugguguaggagaaacccggcccccagaagauuguggguguaguggccacagccuuacaggcaggcaggggugguuggugucaacaggggggccaacaggguaccagagccaagacccucggccuccucccccgccgccuuccugcagguaacagggagcccugcgcugcgcccccaguccuugcaggacugcgccgugggggaaggggccgggcggggaggaggcggcgggcgcgcgccccgcucgcgggucugcgcucuggggcccgcgcgggagcgagcucggcgcggcgccggcggccgguugagcugugcucucagcuucggagcagccuccccuugcugauuguggggcgcccuguaaucugcgcuucgcgggcggcccccgacgggugaggcgcccgcggccagagcucuccaaggcggccgcggagucgguccucgcagggagguguggaaggugaggggccagcgaagcgagagcggcgccucggcccuucagugaccccgcggggucgcggcaagcagggcgagggugcucggcugggcgggucacugucccggggcggcagugcccgagcccggggggauccugggggcgcgcccgcccucgggaaggcggccucauucuugauccaagaccagugcccgucccccaaggcccagcuggcuccugucuuggcauagugcuuucuguuuagaauaaagaugaaacauuucucggaagagcauauucaggaauccaugugaaauucucggagucgggucucgaauuuugggggucacuguuaacugcuguuuuuagggacccauguucuuauaaaauguaucuugagcugaaaucacaauuauuuugguccauaaagacuuaauuguguauugcuugucagcuagcaaugcuggacugaguuccgcagagggaauauauaccugaaacacgaaagcaagggccggaguaacguuaccgcuggauaccagaauaucagccaguacagugcauccuuaauacucagagugcaagccauuaucuuuggaacuuucaagcuaagggagcuaggaccaagguagucucgaguaauugcugggaaaagaaaauauuugguagaaacauuuccauagagcacacggguuucuuaguugaguguaugaguugcccuuugaccuagacaaggguuuucuuaaucuacaagcgguccagaaauuuuaugugcugcccaaguaggcaaaagaguggagggagauuauuaaagggaagacugaugcauauucaagucagagacugucaacucagcauuuuauuauagaguggagaugcuaagugcuacgaaauaccuauuacgggauacuaggauauccuuuucuaccuucuugugacuuuuuaauuucaaagcuaaugagcaagauuuuguguuuuccccguccucaaaacaacaggaaagcauuuuggaaggccaaguguuuuucuuacauuucaauaaaucaauuuuagcugaauuaucauuuuuaaagcacuggcgggcaugguggcacaugccuguaaucucagcaacuagggaggcuggggagggcagguagcuugagcccaggaauuccagguuacagugagauaggauagcgccaaugcacucuaggccagcagcaacagaacaagaccauaucucuauuuaaaacaaaaaacaaacaaaaaaacuucuucauauaacaguauuugugcuucuuuagauauauuagugugaagaauuacugcuucaaaacauucucaaauugcaauaaucagcacaccuuuuuaauuuucccccaauaaaguuugcacugggaacauacaauauaaucuuaccacugucaguauuacacugaugguaucaguggacuucugucaaaguuaacaugcuuucaaaacaagaaaauggcauccuuuccaguucucucaagaaauugagucaucccuuuuuaauuuuuaagugauuuuuuuagucuuagaccuaaaauacaguaagaaaaaugaauuuuaacuacuuccuaaugcuuuuauaacuuuguuaauuauaguggaauucauaugaaaucuaagguuaauagcuauugcaaggccaauguucccacaaggaaguauuuugcuauuuagaaauagcuaaguaaauuaaauguuccuuucucuugccucuggugacugccauucaucagccagagcacugacccugaauccugguggcagucuuaucucccaugaggauuaauauuaacacuuaaauaaacagcaugauuuccugcgaagaagauauucauuaauauacagucccuuauucucugcuuuucucuuaauuguguguugauuuuggaaagcuguguuuugugggugagagagagacggucagacuagcuucagauacuuucaaaguaacacuucuguaacucacucuuccagucugacuggcuuuucaggcaggaguuggagaccaaguagagcuuucugccuaugaaauggcaauuaguuucaaagaacauagacccauucaaguuaccugaggaaaagggggcugguuguaagggugucaaugggauguuaggguaucuggguggaauuagauuugaggcugggcuuccgguagucuugagauggauaguaguaaugugcccccuaaguaugacuaagcuacggucccaguguuugcuuuuuaaaauuuuacuaccaacugacuuccucuggaaaguuucugacuucauguggcuuugguuugccguagcuccaccuccaccucauagcauccuucuaccuucggcuaugcuucuaauaggcaaaaauuguucuuaguucaaauuccugggggagacaaugaucuggccaguuuaucucuucacucaggccaugaaauugauggcuaauuugugaauuaaccgcccuuuggcccaggauagguaccugccaacauuaacugugcccaagaagagguggcaagaucaagugcuaagcauaauccucccuacucagcaggagguugugacaaucuggccagcacucuaucuccagaacagagggauuagcauuguugcuuuuacccauggucccacauaaacuuuuuauuuguagucccaguagaaaggugaauguuaccauaguugccauacuuggcauuucuuuuaguacuguuuuuugcuucucugucauuuuuaagaaagauacauugccagguagguaggaauucagugaauuuguuacaaagcagauuuaguucuuauucucagcaacauuuuuagauuuugaaaaucuucaauuuuagauagcuuuagccuuuauacauguguuucuuauauaacgaugguuguggaucgguaggcacuuuaaauuuuguucuaggcauguguuuugagcagcauuacauacccaguguagaagguguuguauggaauuucaccgaaguggggaaaaauuccaaguagagggucaauguguaaugauuauugaguuuauauuuguccaaagaauacagauuuuaaacaaauuuuuaaaggccuacauagaauuauuggccguauuuguagcaguuugcuuucuacauugccagaguuaguaagaacucuauuuucuaauuuuuauauuaugguaaagccaccacugaaaacugacugccacagauuuuucagacauacguuguuuggccuauauagguuuagaaaacauuugauucaacauugaaaaauauggagauuuccacaaaacuauucaggcucuugguuccucacgauaaguggcaugaucugacaguucugaaacugcaguccugguuggaacucugugauagccacugucuucagaaugcaagccucucacaguaggucccaugcacgcacaguaggucccucugccaggcugccaguacugcuggggcacugcacauuaccuguugucacccugugaguuuguaucccuguugucaagaaagcuguucauauuguagaagauuuggaaggugcaggcaaguguguguguauaaaauuaccuauaaucugaccuuccacuggaaaccucuguuaauacuucaacauauauuuuucaagucuguguguauguauacauauauuucuuuucaaaacaacuuugaggcguaauugauacagaauaaaugaaaaaaguguacaguuuuauguuuugacauaaucacccguuaccaucaucaucaucaagauaaugaauauauccauccucccaaaaguuccucauacaucaugauaauccuuuccucucccuugaucccucuaacugugccccuucacuaggugagcacugaaguauuuugucauaguugcauuugaauucuguguaugugugggcuuuuguuuuuuuuuagcaauugagauuauuugagauucaguuuugcgguuuccccuuuuuacuuaggauagcuuugaagaguagugcgaucguacuuuuucuuauguuuaucgucauuuguguuucuucaaugaguugucuguuuucuuucccauuauuguacugguguuuuaguguuuuacuugguuuauaugagcucuucauuuguuaauauguuuuucaucauauuaacaauguuuuucaacauauuaauauuaaaaccaugauuuuccucauuauaaguauucuccaauuuguauuguuuuccuuuauaauuuuaaguuauuuucuacauacagaaguuuuauuguuuuugaguaauauuuuuacaacauuuuccuuugugagugaggauauacaagugaguuaggaaguaugaauuaccuuauucuauuuuugauugccuuuccacucugaaaguuuguaugugguggaguuuggggagggacaguaacuaccugugacuauuuaguaaugugcauuuucucuagagcuguuaguuguuaauuaacaaccauugcugguaacuugcagagcguuuaccauuuuuacugucaaauguccuaguuaugaggaucaaagaaacuaguaguuugggguggcuaugucuggauaucucuuguugauguugcagauagggauuuaauguuugaaauuguuuucuguuuucuuuuagaucugcuuggcuuugaggaagaguggcaguacugccucacugcauaagggaugggaucagagaacagugcuuuaaagagcuauacacugagagaaccaccauuuaccuuacccucuggacuugcuguuuaucccgcuguacugcaagauggcaaauuugcuucaguuuuuguguauaagagagaaaaugaagacaagguuaauaaagcugccaagguaccauaauaggugacgacuuaauaguuaguacuuuuuacuaucuuguuuucuuuuaaaaaaauaugaaauuaguaaaguucaaaggagguaagaucauaaggaccaguauuuuauuuauguccuuucaaaacauugcucuuacuucaugggccuaucuuccauuugcaugacauggucagguaccauaccuguagccaaaaaacaucauaaaacucaguacaauggcuuuuaucaucauauuuuauuuuucuggugagaaaguuagggagacauuuuuauguagcuaauauaagauauaaggagcuauauaaggaguuaaucucgucuagcaaaaugcaguuaaguauugacaucauucuggaggcuucagcuuccuccuuagggaaaagauccuuguaguucaugccuuauaauuguugcuccaggcagagggugccagugcauuagcaugcugucugacacacucaggagauccuggccucuuaucagaaaaaaugauuuuacuguggaauguaagucaauaaaauaaccccaagugucuuuuugaauuagggaaaaugaaggcauuaguugaugcuucuuuggauagcuagcacuuuggaaauuuaggaauucagauauaucaucuucuaaaauggaaaauguaauuguauuaguaaauuaauucuccaguguuuauucugguaggcaugcuauuuucaaguugaacuugauaucuugauuuuguuagaauuauaaucucuauuaccuugagucccuuaguuaucaacagguauggaacauugaugucuguuucauaggacucuaaauuguuuuuauuuuuuuaaaaugauuauaaaggauuauauuaguaauggaauuuuggucuucacaacaguaauuuauuugauguuguauuuuugaucaagcaugaaauuguuauaagaugguuccuaaagaaaaagauggguaacaguucucucgagaugcguggugguaaaaaguauauagcuggcuguuuucuugcuagguaauuuugcuuuuugguagaaccacauuuuugacucuuuuuuuacaucaucuagguauuguuaagaauuuuuuauugugauuuuacaaaagacaaaaugccuuacuucgcuuucuuguucuuacaguuaaugucuaacaugccuccuguuauuuucaucuaauaagauugugcauuuuuuuuaauaaacuauuaucggcgagguacuagagacuuaucuuucuuaguauuuuuuucuuuauaagauuuuuuuaaaauuguguuacacuuuauggugcacguaccaagaaaauugaauaaccuagaucgaguuuuuaaaggaaaaaacagcaagaccacucuccauuuuugaggacuucugugcugaaggaauugcgaagcuugagagggaagacuuauucccccuuaauauucauagauacccuuuuaagccaugucugagucuuugcacauaguucaucuuugucucuuguuaagccauucuguggcuuugaaaaccucauauaugaauuugggaaauuugaaauugcaacaaagugauaacuuuagauucucagaauguuucucauaaucuuaaaaaacuaggucauagcacuugagaaauguauggcauucgaugugcuagauuuuaggaauuugauguccuagguaucugaaauacuaaaacaauauauuuagcuugccucacuuucucuagaguuuggguuguuggucacaccuuugguaguuuuaacgauuauuucaagcagauauauaguguuuucuguuacuggauaacaauauacacuuucuucacuguuacaaguaaaaaacaacaauccuaguauacaccaagaugaaaugcagguauaagcucuggccacaaaauaaugugagaaauacuuaguucuaucugaccaucucauuuuacauugaauucaucagcuauaauuaacaguauaauuugcuaacugaugaugaugacucauauauguaagccuauaaacagugauaaauucuaagcccgaauuugguugcuguaguuugcuguaaucuaaguguuuaguuagggcuuugugguaagcuuauuaaagcuuauaaaaaugauucuugagugucuuuaugccaggaaucacauuggacucuaagagugguauguagaugcuauauaagugcucuauuuaguauuguuggagucauuaugcucuuccccauaaugaauuugggcuguuguggaaggguuagucaauguuauuuaagaaugcacauugugugggcauaacaagaaauggaagagaugauggcuaugcccaaaagagcuugcauucuaauuggagaaagcuguucuccucucucauacugacuuuuuuuuuugagauguagucucacucuguuucccaggcuagagugcagugguucgaucuuggcucacugcaaccucugccucccggguugaagugauucuccugccucagcaucccacguagcugggauuacaggcacgcgccgacacacccagcucauuuuugaauuuuuaguagaggugggguuucaccauguuggccaggauagccucuaccucucgaccucgugauccgccuuccucagccucucaaagugcugggauuacaggcaugagccaccguaccuggcccaugguugacuuuuuaagaaauuauuuuuugcccuucauaaucagaauccagugcucuuacguggcuucugggcacuauccacucagaagaacuucagaaguaucccccaugccucagguaugauggacccaccagauggaauggccagcuacuugcuccccaccacaccuugcagacuucacgcucuccuuuuuccuuggauguuaauaaccauccaaccugccauucuaaacuaauuaucugccaaaaucucuagucugagcuccagaucuauauuuucacuuaccuauugaacauuuccaccuaaaaguuuuaucaguaccucaaaugcaagcucuacagaauggaauuuuuauuccuuucucuuucugcauuuuauuguuaguuuaugaucuaaccuucagauaguggacauuuacaaaaaaaaaagcaucugcauuuugucuuagauuuacaucuucagagaaaaaggaauaauauuuuucccugaagaucuuuguucucuaguuuaggcaucuugguuauuuuguuuacuuaacauauuuaacagcgugaaauuauggcuuugucucaucuaaaagccugcagguggauuugggcuguaaugcugagucaguuaacuuugcauaguucucaaagugaaauagcgaaucagaggcagaacaacaauaaaaaguuaagccucugaggcuugaaugaauucucuggauagcugaaucauaacugauuccugauaaaggggaaucauuuauauuuagggaaagaaucucauacuuaagaucccuguuuggguguagaaaaauaucaucauugauaaauuauauaauacuauucauauuuaacaauaaagguccuuacucagaacccucuuucagagaccaucaccuaggacaguaaaugggauguaauagguauucaauaacuuuggggaaagugcuuucaagacacucauucaaaaauagucaucuuucucuacuagggcaagagccauuuauuugcucaacugauguucauugaaaaauauccuaguuacccuuagcaaguaugucuuguugcuauucuuuagagcagcagaggcuugaaucaaaaaauguccuauuugauucugaacugcuagccuuuccugugaaucugugugcauaauuuaugcuuaauauuaaauguaccaaaggagagugagaaauaagguucuugcuaaguuaagugccuuguucagaaacauguaaugagucauuucuucuucuccuucuuuauuaaacaaacaaguacucacuuugcaucaagaaaauuucuaggcauuguagaguaaaacaauaagcagaagagaacaugaaagauuugguuugaaaauuauuugaaaugauucuuaaaugaaaauaugagggaggcuacauaauuuuauacagaaaccguagcucaaaacacaccuguaggccaggcaagguggcucaugccuauaaguccagcacuuugggaggccgagguagguggaucaccugaggucaggaguuugagaccagccuggccaacauggugaaaccccaucucuacuaaaaacacaaaaauuagccaggcaugguggugggcgccuguaaucccagcuauucgagagguugaggcagacgaaucauuugaaccugggaggcgaagguugcagugagcugagaacacgccauugcacuccagccuggguaacaagagcgacacucugucucaaaaacaaaacaaaacgaaauaaaaaaacacuuguaaaaaauuauucccaguuaacugcacucauuuaaccaaccugcuaacacaauuuuugguuuaucuggaucuuugcuguauuuauuaguuuguaauugcuaguuaaagaaauuuuuucuucaauauuuucuuaauuauuuuuuauugaauuaacucgaggguaacaacuuucuuccuaagaauaaauaaauaaacccuauuggagcuauucccagaguuggcaaaauuugagauuauuauaagaaaauaaaagaaauuggaggcugggcacaguggcucacaccuguaaucccagcacuuugggaagccgagguggguggaucacaaggucaggaguucaagaccagccuggccaacauagugaaaccccaucucuacuaaaaauacaaaaacaauuagcugggugugguagcgggcgccuguagucccagcuacuugggaggcugaggcaggagaauugguugaaccugggaggcggagguugcagugagccaagauugugccacugcaaugcagccugggugacauagcgagacucugucucaaaaaaaaaaaaaaaaaaaaaauguaauuggagaaaccaacccacugagaagauuuuccuaugacccugccuggaaguaguuuaauaaaguuugaggcaucugauacaaaaauuauaccaaugcaggguauggauucuuaugcuagcccauaguccuccaagaagguguucaguauucacugcuuauuuaugaaaaugccaccugguaauauauugaggguuaucuuccaaaugaaauauuucaucacucuccucccaaucugauuggacagggcuuccucagugauuguauaggguagacccuagagcuuuaauaucauguuaggaccuagaggacauuauguuaagucagguguccccaaccccuaggcugcagacugguacugguucguggccucuaggaacaggauggcacagcaggaggcugugggcagugggcacgcgagcauuaccaucugaguucugucuccugucagaucagcagcaguauuguguccggaauugguggguucuuggucucacugacuucaagaaugaagccgcggacccucgcggugaguguuacaguucuuaaagguggcgugucuggaguuuguuccuucucauguucggaguuucuuccuucuggugggguucguggucucgcuggcucaggagugaagccguggaccuucgcggugaguguuacagcucauaaaggcaguguggacccaaagagugagcagcaacaagauuuauugcaaagagcgaaaggacaaagcuuccacaauguggaagcggaccugagaggguugccacugcuggcugggcagccugcuuuuauucucuuauccggcccgacccacauccugcugacugguagagcccaguggucuguuuugacagggcgcugauuugugcguuuacaaucccugagcuagacacaaagguucuccaccuccccaccagauuagcuagauacagaguguggacacaaagguucuccaaguccccaccagaguagcuagauacagaguguggauuggugcauucacaaaccuugagcuagacacagggcgcugauugguguguuugcaaaccuugagcuagauacagagugcugacugguguauuuacagucccugagcuagacacaaagguuccccacguccccaccagacucaggagcccagcuggcuucacccaguggaucccgcacuggggcugcagguggagcugccugccagucccacgccaugugcccgcacuccucagcccuuuggguggucgaugggacugggcuccguggagcagggggcggcgcuggucagggaggcuggggucgcacaggagcccagggaggggugggaggcucaggcauggcaugcugcagguccugagcccugccccgugggaaggcagcuaaggcccggcgagaaaaugagugcagcaccggugggcuggcacugcugggggacccaguacacccuccgcagccacugucccaggugcuaagcaccucauugccccggguggcagggccugccggcugcuccaaguggggggccugccaagcccacgcccacccagaacuccagcuggcccacaagcugcgugggcagccccaguucccgcucgcaccucucccuucacaccucccugcaagcugagggaaccggcuccggccuuggccagcccagaagggggcucccacagugcuguggugggcugaagggcuccucaagugccgucaaaguggaaacccagguagaggaggcgccgagagcgagcgagggcugugaggacugccagcacgcugucaccucucaguauuagauucucauaggagcaggaacccuauugugaacuguguaugcaagagaucuagguugugcacuuauggcaaucuaacuaaugccugaugauuugagguagaacagucucaucccgaaauaauccccccaccccugguccaugaaaaaauuguguucaugaaacuggucccuggugucaaaaagguuggggaccgcuguguuaagugauguaaaugaggcacagaaagacacacaccacaagaucucacucauguggaaucuaaaaaaguugaucucauaccaguugagaguagacuggugguuaccagaggccaggaaggguaggggauuguaggggaugaagagagguugauuaauggguacaaauaugcaguuagaagauacaagauagaagauauaagaucuaguguuugauaggucaguaggaugacuaguuuacaguaaucgauuguauauuuuuacauaacuagaagagacuaauucuaauguuucuagcauaaagaaaagacaaauguuuaaggugauggauaucccaauuacauugauuugaucuuuacaaauuuuacgaaaguauuaaaaucacagguacucccccaaaauaugcauauuaucaauuuuuuuaauuuaagaaaauuaaaaauaaauagggcaaaaaauagucuacugugguuaauauuguacuaugucacauaaaacguagaagccuuguaauguagguaucuucagccuccuaucccuaccauucuuuguuacauauuaauuguacauucauucacacacauugaaaaccucaccaggaaguauuacaauaucugcuuuaaauagcgauuaaauaacugaagagguaaauauguggccuucaccugggcacgguggcucacgccuguaaucccgacacuuggggaggcugaggugggcggauugcccgaggucaggaauucgagagcagccuggccaacauggugaaacccugucucuacuaaaaauacaaaaauuaccugggcaugguggugcaagccuguagucccagcuacucgggaggcugaggcaggggaaucacuugaacccgggaggcggagguugcagucagcugagauugcgccacugcacuccaaccuaggagauagagugagaccccgucucaaaaaaaaaaaaaaaaaguggccuucauauuuauuguaauauuuacuguuucugaugcuguuccaucauuccugaagauccaaguuucccuuugguaucauuuuuucuuccauuugaagaacuucaugagcauuuuuuauauagcaggucuucuggcaagaaauuuucuguuuuuuuuuuugucaccaaaagugcuuuuauuuugccuuuuccucugaagguuacuuuugcuuagauacaguauuccaagcugauaguuuuuucuuucagcauuuuaaacauguuucauuguuucuugcccuccaccuuuccugaugagaagucugcaguuguuuaaaucaucauucuccuccauguaauguguuuccuuuagcugcuucuaagauuuuuuuaucuuugauauuuagcaguuugaugguaauauguuuaagugugcuuuuuaaaaaauuuaucuuguuuuauauucacugaaauucuucaagucuguaaaauuuaaauuuggcuaaauacuuuaaguauuuucauccauuuaaaaauuuucauccauuguauuuuuuaugccccaauuuuuuucuuuucucuuuuugggacuucaguuauauuuauuugaccuuuuguuauugucacaggugucugaggcucuggucucuuuuuuuucuuucuuaauuuuucuuuaugagauggagauuucacuguguugcccaggcuggucuugaacuccugggcugaagugauccuccugcauuggccucccaaagugcugggauuacaggugugaguccccaaaccuggccccucugaucauuuuuuaaaacauuuuuuauucuucagauugguuaauauuuucaaguuuacugacucuguauucugucauauucauucuguuaaugagucuauacauuaauuuuugauuuucaaucuuuuauuuuucuuuuggaaauuuaaauuuuucuauuuauuuuauaacuuuuccuuuaucucuaggaggaugauuacaauagcugcuuuaaauucuuucugguaauucuaauaucugaggccccuuggagugguguuuguugguugucuuuuccauugagaauguguuacauuuuugugguucuuuguauguugaguaguuugggguugcauccuggacauuuugaauacgaugucacauaacucuuugcucuguuauaauccuuuggaaaaugcugauguuuuuuauuuagcaggcagcuaauuuagguucaggccucauguuuuugaacuaguuccucuuacucuuccugugaaugguauuugcaaccugucuguuucucaaaacuuugcucugcugguuugggucuauccaguggaugcuugcuucugagaauuuguggguaugugaaaaaucaggacaucucuccagcucucuccucucugggauacccuccucauacucaccuuccuugguucuuuucuaucguucuuucagccagaaagaugguaaaguuuuuacuggacuuuuagcaccuuuguuacacugcuuugcaacuggggccugucaccaugcauagcugugagaaggggaaaauuuccccaaaccaagaaacuuaccccaugggugucgcuucuucagguuugacuccccuccauaaucuguuugcauuugcuuacuugucaggauuucaguuguuucuggcacuuuguucaguuuauagcaguaaucguugagggaucugggcucuuaugaggcuuacacuacaaugauggaacuggaaauuucuguagagccauuuaaauauuaguaaauugaaugaugucagaacaaguaauagaucuuugccuuaugugaaauauaguggguagggaggaagguagggagcucaaaagagccuuaacugcaaguauacauuuucugauuucccccauaauguauaugaaacuauaaucugguuuggggucauuaacuucagcucuucgguuuguauuuuuaaagcauuugaagacacuucgucacccuugcuugcuaagauuuuuaucuuguacuguggaagcggauggcauucaucuugucacugagcgaguacagccccuggaaguggcuuuggaaacauugucuucugcagaggucugugcugggaucuaugacauauugcuggcucuuaucuuccuucaugacagaguaaguaaccuguauagucugcaucacagacuuugauguagaugggggugggagggugaugugugugguaauacuuauaaauuaugguguucauagaaauuguaaguuaaguguuauuauuagaaaacuuccugaggaaaaauagcauguuggaaggcacaagaggugcuauagauagagguuuuauagaauggacaacuaguucugugucccuggacaguuacuuauagaauuuuauuuuaguuuacuauagucugucucuaguuuuggauaauucuuugccuaaacauagcuacagcuggcaugaguuacuaaaacaaagaaaagguguaaugucagugcugccauagaccaaaguuccuauuuguuuucaggaguugugucccauuuuagauuuugaagaaagaaaugaccauuucuuaggaagaggcagaauacauacauauccuuuccuuucccauuugaguaguuggggccaauugagagacagccucuuaacauucugugguguaaccagugugcuuggcucucugaugauauuugcuauuacuagaagaugguuccuagguuuacuucuggucuguuucuugacaguauuacuguuuucuuaaugguauuugcauucugaggcauuaaggucuuuggcaguccaccaagauuaaaaaauacuagucacagguuagaaacacuuggacuugacucaucuuuauguauguuuuuaaauuuuuuucaauuaauuggagacagauucuccaaauaucauguuggauuuauagucucuuaaaagugcauuuacaaguucgcaugauaacgagaauuauuagugguucaguggggagaaauaucuucuuuguugacaaaagugcauacacaugguuaaaaaguuuguacaguaugugggugaggugucccucucccauccuugaauccagugcccuaauuccucucuucagaggcaauggugguaacucguguauuauuccagagauguucuuugugcauauaaaacaaauaucuaguguguauacuucuucucuuucauuuuuuucucaaauggagauauacuauacacacuauucuaaaccuuccuuuaaaaaauauuuaucuuuuggaguauucucuauaaaaauauuuacacauuugauguauuggguagaauauuuaaagugcucuuuuggccaggcgcaguggcucacaccuguaaucccagcacuuugggaggccaaggcaagaggaucgcuugagcccaggaguuugagaccagccugggcaacauggcaagacccuaucucuacaaaaacauuucaaaaaaugagccagccaugguggcacaugccuguagucccccuacaccggagacugaggugggaggauugcuugagcccaggaggucaaggcugcagugagcugugaucacaccacuguacuccagcuggggcaacagagacccuguaauaaauacauacauuacauacauacauaauaacuuuaaacauacuuuuuuaucacugaaaugauuuuugguuuggggaaaaaaacuuaaauaccugaauccuguucuuauuuucucccuuucuuuuacuuauuugacuguacuauuuuuacaguuuuaaaaugggcucuuuuguggucugugggauauuucuuuuuuuuuuuuuuuuuuuuuuuuuuuuuuauuugagacaaggucucacucugucgccuaggcuggagugcaguggugugaucucggcucacugcaagcuccaccucccggguucacgccauucuccugucucagccucccgaguagcugggacuacaggcgcccgccaccaugcccggcuaauauuuuguauuuuucguagagacgcgguuucaccguguuaaccaggauggucucgaucuccugaccucaugaucugccugccucgaccucccaaagugcugggauuacaggcgugagccacugcaccuggccagucugugggauauuucuggugguccuuaucauuccauuuuccucuucuucaggcagaauuuuuuuaaugccuacuaacaagauuucagaugaaguagaucuggguucgugauagaaugugggugagaaagaauuuagagaagaaaauaaauaaaauaaccuaugugagcaaagauauauuuuaucuuuaaaggcauuggaagcaaauaauauagauuauacagacuuguaaauguauguuuaagaacauguauauccccugacucccauagaaaucgggagaugacugugugcacuggcuuuaauguguuuauuaaccugccacaugaggcagggggagauaacagaagcccuuccauuccauuuuucuuuuuaucuaacuucauucaauuuguuguuucuuaaaguuauaguuccauuuauuaugccacaagugggaaggcuugucauaauuuuuuuggugauuaguauuuaguuuuuuaaaauaaagauugugagagauggagaaaaacaucuuuugaaguaaauuucuauuucagauccuggaguggcacucuuccuucuguucuuuuuuuuuuccagggacaccuaacacacaauaaugucuguuuaucaucuguguuugugagugaagauggacacuggaagcuaggaggaauggaaacuguuuguaaaguuucucaggccacaccagagguaagccaggggacagccccccuuccuuacuugguuuuuaauagcgucuugguaugugguucuugccuaggcacuuuccuucaguguuagcuuggucuuagauuuggagacuugaauuuuuugucagugcccucauuuauagaauuauagcauuuuguuccucagaggcagugggggucauguauccuuucuccuuauuuuauaaauagggaaaccugagacggagagagguaaaauguuucguucagauauuugaguuaaaugccccuccucucugccccauaguaccuuguacuuacuuggaucauaccacuugauagugaaauuaccuuuauguaucugucuuguauuccauugguugggcucuuaagggugugagucucuuaucuuuauaccucuaccuagaauagugccuggcacauacuagguauucagaaaauguucuuugaacaauuguccgaguugcccaauuucauacaugguaucuuaguagcgggauuuaggaccugugcaucuuaacuccuaguggacuguguuguugcugauguaguauuccuuauacuuuugucugagaguucugcauguuucccucccagguugaugaaccuuucuguuuucuguuuuguguguucuuuucacauuuugcguguugcugcugcauucacucuuucuuaaggaaaaaauaaaaaccauuuccaucuuaauaucccuacggaaaugguggcucacuguugacuuacuguuucagcuuaauuuccccuauucuuuuuugugcugcuuccacacuuaacuugggccaugucuaacguguaccuucauggguucuugcucaguucagauguucuaccacaaagacaucuuucugguuauucuguccauauugaucucuuucuucccugaauuuaccuuuuguguacuuuguauauagcauguaauccuuucugugcuguuuauuccaaauucuuugccaugggauauaaggcccuucacaaucuuucugcagccuaccuucagccucauuuaccauuuagguuuuucuggggagugcugggaaacggaauuucucucugucacccaggcuggagugcaguggugcgaucucggcuuacugcaaccucugccucccugguucaagugaucuucccaccucagccuccugaguagcugggaccacaggugcacaccaccacaccugguuaauuuuuuauauuuuugguagagaugggauuuugcuguguugccaaggcuggucucaaauuccugaccucagguuaucugcccaccuuagccucccaaagugcugggauuacagauaugagccaccgagccuggccucacucaagaguucuugagcuauagucugguuacaucuuguuccaugcaguucagcuguguucccacauaugccuucuuccuucacacucuucuucuuuguaggccauucuguugcuggaaugcauuucuucccauuggcuucuggaaaaugugaacucaucuaagaucuggcuuuaaucuccuuucugugacuccuuccccuaggcauuccccugcccaacaaaauuagucaccccagugcuuccagggcacuuagcacguuuauggagauucuuaguuuacauucuagguuaugagcaccugauugggggcagaaacuuuauugcauucaucuuguauuccuaguguccuaaaugauguucgggacauauaggcucuucaaaaauagucuucgaaacuagcaaauuaauaugcuuauucuguggauguugguuuugucuccauaacuaagguucucaacuuucuaaucucgugugguagcaagacuuaagauucauuugguuuagugagauuaaugacagauuuguucugugcuagaaaagccuucuuauuguuaauaucuaagcaggaaaagaaagaaguguucuaauuuccauauaaggaaaucagaugcacagaugccucugaacagcagagcgugucuguuaaaccagaugaaggggagaggaaaaggaacuaccauuuauuacugugccuugugcugugccagguacuuuauuugcauuuuuaaaauuagaagcauuuuaaauuugugcaucuaauaugcggcauugauuugaagguuuaauuggugcuguuugcauugcucauugcuuauguaaccugauguaagagauuaguucaccaaacauauguaugaaucauuuucuuuaauuuauuucucugucuaguuucugaggaguauucagucaauaagagacccagcaucuaucccuccugaagagaugguaagaugauauacuucacauauaaugaaggugccuuuguguaauugaguaugaaauuuuaaaaaacuuuccucugcuuacuccuuucuuuacugaguuauagaugccucauaauuccucuggccuuaaagcuuucuaagauuaaucuuaucaccacagccagggagccagcuuaaauuuuuuugucacauaaacaccuaugauauuguuuagagguagagauaccucagugugaacagacaauuauacccauuucacgauaaguaguuguauuagucuguuuucaugcugcugauaaagacauaccugcgacugggcaauuuacaaaagaaagagguuuauuggacuaacaguuccauguggcuggggaggccucacaaucauggcggaaggugaaaggcacuucucacauggcagcagacaagagaagagagcuugugcaggaaaauucccuuuuauaaaaccaucaggucuugugagaccuacucacuauuaccagaacagcacaggagagaucuaccuccauaauucaaucaccucccacugaauuccugcccaugacacaugggaauugugggaguuacaauccaagaugagagucacagccaaaccacaucauuccuccccuggccccuccccagucucauguccucacauuucaaaaccagucaugucuucucaacagucccccaaagucuucacucauuucagcauuaacucaaaaguccauaguccaaugucucaucugagaugaggcaagucccuuccaccuaugagccuguaaaaucagaagcaaguuaguuacuuccuagauacaauggggguacaggcauuggguaaauacggccauuccaaaugggagaaauuagcuaaacaaaggggcuacaggcaagugugaaauccagugaggcagucaaaucuuaaagcuccaaaaugaucuccuuugauuccgugucucgcauccgggucacgcugaugcaagcgguggguucccauggucuugggcagcuucuaccccuguggcucugcaggguacaguuucccuccuggcugcuuucacaggcuggucuugaaugucugcagcuuuuccaggcacguggugcaagcugucaguggaucuaccauucugggaucuggaggaugcuggccuccuucucacagcuccauuaggcagugcuccaguaggaacucugugugggggcaccgaccucacauuuccuuuucacacugcccuaguagagguucuccauaagggcccugcccaugcagcaaauucugccugggcauccaggcauuuccauacaucuucugaaaucuagguggagguucccaaaccccaguucuugacuaaugugcacuugcaggcucaacaccaugugaagcugccaaggcuuggggcuugcacccucugaagccacaugcugagcucuacguuggccccuuucugccauggcuagagcggcugagaugcagggcaccaagucccuaggcuucacacagcauggggacccugggccucgcccaugaaaccacuuuuuccuccuaggccugcaggccugugaugggaggggcugccaugaagaucucugacaugcccuggagacauuuuccccauuuucuuggggauuaacauuuggccccucauuacuuaugcaaacuucugcagcugccuugaaugucaccugagauuuucuuuucuauugcauugucaggcugcaaacuucccaagcuuuuaugcucuguuuuccuuuuaaaacugaaugccuuuaacagcacccaagucaccucuugaaugcucugcugcuuagaaauuucuuccgccagauacccuaaauccucucuuaaguucaaaguuccacaguucuuuagggcaggggcaaaaugccaccagucucugcuaaaacauaacaagagucaccuuugccccaguucccaacaaguuccucaucuccaucugagaccaccucagccuggaccuuauuguucauaucacuagcagcauuuuugucaaagccauucaacaagucucuaggaaauuccaaacuuucccacauuuuccugucuucuucugaacccuccaaacuguuccagccuuugccaguuacccaguuccaaagucccuuccauauuuucagguaucuuuucagcaacgccccacucuacugguaccaauuuacuguauuacucuguuuucacgcugcugaugaagacauacccaagacugggcaauuuacaaaaguuccacguggcuggggaguuccuuaaaaucauggcagaaggcaaaaggcacgucucaccugguggcagacaagagaagagagcuuaugcagggaaacuccccuuuuuuaaagccaucagaucuugugaggcccauucacuaucaugagaacagggcaggaaagaccugccccccauaauucagucaccugccacugguucuucccaggacacgugggaauugugggaguuauaauucaagaugagauuugggugggaaaacagugaaaccauuaucaguaguugcacuuugcuggaauccauaauaauuauggaagcaaaaacccuaguccuuucuuguaugucacccaaaccauucaucuaucucuagcugcccauuacuuaggauuucaagaugcacagaagaaugauuauuaagagugcugguaaagaaaaauucuauuuaccaauaaauucaaaagcagaugcuccuucuauaaauuuguucuuauagccacuauaaauaauccccaaagauauauuuagugugcuuuacaggaaauaugaacucaacuauaaacuuaaguauagaccuaagacuugaaauaaaucagauuuauccaaaucaguauuauguauauauacuaguguuuuuaaaaucggugauuugcggguuuuaagucaauuuaggggguccugacuagcauuuuauaaaaaaaaaaagaauaaaagaacaugucuuugggcaucuuagauaguaaggcuaagcacuguuuuaugaaacuuuuguuuccauuauguguguauuuaugcacguguauguauaguagagcaugauauaagacauauucuuuaccauggauugcugugaaaauauuuguaaaagccaccgacaugugccauauucuaaccuuuuuaaaaauuuuugcucauuuuaauguuuuacaaucuucaacaaauucuauucacuaauaguguuaagaaucuauacauucaugugugguggucugaagauagauuugaguauaauaaauacaaacaugggagaaggugcuucagagaaaauuagaaauggcuuauaaggcagauccucuaguuuuaauugucuucacugcuuuuagucuccagaauucacaacucucccagagugucauggacaugcccgggaugccuuuucauuuggaacauugguggaaaguuugcucacaaucuuaaaugaacagggugaguuggaguuauacuacugcaucuauagaauaaguaggaaaaucauccaugacguauucuguguggaauucaaaggacuacagucuuugagcacaguaaggaaucuuuugcuuaccagguaacuuuuuuagggcagauacuaagaacaguaaggaaagaagcuuuggguuucauuaguuugcauggugaaaagaauuuuaaguaggaagcacuuugaacuauggcugucaguaucaugugugauuaccuuauuaauugguaauaguacuuaagcggucuaaauguagacucuauuccuuauugaaccggccaauaaguacauaacuaucauuaaugauuuauauguaauaaucugaauaauaggguaaaauucauaauuuuuuguuaaauugagcucaacauuucuuuauucuuucaaagcucauuugauuuauuuuccuauuaauuuacucuucacuuuuuucuuucauugccucuuaaagcucaggcugcuaaagacauuguuuucuccucucuucuguguucucuaacugcaugcuuggcagccugcuucacucuccugugcccacuuuaggacuuuaauuuuccacucauugaguuuacugaggcaugugucacaguaggccccuuauuggccuacaucucacauggcucaagcuuugugccaguucuaaugcgguuuauucugccaggcuuaugcaguguucugauucagcugucagcucuaaauugucccauccuaaauacuugagaauuaaauccuaaggcccaaaggcauccauuguguauaaugaacuaacuauucuauguauuuagaaugguagcaauuauuuacuauccuuggaagaauuguaaauauaaucauucauauaacuguucuguggaugaggaaccccuguugagaaagacccucaaaccuaucacuguuagcccuucuucuuugggccugagcuggguuaaauggauaaucaggaaaugagaggguauagaagggaauggcaccuggggugggguuugauggugguggcaggacaacuuucuacaccugccaaugaguuuugccuaaggcaagcaggaagcuguuuagcaacagccagggcuuuguuuguuugggcuuuuacagguugguuuuugcucucggcagucuccagcuauagagguccugaaaagagggagaaggcauuggaaacuaacuguagcucuggauuucaguuucagcggauguucucuccagcuuucaacagaccuugcacucaacuuugcugaaucccauuccaaaaugucggccagcgcucugcaccuuacuaucucaugacuucuucaggugagggcaucugguguggugacgccagcugcuuccggaacacugcugccugcucuugugccuuggauaaguggcagugggggguuuuuggaggaccaaaugaugcaguuucuguuguuaauuauuaggagagauugaaucauguccacaggagaaaauagaggaagaaauuggguugucugucaguuuccuauuauagauaggaaguuuuagaaauccuugauugucuugaaggcuuggauuuagaaacuguagccagauuuauuagggcuucuaauagugaagaagcuagguguguccacugguuuacaguuguaaguuaauugaaaaaguuacuaaaccuagccuuucuuuucugcugccauuauauuaugaguuuauuauuauucaguuuuucucauggggauggggaaugaguucauauucuuugucuaguaauaugugauggaagagcaaauaaguugguuuagaggcaagggcacaauauaauuuaauaccuuauuagauucagagauauuuuugaacccuucuucaagguuaguuuuaauuauguguccuucauuuuuuuauuuccaugacugcagaacuucugcacagguuaguuccauauucaugacuucuauuagcaaagccaaccuuauguuaguuuuaaaacuaaaaauccuauguguuugcauuuagagcuugagaaaaaccagagcaaagggaaggcuaguauuauucccaaguggggaaaauuaccucuaggauagaacuagggguagguggggaaggguaaucuuauuaaauaaguagcauuuaugguuacugggcuuauauugucauauuucaaacuauucaaaacuuucccauuaugaucgucuuuuuugaggauguuuuuaaaaauuuguauuuuuaauugacaaauacaaauuuuauauuuaucauuaugagagucuuuccaaaguacuucuaugcccuuuuggaugauucuuagaaauauuuuauuucccuugauagaaagucucuacaaagaacaaucccuuaugguaaauagauucucucaucacucuguguaaaaugaguuauuuauuaagaguuguauuguaaauugagaggggagaggaaaacugaaaacacacaaaccguaccugccaaaaucccacuguuaauguggggagaaaccccaguuaagagacaacaguaggagccagggucagcaucucuuacagaggcagcugaaccaauuugauugauuagauuuaaguuuagacaucuuugcugcugaaccagggggaagccuaaaguagguauaaacauaagaugugaagauccaagugguaucucugcuuacugggccucccaauaggcuguccagcuuguaugccggagcaucuggggucaacagucucauauacaguagggugugagcugagcagugcacagccuuuggaauucucuggcagcccuguaggaaaccgaccacuccucucacacuaaucccugccuggcugaaagaaugaccaaguaacuuacagcaggagaaaugagaagauugcuguauggaaauuccacuuuccacaaucucuuuaauaguuuuuauuucaucaaaggagacuugagagucagcaauauuuuguaaugguaaugucauuucucccaggauacuucauuuaacauccuauuacaaccaacaguuuggaggauuuuucugacuaaaccauaaagcauguuagcauauguguguuuaaacuuguauccucgucacagaucucuuugcuauuaaaauauuagauuucagaggcguguuccauaguauuugucucauaagcuacuuaguuguaauagaaucuuuaaauggcaaaggagaauguuucuugguugaaaauuauauugauguagucugugauuaugaccucaauauuuaacauucucuaaucuguucugcugaauuccuucucuuuuuggcauuuagaaaugauuuucuggaaguugugaauuucuugaaaaguuuaacauugaagagugaagaggagaaaacggaauucuuuaaguaaguucagaaaauuaagaauuuaaauugaauaacuuggauuaaguccauauaaucacuuuagguauucuagagaagaugagucauauauuugguuuauuucacauuuauugaacauuuccuaugugucaggcuuucugcuaggcccuggugggguagauauuucuggugaaagaaauagauacccagacugauaauccuuaaacagagagguggguacaguagagcuuuuggaaggaguccugagaacacacagggcaggaggaggucguuagagaaaagguauucuaggcagaggggcaacaugaacaaaugcacaaagacaagaccuagugugacuugugcaggaaccgcaaacaguugaguccugcugggggacaaauuccaagacaaggacagguaggagguacaccuugcauguggcagugaggagugcugauguuauuuguaaauaggggacuucaggcauugaagccaucaaagagauggaagcaggcugugaaacagauuaaugucccuuuagguggaucacuuuguucucuauugagugggaaggcuuaacucauuuaagauuuggauugguuagugacuaugguaguccaggcaguaaauaugaagccacacauaagggcauuaaugucuccaaugaagaagacacuaagauaaacauuuaaaaagauaaagcugagaagccuuagugauuaucaccaaaugaaauagagaauauuggaggagaggaccuaauaugcagggaaaauuaugacuucaguguuggauauguugguuugaaguaucuguuggacuuuagauagagauauacauggaccguugaacagacaggucugaagcuucagagaagucuuaagcugaugagcuagagggaaauauuaggguguuaucagccuauaguuggugauauuuucacagagaaaguggguagcaugaaaaggacagugagcccaaauuguaauccuggggcacccgaccuuauaagggggcuggugggaaggaguggcugaugaaugagaagcagggguuagaggagacucagagagcuaggaaggcuaugauauucccaaaggaguagggaauuucacgaagguaggaggaacgaacagguaccuguucauuuaguaguuaggaagacacugguaacuuuaucuuagcaagagcuguuccagcagugagagugcauugggcugagaagugaacagaaggugagaaagacacuggagaaaaacuuggagagaaaauauuacugaagaagcaaauggggucaaggaaggauuuuguaaggguggaagagaccugagcauauuaauagacgagggaaaggagcuagcagaagaauggagggagcaguugaagcugcaaucaaguuggggagaugguuggugcauuguccuggaagagaggggaaugcuggggcaguggcuggauggggguggccuuaaguaagaggaggcccucggauccuuaauaacuagaagggaggugggaaugaguaucaauguaaaccuguuugcugauagcgguguagggguuugaaggugauaaugcaugugaccuguuuccuaauaaaguaggaggcaaggauaucugcuaagggugauuguauaauggaguaauauuaccauuaauaccuaauaucuguauuucuuaacaaagugccuuuauauauguuguuuuaauuuauggggauagugacaaaagccuauguuuuguuaguuauggaagcuuucuacauuguuuaaauuugagaaagugucuuuuauuaucuacaaagccugucuucuuaggguaaaaaggagggcacuuugacuauuaguaaggggauaauuugguggaaacauuuccuggugugaauuggaggugugcugacuagcuggcuuugcucacacuuucuguauuuuuuuuuuuuuuuuugagacagaaucucacccugucacccaggcuggagugcagugacaugaucucagcucacugcaaccucugccucccagcuucaagcgauugaaccucagccucccaugccucagccccgaguagcugggauuacaggcgucugccaccacgcccggcuaauuuuuguacuuuuaguagagaugggguuucaccauguuggccaagcuggucucaaacuccugaccucaagugaucugcccgccgcggccgcccaaagugcugggauuacaggugugagccacugcacccagccacgcauuuuucuuaaguacuuggggaccaaucuguucaccuucucuaucuccauuucaaaugcaucacuuugauagaagugagagagaggauguguguaggcuaaacuguacaaguaagcugauacagugucaugaccaguuuccugggcuuucccuuuuuguccucagauuucugcuggacagagucagcugcuugucagaggaauugauagcuucaagguuggugccucuucugcuuaaucaguugguguuugcagagccaguggcuguuaagaguuuucuuccuuaucugcuuggccccaaaaaaggugaaugcuuuuucaaaguguuauugcuaguuaagaaguuuggugauuauuaguccauauuugagcaggaugagauuacugugugguguaguuaauguuugguucuaaaaacggagaacaauuguuggccccugaugugauaacuuuaauucaaaccuggguaccagaguucacaggauaaaugaagcaucuuccuagagaguccaauuuacuauaguaaguguuauaucugacuagaaucugaaauauacauuugaaguuuuaagguaaggcaugcaucuucaaagaacuuuuacauuuaucaugaaucauuuaggccugugccuccuaccuuaccaagagcaacccauuuauuuucuauuuucagugaaaagcacugagaucauuuuacuuccuggggcuucaaguuuuuuuuacgaaugugaaaugagguuauugcuuuggaauuuuacaauuuuauagcacuagagaugguaacaacagaugagagaauauaguauuaauaugacacuagaauuuuaaguuacguagaauccugcuuucagaauuuauuuucuuaaagggaucucaguccaacaaagcauuguuacaguuuagaauuuccuuauaucucuacuuugauaccauucucuuuagccaugaauuuuucuuuauagcucuuacauccuauuccucaguaggucuuacauaggggugugccucugaaucaccuauguugcuuuuugaaaauuugccucuuugcuugauccauugguucuagaacagagagccaggacauagguauacauauuuuuuaaaaguucccaaauaauucucaauacauaccugccugauaaccacuaccauaaauacuggaaaaagaggaguauccagcaucaaagucccacuguagcauuuaacaccugguuuugcaaauaaaacuacaacaauaucaguaugucacaaaucuaguguaugaaauuccucacugauuaaacauaaauuuauaaaaaguuacucagaauucuguuaaaauacaagcuuuguuguacacuaugaucucuaguauuucaaaaacucuacaagguaaguguacuuaacauaauuaagcguuaaguaauuuucggucaagaaaagaacuuugcuuugguuuggagcauuagaauuuagaagaauacuggccgggcgcgguggcucacgccuguaaucccagcacuuugggacaccgaggcagguggaucacuaggucagaaguuugagaccagccuggccaacauggugaaaccccaucucuacuaaaaauacaaaaauuagccgggcaugguggcgggugccuguaaucccagcuacucgggaggcugaggcaggagaauugcuugaaccugggaggaggagguugcagugagccgagaucgcgccacugcacuccagcaugggugacagagugagacuccaucucaaaaagaaaaaaagaauuuagaagaguacuuagaauauguguaguuuuggguucaguguaugaauuaugcuuaauacuuuucacugaaaugaaaauuuguuuuuucaucuguaaccuuugauuuuucggguagaucaugcgcagggagaaacuccuugcuugcucucaccagcccuguuccagucacgggugauccccgugcuucuccaguuguuugaaguucaugaagagcaugugcggauggugcugcugucucacaucgaggccuacguggagcacuucacucaggagcagcugaagaaagucaucuugccacaggucagaggccaaguuugcagugggguagucacagaaccugagggaagagugcugaaagaaagaguuuuggagguauucagauaauagcuuagaaagccuucaggcagcagucuguggaauacaaagugcugaaauuaaaauugcauuuccauuccauucacacaggcaaauugauuaaacugacauauuuggucuuaaccugggagaaacuauaauuguuuguuaauuuugggaggguaaaugaauaacaauaauguauggagcacuuugugaacauaacauauaauuauccauaauuauuauaaaguaauuaaauuagaacagagaggagcaugagaugauucuuaucaguggcuuucagccuguuguuaucagccacuagggaaccuuauuaugauuugcccaccaaaggguuuuguuagugaaacuaaugaaagguuuguauuaguugcuuaggcugccauaacaaauuaucacaaauuauaauggcuuaaagcaauacaaauuuauuuuuaguucuggaggccagaagucuaaaaccagggugucaacaggacccugcuuccucugaaggcuguaggaugugaaagggacuccucuuuacaagcuucucguagcucccagcaauccuugguauuucuuggcuuguggcuguaucauuccagucucugcuucuguugucacguggccuucuuaccuccuugucugucuuuacauggccucuuagaaagacaccagucauugaauuuauggccuacccuaacccaguaugaccucaucuaaaggucacauucugcauggacaugaauuuuggagggacacuauucaaccuaguaugagguuuuaaaaaaauuguuuuaaaagacuacaaucacauggugucuuucaaauaauuuuccuaugagauagauuaacauucucucugcuuucaaggagcucauaagugggacauguuucagucauccguugccauguaaguaccccaaaacuuagugccuuaaaauaauaaucauuuuauuaauucucaugauucuuuggauugacuggacucagcugaagguucuguuccacauaucagcugagucuucagucaucuggggcccgacaaggguugacacauccaaaauggcuccuugguaucuuggaagggguggcugagaggcugcgccuuucucuccaugaauuuucaggaagcuuggggggcuuguauccccccaugugacauuuccacaugauuucucuagcaaggcagguggacuucuuaaauggcuggccagggcuaaagaaaaaaaaagggcaaaagaagccuucuuaaaguguagguugugaacugacagucauuuuugccucauucucucgguuagaguuggaaaaagcccaggcucauugugggauggguuuacucaagggcauggauacuggaggugugauucgcugggggcugacuuuaaagucucuguguuguaguaacuacaacauagcacuuuguauuuacaucugcagcaguaauuguuacccuguauguaguugugucuggaaauuuagaagaggaaugaagcacuuuaacucugaaauggaguugucaucauaggucucagaauuggacugaggucaaagaguaaauguugagcauguggaagacaaugaaaccucucauuacuuaggaaacugcuuccccuaaagaagagugggccaauuugugugugcuagaaaguucacuuugguagcaguguggaagagaccacagaaagggagauaagcuaggaagcuguuagaauaguuuagcuaagagaugacaaaggcuggggaaagugugacaguggauauaguagagggacacagaagggguaguacucaguuucucauuagauggaagagguguugaggaugaccaauuuuuggcuugggcggauugcuguuuuaugauuaucauauucagugggcagaacucuaaucauauguaaaagaaacaugcuuuaguuuacauguacagaaagugaucuguuagcauugguccuaauaauuaucuuuugaguccuguuggaaaccuuuaaucuuacuauauaaaugaggaaaccaggccagaaaaauaaaaagaccaauuggucaagucacauugagaauuauuagcagagcuaagaccaaaaccaaagauuccugauaccugucacgcccugcugcuuccaguaggcaggccaguuacccuggccuugugucuggcuggugcagaugcuuugaaggucauuuccuuccuuauaugcagagcaguacuugccugauaucugcaugugacugucuucuaagguguuuuugguugcaaguaacugaaacucauuuuaaaccagccaaagcaaaaaaaauuuaagaauguuagacuaacuuagauggaaaucaagugcagcuggggcuuacagccauguuuuucauuccuuucuucugucugcauuuguuugacuuuugacucucugaagaccagcuuuccuuguuuuggugugcacauggccaaaaugguugucccauaacuuccaaguuuucuguccucauaaaaaaaaauuauuuuagagaugggggucucacuguguugcccaagcuagagugcaguggcucuucacaggcaugaacccacuaccgaucagcccaggaguuugaccugcuccauuuccaaccugggcugguucaccccucuuuaggcaaccugguaguccccagcuccugggagguuacuauauugaugcugaauuuagugcagacacccaaucagcauagcacacuacagcccagaacuccugggcucaagugauccacaugccucagccuucugaguagcucgggcuacaggcacuugucccugccuggcauacuguccucauugaguaaaccuauauaaacugaaaauauaaauucuaguuuauauuacuggacaaaagaucaugaugggcucaguuugggacaggugguccuacccuugaaaagagcugaaaagagaagcauggacaggaacauaacuguuaguacccuagaugaguucugagugcgcucugcagaacacugccaguacaugaacuuuuuauuacaguucugugaugugaguacagauaugaagacuuaacauuuaaaaccuuuugucgcaauuugacagaguaauuuuauguacccaacauaugucuuuuuaauuuuguuuugauuguauuuuuuaaaaaugguaagucugugauggauugggaggggaagauacuggucuuuuaccacagguaguuugagagccacugaccuggaacacauaucuaagauaauguaguuuaucuaagcacaaucuguuugcagcccaauugcucauuuacaggggaagaaagagauagguauugugguugucaacccuuauuaccucauuugcuccuagguuuugcugggccugcgugauacuagcgauuccauuguggcaauuacucugcauagccuagcagugcuggucucucugcuuggaccagaggugguugugggaggagaacgaaccaagaucuucaaacgcacugccccaaguuuuacuaaaaauacugaccuuucucuagaagguaagaauuauuaaaaggucuaacuuuuugugugucauuuuuuuagauuuuuaguauuauauaaguaauguaggagggucauauucagucaaaugauauaaagaaguauaaauaaaaaguuaauuucucuuucugaacuucucggggggauuuucagugggaauccuuucauacuuuuuuuuuaagcuugcaaaaagacacacagauauauguuuacacgugcauagagagucauguaccacauaaggacauuuugguuaacgaaggaccucguaaaugacugacugucuauaccaugauggucucaugacauuauaauggagcugaaaaauugcuauuggcaguugauguuguagcuguaguggaaugcauuacucauguguuuguggugaugcugguguaaacaaaccuagugugcugccaguuauauaaaaguacagugcauacaauuaugugcaguacauaauacuugguaaugauaacaaaugacuauguaacugguuuauauauuuacuuuuaaucauuaguguauuccuucugcuuauuaaaaagaaaaaacuuuaacugugaaacagccuccagggguccuucaggagguauuccagaagaaggcauuguuaucagaggacaugacagcucccugcagaccuuccagcggaauaagcuguggaggucaaagacagugaaauugaugaucuugacccuguguaggccuaggcuaaugugugugauugugucuuagauuuuaacaaaaaaguuucaaaguaaaaauaaguaaauaauuuuaaaaacagaaaaagcuuacagaauaaggauauaagaaaauauuuugguacaguuguacaauauguuuuaagcauaguauuauuacaaaaaagucaaacaguuaaaaacauuaaaaaguuuauaaaguuauaguaaauaacauuauugaagaaaaauuuuuaauaaacuuaguguagccuaaguguaguguuuauaaacuguaugguaguguacaguaauauccuaggccuucauucacugguaacucagagcaacuucuaguccuauaaaugccauucauaguaaauacccuauacagguauaccauguaucauuauauuuuuacuuuucuauguuuggacacucaaauaauuaccacuguguuauaauuaucuacaguauucaguacaguaacaugcuguaucaguuuauagccuagguguuaauaggcuauaccaucuauguuuauacaaggacaaaaucgucuaagaugcauuucucagaacauguccccauuguuaagugacacaagacuguguaggauuuuugcuuaaaugguaagaaaaugccaugcacaaaucuauaauuuguuuucaaguaacaacauaucagggaccugucucccaauacauagaagucuaacuuacucuuugaaagcuaccuaauauuucacugaauauaauucauucagugauuucuuuauucauggauacugcauccauuucuggauuuuuaaucccuacaaacagugcugcaaugaauaucuuuacacguguaucuuuccaguuggucccccauauuugcagguuugcaccugcagauuuaaccaacuguggaucaaaaauacucagaaaagaaaccaaaaaauaaagguauuauaaguaaccaagaaaugacuuaaaguauuaugggaugauaugcauagauuauauuuaaauacuacaucauuuucuuuaagagacuugagcauccgcagacacugaauguuagaaguaaacuugcugggccaaaggauauauuuuaaauuuaguagauacugucagcuuacaaaaagguugcaucaauucuuauuaacacuagauguuuaaguuucuugugacuuuuguuggccuaugggguaaaaagcuguugccuuuuagauacugcaggaaguccuuauuucugguauguucccaguggauguuaccugggagguagcaguaauuucuggucuuacaagaauuuuuuaucaacaaugucauugcuccuuuguguagccuucaguaagacaaugaacuuguuauguaauucuggaucucuaacccaguucucauugauaguugguaacauggagacauuuagcagaaaagaguuaaucagauaggcuuuucucuaauuuugaugcuaaaagaauuuuuaaagcaacauuggcuuccugaaguuuuaaagagcguucaccucuuccuuggugcuaaugaaaccagcgucauggcugcaaagagcuugaaaagggugauguagaggcuguggucucauuuucagcuaugaaagggaaauaggaaauuaagucugccugaaagagagguggagaacaugguucagagaagaagacaucggauaaggcauuagauaggacuucaaggaggauaguggcacaaaugaguggagggcuuguagaggccuggccugagugcuggggugaggaggggggagauguggugcugaagagagcuggggaccuaaucguuaagaguuuaccccaggcuauuccccacauccucacuuuuuggccaaaaauugauugaccaaugcccauuuuuuuaaguauaaacuuucuggcaaacuguuaaggacauuucuugaaacuaauuuuuuccccaguuggggguuaaauguccacagcuuaaauuuauuauuuuaacuacuuuuaaguguauaguuuugugguauucacuacauucauauucuuaugcuuauacucuucaacuuuuauucuuaaaaggaaaguaaguagaaucaguugguuuuaaaucuccaccaacauguuuugaagggcuauaacuuuuuagcuaggugucccaaagguuauaucuguguaaugcuuugauccaucaccacauggaguggacacagccuguucuuaaacaccucuagggacaggcaguccauuccauaauggguguaugucuucaaauguuugaagauguucucuccuccauuuuauccuuuauauguauaaaaauauacccauuucacuuaacuaugcccaccaaccaugugauagaucaagaagcaauuuacugucccuuucauguuuuggaguuuuuauuuaccuucagauucuccuaugugugucgucugcagccaucacagucagaucucgccaaucuuggagaaccccuucucuagcauauucccuaaauguuucuuuucuggcagcacgcccaucaacagcaagaagcacauacagcgagauuacuacaauacucuuuuacagacagguagaaauauuaaauuuauauagcuuuuccauugcuuggaugaauguuuuccugagacuaauaagcuuauggguguuuugggaguuuugagacugauuuauuuguaauuauguagucagcuuuggucucaucuuguuucuccagacuauuggauauauacuuaccuccucuuuauaguuggugagaagugcagguugacauuacuugaauucuuuuuugcacugauacuuuacuuugagacuuuuguugccuuagugcagcaucuuccaaauuguaccaagaaugauaguuuugaaagauguuaaugggcguguugugaaaaagaguucugugguuaaauaaguuuggggaaaugagagcaaagucauuaacacauugcacaggaucucucagugccuuaacuacuacacuuagggaaauuucuuaaagugagguuaauaaguugaguuaggcaaacuuauuugagccugcaagacuuuuucaggcauauguaauuaacaaacaucccaaggauaacacugccuggcuuagagcauuucuauauuuaugugaauauacuguauguuuggauauuuaauaaggauugaaugcacuaguuauuacuuacaugcuuccacugaguuaauaauguaaguauuauguaauuauuuggauaacaugugacaucguugaucuugaguaauguucugcugggaucucuuuuguuuaguaugcauggauauuuccaaguaauuagaccuauacuacuacacuuccuuaaugcuauccuucccauaaguguaguucuuaccuuuaaccaguauuuuaugagaauaauuauuuucccuacaggcgauccauuuucucagccuauuaaauuucccauaaauggacucucagauguaaaaaauacuucggaggacagugaaaacuucccaucaaguucuaaaaagucugaggaguggccugacuggagugaaccugaggagccugaaaaucaaacugucaacauacagauuuggccuagagaaccuugugaugaugucaagucccagugcacuaccuuggauguggaagagucaucuugggaugacugcgagcccagcagcuuagauacuaaaguaaacccaggagguggaaucacugcuacaaaaccuguuaccucaggggagcagaagccuauuccugcuuugcuuucacucacugaagagucuaugccuuggaaaucaagcuuaccccaaaagauuagccuuguacaaaggggggaugacgcagaccaaaucgagccgccaaaagugucaucacaagaaaggccccuuaagguuccaucagaacuugguuuaggagaggaauucaccauucaaguaaaaaagaagccaguaaaagauccugagauggauugguuugcugauaugaucccagaaauuaagccuucugcugcuuuucuuauauuaccugaacugaggacagaaauggucccaaaaaaggaugaugucuccccagugaugcaguuuuccucaaaauuugcugcagcagaaauuacugaggugaguacuuuuauggaguaaacugugcuacuagcuuuaggauuucccucauagguccuaguugcaguaucccauuuauaacaagcaacaugcuauuuuccuagucaagucaagcacaaaauuaacaaaaucaguuucuaucauugguaucuaucuuuccuucccccagaaaaauguagcaaugcuuaguuuguuuaaugagcuauuguaaccuuuuuauuugaaaaagaaaaaaaagggauuaaaauaaggauuuggugucauccacacugauuuuuacuggauuuuaugguuuuugaaaagcuauuuuccagugccaugguuuuguaauccuacuuuucaacuuucuguuagagcucuaaguuauuuuacuuaguacgagguaguguuucuggcaucaaaagauaaauuuuaaauuccugcuuuuucaaauuugcguaugauuuuugcauaugauuuguuucaguggguucuuggugugcuuuauuuuguugcagggagaggcugaaggcugggaagaagaaggggagcugaacugggaagauaauaacuggugacaauagaugugaguuaaacuuuaggaaaaaggauucccuuuuuuuaaaaaaaaucaauaccucaaaagcaggcuuugggacaagaaaaccccaaaguggccugcuuuucccaucccaggagcucauuauccagucugugccaacugaaguaggagacugacugugagugcuggcuaaaagcccuggguggugaggcucacaguacugguuuccaggaggaagagccuuugugcauuugacugaggccaguuucuaugaagagcaaguagcugaggagaggucgaauuuacugcuuuuuccaggacaauucuggaaguaaagaaaauguaauucaagcugguuagcuuaauuuugugccauucuuuaacauaagaguaagcucuauuaugaaauacaacuuuaaaaaauuuuagcuauaaauuauauaaaugauuuuaaauugcugagguuuccuuaggcagcuuauuuauuuguuuacaguuagacuaucugaguaaaugguucuuuguggaccuaggcaguuccugacuguuccacauguaguacauuguaccaaaguucuuaauaagaauauuccccacaauccuguucucuaaaugucaaauaaagauuauuuucacuagauucaacuuuacaaaauuuguuuuauaucuguuagaaaauguacagacauaaguauuuucaguugacaaagcaucaaacccaguucugccuagugauaaguuucacccuagaguauguauguaacguuuuagcuuauccauccuuucuuggagcgccuccauuuccauugaaagccaggcuggagcaggacccuuuuggaguagugacucaguugcuuccaaagccccugcuauuguaugcagcgcugaccuguacucuucuucccaggggaacuccugacgagcucuuuuugcauaaggcuggaaaaaaaacauaaguaauaucacaauauccauucuaaauauaaagaaccuuccuuuuggacuggaguaaagcuuacaugcaaauuuuauucuagucauuggaucacaaggguaggaggaugcaccccaaaaccccuacacagucaucuagaaaaauauguaaaggcauuuugguuuaucauagcaauucagagugcuacuaccagugucuuaguuuguaugugguauacaacaaguauccugucccaaagggcucccaaugagaagugcugcauaguccaagcuuacaugucuuauaaacaaguucauaaauguauuuucuuuuuaugagaguuugacuaaaacuuaucagaauguuguucuucaugaauuacuacuauacuaauuacuauacuaauagugcucaaaacaauauuuugaauauccuuauuggugucaaauucugccuuuuaauaaguagaugugaucuucaguuacugccaaaaauuauuaggagacucauuugauuaauaaggcaaggaaucaaacuaaacauuuaggaguaaguuucuuucauuuucuucugugguucaguaaagacugcauuuauagcaucacugguacaauauguaacuucccuuaaagguuacuaccaauaauucaaacauacugaaagaauauauuugauauggug

SEQ ID NO: 12928 - RNA, 2380 nt, Homo sapiens
aaauuuuugguccuucuguuuauuucauuuuggauacucagugaauguuaauuaaccaggaaacuuaaaaguuauuucaauuaugaaccucuucaauccuucaucaauuauuuugaguauucuggucuuaaaaacaucucuuucuucuacaaacuucugaaagagaugaacaccuccaccuacaccaaaauaaugugcuuugcuggccaaaaguacacguccauuuuuacuuaacagucuaaggaaagucuggugcaaauuacuauaauaaucuggguuguaaaugguuucugaggugagaaugagaucauauuuuacaaaaaguuuuucacuacuuaguacaagcuuacaaaacucagaccacucaccagaaaaaaaucggcauuuauauaguuguguuacuuuugguuuccugcaucuuuucacaucuggcucauuuacaucauuuucuucaucuuccaaaguggaguuagcuacuacauuagguaagguuacuucaucaaucaccauacuguuauaaucuugaaagugaauuucuuuggacccucccuugaaugcaguuauaccuaguaaaccugauccacaaccaagauccaagacuuuuuucccagcaaauuucacuuuggccuuugugaaauaagccaggaggucaaagguacauucccagauuuuuaagccucccucauaaacaccuguaaucagaucagagugagaagaaaagcuuuuugaaacuauguuuucuccagggaaguucucuuucaacaagaugguuuucacuacugauaacuuaacaugcuggaaaccugguaauguuucuaugacuuuauuuucuaacaucuucuuuaaaucuuuaggcauagcaugcucuuuggcagcucucaaggagggcuguuuuccauguggcuccaaguuccuugaacugcuggcugcacugaguggacugucugugucuugagagggagcugcauuuuccauugacuuauguucccacaagugauccugaggcaagucaaauuguucugcagaacauuuucugucccucucuucuccuuuuugacuuucugagacugacagcucuuuugaggaauccagggucaaagcuccaucucuaauggguguuaauucauuuuccagauggucuucuauagugaaauuaaacugaaaggucauccucuuauuaaaugcacacaaucuuuaaauucagauucuucaacuucuggauagaauuugaugauacacacaaaucugccucaauuauucaauuaguuuuguugggcccaauuucucuuuagcagcuuauacaugguaacaaauauuuagagauauuuccaaaugacuuuuuagacgucuuugguccucuuuccaagcagcucuggaaagaaaaaaaaaaaaaaaagaaagaaaaugaugauuaaagcaaaauggcacauuucacuaaaguguaauauuaaacagccacccccaccccucccugucccaccauacagcugcuuuuucuuaaaaaguuguggggaagagagagagauaagagauuuggacacucauacacaccuuaaggguuccaaagugggagaagaaaaucaacuauaaaaacaaacagaagaacaacagcaaccaccaccacuaccaccuggacaaacauaaaguccaagauauucagacaggacagccuagcuacuugcugucuuucagcugucuugauuuguguccaaccauauucacccccuaagcuuccagaauaacuucacuucugucuuuuacagaagaggugcaguauuuuauuuugguaagucagcgucccuuuaaaaacaugcauagguauggccugguguguguaaauucauccaagacuucacuccaaacauuuagucgagaacagcagcccuaaguguauagaaguggggguaauuuggcaauaauuaguaaagacuaauucgguggcagagcaaacgcaaacuagggcacugcaguaguuuggagagaccuguagaaauaagaagcaacuuuauugagaaucuucuaucuacugcgcuagacacuauaccaucugccucaauuuucacaguucuggcaagugggaucuuuguucccuuuauacaagauuuacaauuugggggagaggcgggucacccagucccgcggcuaggaacgcgccucuuuccucucccaucacgcugcaaggcuuggagucacuuccggcugcaggucccggaacaaauccgaccccagaaguggggacuucuggcccucaccuccccauuugaauguaauguuuacagugauccagaccuggggaugcuugcuucccgacguguccugggaucgcgcuucugaaaaagcucaccucacaacgccuccuccggaccuaaaucgcgcacca

SEQ ID NO: 12929 - RNA, 3205 nt, Homo sapiens
uucuggguuugguugagcaagcacacauuuugcauggagggauucacuguagcucucaguacaucucuuugguauugaagcagaguauugaccuuugucuauugucuuagccacucacaggagaguauaugaaggaaauuuggaaaaacagccucaauguuuugguagcauuguaaauggagaaagaauaagaguaaggaacacgugguuuugccucugagcaguuaagaauagguguugagaccuaugucaacaauagagaaauucaaugagaucucuuucagauauuuuaacauagccacuuuccauuaccuugauuugagcaauuaauggucucucugaugcccccaguuacuuucuaugaggagugaugaagaagagccccauuagguuauaaacaaaacuuuaugaacuuauaggcaggcuaagugucuggagaagauugagaaaggauguuuuaaaccuuaagagaugggauguucccaucuuuaauuccuagacuaaaguucuuuuucugaugaacagucugaugaacacaguuucccuuacagagaguuuucaucuauuuggucuucucuguuuaaauccugcaucaacuuuacaaauuuucaggagaaaaagcaaaucucuuagcuuaucacaccaggucaccaauacaggggcagcuucuucugccccuaacuucaucuccugccuccuccauaauccccuuuugauucagaugcacugaacugcgaaacauaccaucuucucauugauuuuacacuuucaugucuuucuacaugccauuuucucugauggaacucuauuuccauuuuccccuuggcuaaaugccucucauucuucaaagcuaagcuugaaaaaggcuuucugaccugccagucugguuuaggcaucccuagucuauguucuaauaauaccuagguuguauuuguguccuaacacacuuacuacacuucacuaccggcacugauuucaccugucuccccuacuggauuuuuccuuccuuaauaucagaaaccaucauuaugagucucacacucuaacagaguugaugaauaaaugacugcuacaugaagaaaugagugaagucaggaagcauaacaccuuucuaauuagcuuuagugauagccuaggguacuuagaccagaggccccaaaugcaaaacugcaaaguagccucauuugaauuuugggagagagcuuuugaaaaauucagauuuccacacccacuaccaagucuccccauagaaggaucuauauuuuuaggaaguucccuaggugauucuaauggacaaucaguucucaagaucacuuaucuuggcuuuauuuucuuuuaaugcaaauguuuuccaacaugaacuacugaaguugugguuuuugccuccccacccuaaauuacauaaaucaauuucuuuugauuuauguaaccaagaugcaaagagaagacucuuuccuauuuaccuuuuugucugaaacgcuuucuuagcaaagccaggagcgucccacccauuaucagaccuaucguagaagccaccgcuccaccaaaguaagucagggcuuccuggauagucaaugguccugcuacaaaacaaacacacacacaugcaagacauaagaaguguauuaugcaaaagacuagucuuucucucccagaaaguuuucaagaacucuaagaugugcgaucaaguaggaucaccaaagguccugggaaugcugacaagcuaacaugaaagaagaucuggaauucauaaauccacugcaacagaaugggaaguggggccuuauuuuauuccuaaggcuuaaauauagacuguaauuuccaaaggaaucagggugaggacccaauaaaagaaauuaaauuguagacacaagaagccuauacauguaaguaugggcaaauaaaauaaaaguggggccuuaauuuauuccuaagacuuaaauauaaacuguaauuuccaaaagaauuaggguaaggucccaauaaaagaaauuaaauuguagacauaagaagccuauacauguaaguuuaggcaaauaaaauaaacugugcauaauuuuuuggcaaagauucaguuauguaacaaaaggcagucaggacaagcuaugaggggaaaaaauagggggcugaaauauaccuugcaaacagauggaauuuaauuaaggaagaucugcuaggagguuuuuagaguuaggugguaagcaaaggucuucugagauaauaaauuagaaaucugcaugaaauaacucccaguuuaaaacauuuugaaacuucaaggucuguuaaacagagauuauaacgaagcaaaagguuucauuucacaaacugaacacugaagaggaggggugauuaccuacacagucacuggguuuaauuuccacuacuuuauaaggcaaggagauucugccugauucauugugaaacacuuauuaagcagggggaaacccggggauggaaagcaagaccacuaugagaaagacacagggaagaaacacugauuuuguuauuuuccacaucaaagugacuucuuaacccacaugaaaauuguaccuuggcagguuggcacgguaguugaccaguggccauucucuuggcaugcuguuugugcagagccauuaaguaacuggcccucuagacaauggaaagagcagauugauccauaacugaaguuuccccagagguuggagcaguucaucgcuauuggcuuauuaacauguaguucugagcauuucacagcugcagaaaagaaauaaugcaagagaaacaacauguggauuggaggugaaagagauuauaguuucuuuuguaaccuaacauugccaauaaaugaggcagaauguaaaaggucagaaaggauaugagccacuuccaauauucacaguagcucuucuaacagcacauauaugaaaauauucucucgaagggugauauccaaagaaccaagaugcaaagauggacacauaguagcauccgacaaauaccugcuaaugcauugauaaaucuugccuccaaauauacuauuuacaaaauuuugguucuuaaaauacuguuagucuaaauguuauuacuacauuugugaucaacuggcaugucaguauguguuuauugaaauacuuaauaaguguucagcauaucuggacacuggaaguuugaaagaaguagacugucauccuccuuaaacuacauuuucagggaacuucagggu

SEQ ID NO: 12930 - RNA, 3940 nt, Homo sapiens
gggaaaaauggaagacuauaaagcuuaacuuuucuuuacauaaucauauauuaaauuuuaaguauguauuaaauuuucaggcaugaaggaaauuguguuggcaguaggacacagguaugacaauggaguuacaaaagaguucacaaaaggauuuucauuuccuccaggacagaaauguccuaacaagacauaacuuauuucaggauguguaacauuuccauuauuaacugcuagguggugaugauguggccuugccugcaaagcagaagucaggacugcugaaaaauguuuacgaacuguuauggagucaauucccuaugcuaccugcuggaaaaacaaaaauaaucugaugcuaucccucucccaaaaaguggguaguugaguguccuacaaaaagccugaauggcagaauauucgaaaucuagaaagaaaagauuaugcugcgccucaggguguagauaugaugagcaauuuuuuucuuucuuuuauuuuuuuaaggaaaugauaauuauuuaaauuucuuuggucucauuuccagagaccuguccuuuuccuggucuccucauucagccuccauaugauccuguugugaacaucaaguuuccugcuacacuggacuuaacuauaaugcauuugcugcagguuuccauaaacacccaugaaucaaagacauggaauuaccuuagauuagcucuggaccagccuguuggacccgcucuggaccaacccuguuuccugaguuugggauugugguacaaucucaaauucucaaccuaccaccccuuccugucccaccucuucucuuccuguaacacaagccacagaagccaggagcaaauguuucugcaguagucucugugcuuugacucaccuguuacuugaaauaccagugaaccaaagagacuggagcaucugacucacaagaagaccagacuguggagaaauaaaaauaccucuuuauuuuuugauugaaggaagguuuucuccacuuuguuggaaagcagguggcaucucuaauuggaagaaauuccuguagcaucuucuggagucuccagugguugcuguugaugaggccucuuggaccucugcucugaggcuuccagagaguccucuggauggcaccagaggcugcagaaggccaagaaucaagcuagaaggccacaugucaccguggaccuuccugccaccagucacugucccucaaaugacccaaagaccaauauucaaaugcguaauuaaaagaauuuuccccaaaugccguguuccucuauuuuaugguuuguucaguaaggucuguauacaucacauuguuuaccaucaguguaauaacacacaauuaugguuguccuauuuacaccucaaccauucauucagucagcaaauauguaucgcacacccuacacugcaagagaaaaucagagaaauggaaaaauucuucaucaccuuaauauuuuacagggaagaacaaauguguuuuacauguucuuuaaaucccauguuuaauaaauaggucauugaaaguuauauaguauuuaucuggaacugauguuaaaaaaaauagagagccaaaaauuauaguagucaucuugucucuguaaaauguaauuaaauaaauaugucauguacacuguauauacauaagcaaacaugcaaauaaaaaagcagccuacucaaagguuacaauaauguugcaacaauucugguaguaaccuugggauuuagggacacagugcuuucaaaacguuucucugauacacugccaguagcaucucugacugcuuauuuaaaugucaaucaguaggcuagguguucuaggacuuuggucucaacccuguuuccugagucagaaucuacauuuuguaaaaguuccccugggaauucugauggucugccaacuuugggagacacugauaauauuguagauaaagaaguguaagcaacuguucaguuagggagacaauagauaccugcauggaauaacaaaagguaauuaacaugauuauauaauuugaauaguguuguaauaguucauaaaauggaaaagccaauuugagcccagaaucugggagauaggcagaacucuggacuguaaagaauggcccagcaaagaggaagaaaaugggcauucuaaguuggugcaauaauaucagcacaggagaaaagacagaauauuggggggaguggggagggaggaagaggcuguugaugagccugauaucauuaacagagaccucaugugaggugccagauuacaauuuauugaauguacugaaugcauaaagcauaagacagaaaccuggagccaugcagauacagggaacccaggacaagucauuaugaugccucagacaauauaauucgcagauucucuaucaauagcaaaguaagauuuaaggugcugugaaacagucagauccuucaagaaaaacaagaauacaagggguccuggagacaggaaaauaugaucauaauaauaaauuugugauuccuucuuucucucuuuuucucuuucuuucuuuuucuuucuuucuuuuuuuuuuuugauggaguuuugcucucguugcccaggcuggaguaaaauggcaugauaucagcucacugcaaacuccaccuuccagguucaagcaauucucuugccucaaucucucgaguaggugggauuacagguguccaccacaacgcccggcuaauuuuuuauauuuuuaguagagaaggguuucaccauguuggccaggcuggucuugaacuccugaccucaggugauucacccgccuuggccucccaaaguacugggauuacaggcgugagccacugcgccuagccucuguguguuaagugcuggaacuauaguuuacaguagcauuuuauccucccaacauacccuaucaggaaaaauuauuauugucauccuuauuucacagaugucaaaacugaacagagagguacaguaacuugcccaagacaacacagcuaguaagugaaacugaaaucuggacaacugauuuuuuucagccaagcucuucaagcccgcugcuaugcugcagcuuagcuggcgacaggcccuuaucaaggcagaacugugccuugauagaggccaggaaggcgauucagagcaguaggccuuguccauguguuuguucccugcuucuucaccacuugaaaauaguguuucagugcccaguaacagggcacaauacucuuuuccucagauuaaaaggggagccaucugcuuaaggugguugggugccacugcacugcacagaagguucuccaagugugagcuuggacccaggcaggccucaggucagugguaacggacgacugcuuccgugguguuggcagguggaaauggagggauacagcuuuguccggcucaugaaucccugggcauugucccgccugcuagagccucugaucucugccccuucuucaccugcaguaaaacagucacuaguuugguugcucucccuaauaccucuggucacugggagcugugaucucaccaaaccccugccaggaaaagccccagaaaaagcggagggagugagagccagaggcugcugcugccguuugcaagaacugcaggggaggaggacgcugccacccacagccucuagagcucauugcagcugggacagcccggagugugguuagcagcucggcaagcgcugcccagguccuggggugguggcagccagcgggagcaggaaaggaagcauguucccaggcugcccacgccucuggguccugguggucuugggcaccagcuggguaggcugggggagccaagggacagaagcggcacagcuaaggcaguucuacguggcugcucagggcaucaguuggagcuaccgaccugagcccacaaacucaagguaacucagguguggaguccgggugggcuucucuagagaggaaaaucuauuucuuuuagagaaca

SEQ ID NO: 12931 - RNA, 72830 nt, Homo sapiens
acagucacuaguuugguugcucucccuaauaccucuggucacugggagcugugaucucaccaaaccccugccaggaaaagccccagaaaaagcggagggagugagagccagaggcugcugcugccguuugcaagaacugcaggggaggaggacgcugccacccacagccucuagagcucauugcagcugggacagcccggagugugguuagcagcucggcaagcgcugcccagguccuggggugguggcagccagcgggagcaggaaaggaagcauguucccaggcugcccacgccucuggguccugguggucuugggcaccagcuggguaggcugggggagccaagggacagaagcggcacagcuaaggcaguucuacguggcugcucagggcaucaguuggagcuaccgaccugagcccacaaacucaagguaacucagguguggaguccgggugggcuucucuagagaggaaaaucuauuucuuuuagagaacauucccuuugcaaugucauggcuuuuuuuuuuuuuaacuucagguaaguaaauauaacuaauaggagaguauacugaauuaaauaaacugggcaaaugcuaauuuugcauccaacaauguaguuuaucauucugaggguuuagaaagcacccuauuugauugguuagaugcuaccuucuuuucaaguuuauuuucaauacaguuuuguuaguauguuuguguuggcuuauauauugguuaauucaaaggcaccaggcacuugcucccucauuagcccuuccugcaaacuccuguuccagauuuuuaguuguauaguauuuuuaugagacuccuaguuacauauuauuuauuccauugucuacauagcuucaucuucuaaaacuaaaaaugaacaccuugugcuuuuugucauauaauuuuauugcugccuuauaaaugacuuucaaaauaucaucaguucuuguauguuuuuguacuuucaccuuuuuucugcuucauauuugacuuauuuauccuauugaaugugacucuucauuuuuuuuucucucuguucaucauguccugggauaugguuuaccuuggcuacuuaaaggcauauguaacugagaggagguuuaauucagauaaaauacuauccuugaguugcaaacuauuuuuucuaauugaaauguuaaaaauaagacuucucagaaauuaacuaaaucauacagucuauucaauauuuccaguuaguuauuuuuuaaaugguaaaccugcuagugugacucacuuuuuuuccuuacaucacacuucauuaugaaagauguguuccucuuuuacaauuacaaaaccaaaguaaucugccaaaaaauaauguaauauuuugagaucuuuuaguguauaauauuaaccuuuuuaaaacucucauuguaacuggguuauuuuggaggguauuacauaccaucuuggucuuauaauaagaagagaucccuccuucucaaaaauaaucauuuuaaauaucguacuucaaagugauaaucuaggucacacccacacccuuugggaacugccguaagcuaaaaccccaaggaaaauaacaguccuucuaacacuaaucuugccugcucaugaguagaaugcagacuugguuguuggcuuucuuguagcaugcuggguucaugcuugggaguuuuuucucuugucuguaguuagcguugaaaauaacaagcaaaauaccggaggcagaaccagauagggcaaaggucugauucacauggugaguacacagggaaccaugacuggucauucuguccccucauccuguggguaaguuuccaaaguucuggagauucguuccucugguaggaauuguugagucaaaaccauagaaacacaacccagacaaacugucauauuguuuaacccuaaaucauaucauuucucucuagcauuuucuuaugaaaaaucuaauccauauaucuggcugcuuaaacuaagaacuuguucuaacuuguccugccccuagagcuaugauacucacuaggugaauaucaacauagccaacuccaucuuuuggcaaaguguauuuuagcacaaagcagacaucuaucuacuuauuucauauaauauuagcaggacaaugccuuuuaaagguaaaauguaucuauuauucuugcuccaagucuaaggugaacacuuucaaaaauuuccuuagaaaacuuguuuagucacucacauguauacaaagagauauugaagaaaagauauacauacauuuuccuucuaggguucuagcuuuauaugauuuugugauuaugaacaaaucaucuuuaaacaauccuuauaaaugaaaaacucgucguacacauuguuugaauucauaugaucuguaacuuuuuaaucagauagauuauuuuccaauagaaauuguucagaucaaaauagacauaccucaguaugaauacacagcauacauaguaaaaacauguuaggaaacaucucucuguugaaauuacuccacguaagagacugauauuuuuuaguaaagauuuuacaccaucaucuacauuucuguauuaaagaucuggggcaggggaggacaauaacuuuucaauuguacuaaaaauaaauaaauaaaaauggacuuccacauuagggacauuaguauauagaauccuggaauucuuaaguuagaagaaugcuaagaguucauuuaauucauauucaacuuccacgcuuuaaccuucuacuuuuccccuuucccucagcaccaaugaccuuaccaaguaguugucuaauuucuacuugaaugcuuccagugauggagaauccacuaccuucucuaucuagcuauucuaaaaguacuuacgugccuccuuuaauucugcccccacauauuaacacaguuucuguauuccacauauuacaauuugugagcauuacuguaacuacagauuuguuuuugcuuucugagaaaaccugaaggguaaagacuaacucuuauuacauuuacaaaauaauauuacuagcuaacauggauugaguauuucuagugugccagcucuaugccuuuugcacauaucaacuuauuuaaaauuauacaacaauucugugaaggagauuucaguauuaaucucauuucauaguuguagaaacugaggcacaaauggaugaaguaaacuuuucaaaguaaaacaauaagagguagauauaggcuucaaguccagagauacugaauucacagccugcacccuagccaccgcgcuguauagaagucauggcauaugugggugcuguuaugucuugauuauggcugggccacuguccccacauuaggaagcaaaacaaagccacucugaucaacugauuuagacauuugcaagguauuuucuccaaauucucuuuccuuuuacccucaucuuugaguuuaagacaaggauaagacugauuugccuuuagagguacagaacaauaacaacaacagcaaaaacaggaaaguaacccaccacucacaacucucccuguugucuguccucucucuaauuuuauuuaaaaucaugaaugcagugguuucacauuuuuuaaucuugguucugccacuuaucaacuguaucucuuggacaaguuacugacucuuuccaaaacaguuuuuucauuuguuuguuuccaauaugaaucccagggcuuuuaccccauuagccaucucucaccucucaacuagaaauaaauuccaccaaaucaauacuuuuucacaauguuccccaguagauuaaaacuauauuugauugaucaguugaaaaacagcucauauauuuauucauaaaggauuuggucauauuuuaaucauauaaaaucuaaaccuacaguuuggguuucuacugugauauuggguucuuuuuagaaaauugauucugaggaaugauauuaggguagauuaacuugugaacaaauaguuaucacaacaggauauuuuugaagagaccaauaauuauuucauuaacuuuacuuauugaucauauuuauaaaacuguggacuucugaaauacaauaaagauacugguauucuacuagaagucugaagauaugagagaucuacuuuuuuuguaaugugagaaauagauauugaauaugccuuucaaauuaguuuuuguauuuuauuuccaguuugaaucuuucuguaacuuccuuuaagaaaauugucuacagagaguaugaaccauauuuuaagaaagaaaaaccacaaucuaccauuucagguaagccugaaauauacuuuuuuaauuuuaaagauaaauuucuauggguaauuuggcauucacaugcaucuaaaauauccauuuacugaaaauuuauagaaacgugugguuuuuuuuuuaagaaguacuggcuacauaauauguggggcccagugcaaaaugaaaaugugaguccccuuguucauauuauugaaaauuucacagugacugcaaagcauuaaaccaagccaggggcccuuuggggcauggggcccugugaaacugcccaggucacauacccaugaagcuggcucuguuuuuaaccuugauuaaaauaacuaaauaaaacuuauaaguguuugaauuuuuauucauucaucuaaaaaacuguuauugaguaccugguaugggcugggcauugaaauaggcauuguggaugcaauaguggacaagacagucucauauccuggguucauggagauuauggucuaguuuaaugagcauagaugugccuucgcaaaaugauauuuugcuuccauuuggcucccuagauucauucaaaggaacuauguauggcugacucuuuugcaucucuuucccgucuauucuucuguuuauuuagugugauauauacaauagccauaauuuuuaaagaaaaucucuuauuuuuuccucaucucuuccuuuaucaagaagacuggguugaauaggguucuaauaucuuaacuaugauaccauauuccgcagggaugauagagaccaucaagggagaacuuccuccaguugaauccccuugucaguaauucaccugucccuuuccccaaucagaugaagaccugcugucuuucccagaaucauccuagucuguccugccucuucugaucuccuuuaaucuucaauauuuagucaaugggagucuuccuuucaguuaaaaaucaacgacuaaaccaaaaccaaaucaaaccauguccaguuaacuccuaucuagaaaaagaaaaaaaaaaaucuccccuugacccugccugccuuuuccuuuucucuccuuuccuucacuaccaguuuucuguaugagaacucuguaucauucucuacauuucuucgccuauauuccuucccuaaucugcuuuaguaugaauaagucuacuaaaauuacucucacaaaagggcaccuaggacuugaggugccagagccuauguucuuuuacuacuagacauuacuaggacauuuaacacucuuccuuucugaagcucucgcuuuaccuguuuuuucuagugccacuuccccuugguuuucucagacuucucuuaccacuccugcucaguauccccaccagauauucuuccccaggguucgaaucucacccaaaaccaaggcuuucacuacuaccuacccagaagccacuuucccucugaagcuacauugacacccccucaauaccagcagaauuaaaucuucccucuucuauacauccccaguaccuugaauuaaucccuaccuucuaaagauauuaagaggaucaauugaguuaauaaguacaaaguauuuauaaugaugcugacacauaauaggcacucaguagaaguuagcuacauuauuguuauuguugcugcuauuacuaaucauaacuuagaucauauauaucauaguauuauggauaucuauauaucuauauuucuccacucauuuauauagucuucacauguguucauuuauauauuuauuuaauuuuaaacagaucugcauuuaaauauucuuuuauuuuuaaauaauuguguauugaggccaggcgugguggcucaugcacuuugggaggccaaggcagauggaucacuugaggucaggaguuccagaccagccuggcccacauggugaaaccccgccucuacugaaaauacaaaaauuaguugugcaugaugguacaugccuguagucccagcuacucaggaggcugagacaugagaaucacuugaacccaggagguggaggcugcagugagcugacaucgcaucacuucacuccaaccugggugacagagcgaaacucuaucucaaaaaaaaaaaaacaacaacaacaacaacaaaaaaguauauugagaaccuacuacauucuaggcucugggauaaagugaauaagacauggaccuugauuuccaggagccaaucagcuauuggggauaaccuauggauagacaagcaaugacaguagaguaauaaggaagaacuaugaugaggauucuguaguaggacauaggagaccuaucuccagucugguggucaggaaaguauuucuauuucuagauugauagcugaaaaaagaguaggaucuuggaaagccaaguggggaggcaagggguugggugauagaugcauuuuaaaccaaggcacagaauguuuaaaaguuuggaggugagaguaugguauauuuguggaaccauaacuggaucagcacaguuggaccacaaacuucagggaaggaauuaacaagagaugcaacuagauggggaucagggauccaugcuaggcuuuauauugagaggaauagggagucccuaaaaggauuucagcaggagaaauauuuguccuuuagaaagauuauguuguccaauuauagagaauagauuggagaaagaccaguccagagccagagaaaguagucaugggacuguuguaucaauccagauagcagagaagcugagauggaguccaaagauauuuaggagcuaaaguugauuaaacuuggugacucauuagaugcagauaaugaggaagaaaagggaauuguuauggacuucaaggugucugguuugaacagcagaauggauagggugccauucagugagaaagaaaauguaagaaaaggagauaguuugugagagaaggugauaaguauagauuuggagucugagguguguauagaauaucuaccuagagauguuaagugagcagacggguguagaaguuuggcccucaaaagagagaucugagcuagcugucaacauuugggagacaucagaacaaagauggcaaaugaagaauuuagagggugugaacucacccagggaggaugugaugagaagagaaggcugcagacagagcucaaaguagcagcaaaguccaagggaugagccaagaaagaaaaguuuaccaaggagcuugagaaagccuguucagggaggggagaagaaaucuagagaauguguuauccuggaggcaaagggucaaaugcuauuaauauaagggucaaaauauggucccuuuguuauggaauagugggacaagaccagauggcaggguguugaggagugaauggaaggcgaggaaacugaagcacaagggucuuauagauaacucuucccugaaacuugguuccagaugggaggagagacaggguaguuucggggguggggguggguacugaggagcuuaaggacauuugagaauuuuauaaaaaggaauacagagacuuaaauauuuaagggaagacucuauagaaaugccaugaaguccuuuccaauagaaaauguggggauaaaacaucugagagagaaugauuaauggagacuuagaagaagcaggaagcauugggauucaaaccuugggcuggcuuggccuuagguagaauggcuaccaccuucauggggggccaggaaagcagaggauaacguugcaaauaaaauuaaguuuguaguuaugaguaggaaguugaaggauguccuguccuauaucacagagucuauucauuuucauagcuccagcuccaagcuuagcauguacaauagauacuuaagaacuauuuaauuaaauuaaauuguagguagaugaagggaauauaaggugggaaacauacucauuagggccaggaaaagaggauuggggccgguauuugaagguguaccuuuuguggcuuuugccaagcuaagcaaauuuuaaucccuuugcugugugagacauugugcuaaaugccauaagagacggaaaggacuaauuccaggcugaagacuuuuaaacaauaaaaaggcauggauagcuuuugaagaaaaggguucugugaucaaaguccuuucagaugauuaaauuuuuuagugauuuccugauuuaaccuuguuagagguagacucugacaguuggugagaacagucuccaauuuauguguaaggccuuugcaccuuucugucaaccccuguguaucucagaauauauuuguuucauguggacaaagguguuucgacguccauuuuaauguaaucucuuccugaauguccaaaguugcuuaacuaugaacuuaugaagugcaggagugguaucuuauucaccuuuguaacucuauaguaguugauacaaggaggcaaaucuggcgugaaggaaaagccuuuuauuuugacugagaagaucuggauuugaacacugccauuaacuauguggccucucccauuccccagacuaguccuguguuauuuguaccuuuccccuauguccugcuccacucaucugcugggugugauucuagcugagcccugaaaaagucaugagccucacuccugcagcaugaacuauuguuguuguuaguucuuguaauuguagggggcugggcuguaggauuggagguaugaagaugcccauccaauaagguuuguggacauuugggcaggugagggaguacagcuggggucauuuuuaggaauucugucuugggcuuuaaaauggcuagucuuggcugggcauaguggcucaugacuguaaucccagcacuuugggaggccaaggugggaggauugcuugaggccaggaguuuuagaccagccugggcaauguagugagacucuguuucuauuuaaaaaaauacauacauauauauauauauauauauauauauauauauauauauauauauuuaaauuagccagacauggugguacauaccugucauuucagcuacuggggaggcuaaggcaagagggucauuuaggacaagagcaucacuugagcccaggaguuggaggcugcagugaguuaugaucacaccacugcacuccagccugggugacaaaauaagaccucaucucuaaauaaauaaauaauuaauuaaauuggcuaguuuugagucugcauauuuuucagggacaaauuauaaaauguuugucccugaaggaguuuugaaauagcugcaacaaucacuaccuuguguuauguaaugcauuguucaccuaagagcaggggauuggauuaguugaccuucugcaguccuuuccaguuccacaacugcacuaaauuggguacaugcugugcuggcuuccccaagcccugaaguaggccacuccuuuccccaauccagcuuugggcacugaggagaggguuagaaggguuuuaggccaucuggcuguuggaggagcuaaagagcagcuugaaaaccauuuagccauguguuuuccuacaugcgugaaaguauuugguaugcauuuaugaaaacauccuuuuguuuugccuuaaaucugaagaagcaggaggggagguugaauaaauacuccaaacuguccacugaaguaauaggucuuauuagguuaaauaacuuaggagacuuucucugggcaucugguauuugcaggcaugugaugccaacaaacaaaucaaccaagcaagagaaccauggcaacuaaaugcggcacacaauuggcagcauagucagcacccuguugggcucauuggcagcugggguaggugggaauagucaguggaaacuuccaucaggagccaagacagaggguagcagcuggaagaggggggucagucaguggaguccgacaugucaggagucaaaagagguguagacaucuggacuauucuauaaagaugggggccugagccugccccguggaaggaauagggagagcuuuggcucaggaguccagagaucugaguucugaucccagcaaugcuaccagaucacugacugaccuugggcaagucaccuuugucccccgauuccuaccucccaggcuuuguuaacuaaaauaaggacugaacuuugugaccuccacaguccuguguaaagcuaacauaaaaacaaacaaaaagcuucaggcacaagaucagaauaaacuccaggaguaggaguucaaggaaaggaauaggacaaccguggguggcaagacagggguagggaaagauaggaccucugucccagaaaucagaguuuaccauugcuucuguaaccaguuacugcaaacuuaguggcuaaaacaacacaaauuuauucuuuuaugauuauauaucugcagaugagaaguccaaaauggguuuuauugggcuaaaaucaagguguuggcagagcugcauuccuucuggaggcucugggggagaauuguuuccuugucuuuuccaguuacuggaagcugccuacacucacgggcucauggccccuuccuccaucuucaaaaccagcugaguagcaucuuccaagcucuuccuaacucagauucuccugcaucccucugauaaggaccuuuguuauuacaugggauccaccuggacagcccagaagaaucucaucucaagauucuuaaucauagauacacagucccuuuugccauauaaaguagcauauuuccaggucccagagauuaggacguggacaucucagcaggggcacauuauucugccuacuacacccaccaaacaaagcccucccacgguguccuccaucucagagaauggcacccuccuccacccagcuccccaaaucagaaccucaucagccauccacagcaacugauguccuuuauucucuaccccacauccaauccaucuucaaguuccaacuauuuuaucucauaaauacaucacuaauauauucucuccucaucaucucaucauaaucucagucaccaccaucucuccuggagucuucuaucuguucucucaauuguucucugcucagucuccuccgagaucauccuccacaaauacagccagagauuuuaaaaccaaaaucugguccauguugcaccccugaugaaaacucuuuaauggcuuccagauacucuuaggcuaaagggaaaacucuaugaggcuuacaaagcccugcaugaugggacucugaggaugccuucggcuucaccuucugccccuuccuuucacauacuaagcuccaccuccccacuggauaacugucaguucucuaaaaaggccacauuuucuggcaccucagggccuuugcgcacgcuacucuaacuuuuuagaaugucuuuggccaucccuuuuccucucugccuuuggaccucaguuaaaggauuaauuccucgggaagggauuccccaacucaccuccaauuggacuagauuccacugucaaauacucuucagaguauucccuccuuuucugucauaauauuuaccauagguuuaaauugaauguuuuugugaucauuuguuuaaaaucugucuuuccuacuauaaaaacguauaaaguuauagaacuauaaaaauguuugacuuuuauaaacucuaugaaggcagggaguggguguaucuauuuuacucuuuuacgcaccauugcaauucugaugccuaggauaauauaggcacuugauauucauugaauaaauaaaggaaugaauaaaggaaugaauacaagguggagguguaguauaaagaaguggcuuaaaagucacgaucuagagacagacauauuaaacuuuaaaucaugaugcugugugauauuaggcaagauauuuaaacucucugaggcucaguguccucaccuauaaaaugaggaucuuaauaucuaccuuaaaaacuugugaggauuaauguagggacuuacagugcuugaauguauuaagggaaacaguacaggaaagccuuauuaugauuaucaucaccacugcaaacaaaugcuggcugaacuccaugagugccgugacuuccuucuccugcuucuaggacgccuaauggcgagaagccaaucccaugacacuuguggauggcucagaaaugacaguaguugauuucugucacuugucuggaauggggcuuuuggucauagauucucaagauuucaaagacaucaagaucaccaaggagcacacguuaaaguccagauucccaaguuucaccuccagaacucagauucauugaggcugaggugauauuuggaaaucugccucuuauuaagacccuaggugauucugaugcagagacuccaaggacuacacuuuggaaauucuaguacagucaucccuugguauccacaggguauugguuccaggacuacucacagauaccaaaauuugcagaugcucaagucccuuauauaaaauuucauaguauuugcaauaaccuaugcacauccucucauauacuuuaaaucaucuuuaaauuaguuauaauacugaaugcaauguaaauacuauguaaauugcuauuauguuagaguuuuauuuguauuguuuuuauuguuuauuuuuuauuguuguuuuuugaauauuuuugauccaaaauugguugacuccauggauguguaaccaugaauaugaaccauggucauggagggcugacuauauacaauuccucaaauucugacucagccaucaacuuuuucccuaacuccccagacagaauuugugcuucauccucucuucuucuguaauauuuugcccauaucucagcagucgcuccuaucauacaucuaucuccaaacuagcuugugaguuccuucaguacagggacuguauuugauccagguagccagaaacuuucuaacacagugccuggcauguagaaaguaaaaccucauucuugauuucugcacccauaaccuccugucucugcuguguucucccauugcaguaacuaauaacaucauuuacccaguuguucugauaaaacaccuugaggucauccuugacuucugucucucacaagccacaugcaauccaucagcaagucuuguuugccuuaccuacaaaaauguccagacuccaaccacuacucaucacguucugcuacaugugcuggcccaguacacugcagucucuuuccuauacugccuaaucucucugcuuccauucuugucccuacacagacuauucucuacacagcagcuaugaugaacuuuuuguuuuaggaugaacuuuuaauacacguuauacuaugucucugcuguacaaagugguuuuucauuuuacuuagaaaugcuccauuucacuuagacgaggcgugguggcucacaccuguaaucccagcacuuugggaggcugaggcggguguaucaccugaggucaggaguuugagaccagccuggccaacauggugaaaagucaucucuacuaaaaauacaaaaauuagcugggugugguggugcaugccugcaaucccagcuacuugggagguugagguaggagaauugcuugaacccaggaggcggagguugcaguggguccugagauugcaucacugcacuccagccuaggagacagagcgagacuccaucucaaaaaaaaaaagaaaaaugcuccagugaugucccauuucacuuagaagaaaauucaaguucuuaccguagcccauagggccucccuuguucuacacaccuaccauccaccucaucucuucuuucuucccguacuguuuuucuuacuguuccuuagauacaucaagacuacuccugccucagagccagagagcugugugauuugguuccucaauucaucuaggucucugagcacacccaugucagagaaaucuaaaguaacuacccucucgcaucacccucuguaauugaaaugaacaucuuucuuaagcaaagaaaguuauugcuaaggaaugacagugggucaaagugggcaagacuuggccagaacuauuucuccuacucuguugacuucuuuuggguccaggacaaguguuucuaccauucuauugugaucuguguacauguaauguugaguuaaugagcugcuaaaaccuucuagauugaaaauaagugagucagccucaggaccaggaggaaugguagcaaucacucuugguaucaucuguuuguuuuucuugcuuagcaacucugccuuugaugacccugaauacagacauaguuuaaauauuuguuuucacaggacuucuugggccuacuuuauaugcugaagucggagacaucauaaaaguucacuuuaaaaauaaggcagauaagcccuugagcauccauccucaaggaauuagguacaguaaauuaucagaagguaagauaaaucuaauauuuuucugaaaagggaaaaugucuaagucuuuaauaccagcaucaacauuuaaaacuauacuguuaaccacguguuguuagggaaaucucuugcaacugguaauuauaaaaauuguugcuguuguaaguuuugagagaagaaaaggaaaagguuuuggaguccucuagaccugcauuuuucacuggguucuuacucuuuaauguuugggagggcaaguuaucuaauuucucugaauucucauauguucaucuuaaaaugggaauaauaauacauacauugaaagaugguuuaaggcgggggucaguaaauuuuuccguaaagggccagauaguaaguuuguuuggcuuugcaggccauaagaucucuguugcaaguacucaacucugccuuuuaguacaaaagcagccauagacgauaccuauuuuuuuggcuuugguuacagaugccagaacuaauuaacuuuguuaccguauucuuucccucaagucauacaccagaguaagaccgccucugacaauacaauuuuauuuacaaaaacaggaaauugguuggguuuggcccaugagccacugacauagugacauagaacuagccugauauaggcuuccuggcacauagaugacacucaauaagugguauuuggugguggugagacuagaagcauuaauaguauuagacuuuuggacauagugaagugguuaagaaaguaagcuuuaaaggcagacaaguuaaaauucuagcuuuaucauuucugauucuacgacuuuagcaucucugagccucaguuuucucaucuauaaaauggaaaugauuauaaccacccauaagauugccugaaauuuaaaugaagucacuuagguagaguacuaaacaugguuccugggaucggauaagcucucuauaaauaaugaugacaaugauggcaauaaucauaaagauaauagucaugcaaguuauuguaucagccgcugaauaguaaguaccugauguuaauaugguucuaauuaucccauuaugcugauguucagaucauuguaagcauaguagaguuccaucaggcacugguauaaaaaauuguauccauauuauaauaguuguugguaugagaacauuuuaaaauaauuucagacuuuucaugguucacauuuaaauaucuuuccuucuacauguuccagccaucauaccuuugagagaauaauugaguaggagagugguuuaugugcagguuuuagaacuagacuaauaagugcaaauccuggcucagugacuuuuaugaaguuauuuaaccucugugugccucaucuuucucaucuguaaaaugguaauaauaaucaugucucugucauacagguuuguugucgugaaaucuuagaauaaugacuggcauauaacagauaauaaauauuagccaugauaguaaagauaauucuucaauuaaaauguguucaaauaauuuaguauuuaucuuaaaacuuguuaguuucagaaaaaaucagaaaguaauuuuuaaauuuauuguuuucuauauaaacuguugucaaacucauacccacuaagguauaagugacugauaauaggucaaugaacuaccuuccuuaggaguacuugcauuagcacuuaaucuuuggcuugaggaaaaacaaugaagcauuaacuguggcacugagauuucuuccaaagugaauuuggcaagacucugggugagguagugggaacaggaguuucuccuauguucuuaaaaucauacagugacauagugaacaaccacuucaccuacuuaugaggcuucuagacgacugcaucagaaguucagcaauguaaagaagaagggggagaaaccucaaaauaucaaaaugucacaugcagguuucauuucaaauaagggaggagguaagaauuguagacuuuggacccuaccugggcuguuugcacagugaaugaaccuugcaacacuaucccucuuccuuuacuguuuauuugucccuacauucccuacagccagcaauuauuuaugagcaauugcuuaaaaugcucccacagcuuucacuggagacaugauuauuggcauauaauauugccucugguccuaugaaucuaagaaagguaaauacauauugguagggaaaguaaaauuuuaccuuggaaaugagaugcaaaccuaguaagcagauaguaucuuuuaugguaaaagacaagccuuauaaguugauuuuauuaugcccucugcauuaaaauaaaacaucuccuccuccaugucugacacucacccucaccuauagccucccucugugguuugagcuauuuuuuugggaguggggauaaacuaacugcaugcugagccaguuacaugagaauccagauuccucuaucucagagguagauauuugagagauaggugguaggggguuaagauaguauuacacuggcuugagaaaccacaacagaacauaagagaacucuggauaacccuuuuugacagaauggacaaacggugauuuguaaaaaugcuuguaaggacauuuccuuuaauaauguauuuaauaagacugucuuagaucagggaauaaaguaucugcaacuguaacuaaucacuuaaaagcugucacuaaaggguuucaauuugagguuaaauuuucagaaacucuguaacuagcaugcaucaaauugacuucaaugcugcaccuuugagcaaaguuuguuguucaguaaaauuuucaaagucguuuuggucaauuaccuuuaaaaagcuuguuucauggagaauuuaauauuauucuuuucuuuuaguuauauucucauauuuuaaauauaugaguugcauaugaaugugaugucacaaaauuaguucuauaauauauagccaucugcugguaagccagcucuccaaauaaaacacguuuucugccagacauuguucguuguaucuaaguguugccaaauucucuauacaaaaauuugcucuucuagauuuuuccaaaacauuccaaugcuugacuuaauguaggugauuacauuuuuucacuucucaucugaauauuuuggccuuauguagagacuuccuugaguauaugauaaacaccugaaacaaacuauaacggcuauaguuuguauauuuaauaaaucacaaaaauguggaucccuuuuccaaagagacuugcaaguccugugcaaugaaaucagcucuuuauaaaacgucagcauugauucgcccauugccuacauuauagcuucuaaaagaauauucugaaucuuugaauguagugaagcauucacuaaguuuauuaacuuaggagaggaaaagaguuguucacaaaaauaaguaacaagggaagaguuacugagugagcacccuaaugaguaaccaaaaaggcucuuuauguaacuucacuuucccaaagcuuguaugcaccauuuuucauuuuuaaaaaauacugagagccuuuggcaaguaauuaguacaucaugacaagaauaaauacaauacaaagcugacuaucgacugagcaggaaaugaacagaacugaguaaauauaaaugaagagcuacccuuguguaaagauuuuauuccagcaagcagcugaacaaggacuucuugugcucuagcacaauaguugucccuguccauuucucuucuuuucaguuuagagcuuaauuuuuuuuauuuugauuacaaagucaaaaucacauucaccaaaacugcaucucacaaaugcuuccucuuaauagcuguuuguauuuuauacuuuauauuaauguauguuguaaaaucaaagauacaacaaaccuguuuuauucuagacuaaagguaaaauaauuugaagugaaaagaauaaaagcauugauaaaauuacaccccaauugucucauuagccaucucacucaguguaauuauagaauauauccuauguacaagucuauaucauucacuguuucaagaugcucauaauucaacuuuuaguaguauacuaaacuuaauuaacaucauucauuuaauuauuugaaauucaucuuauauguaacugacaggcgaaugugaaauucugaguaauuuaguuugaucaauuagacagacauuaauuugugugacuagaguaaccuuucauuaucuaucucaaaauaucauguacacaaguauauacaauaauuuuuuaagcccaguauguguuaaaauaaaucuaggugugaaacauugauuguuuacagauagguucaauauuguuagaaaaucagucacccugcuauaccuagcacaaguguuauagcaucuugggcaauuuuuagauacuuacauugguugguucucauuccagauugacaguguguucuaauuguagcccuagaagaaaucuagaggucaaaccuaucacaauuagggcaccaacauguacccuagaguuaacuaggcagagccccucaggggcccaggcccugucuucuuuacauuuguacucuggcauuuagcacagagccuggaaccuaguggaugaugauggucaugaucaugaugauauuaaucauuacugaacuaaacugaggggccgaggacugauuagaaaguaaggacuaugcauuauuuuucccuugcuuuaaaauuauugauuuugcugauaauuuugagcagguacuuugucuuacuuauuaccaaaaaaaaaaaaaaaaaguacuuuuaccaaaaaagucuuauuuacuuucaucgccuuuggaauagauacaucacuacaauggauuggaaguuuguguccuccaaaaauucacauacugaaaucuaaccuccagugugauggcauuagcagguggggccuuugggagauuuuuuuuuauuauacuuuaaguuuuaggguacaugugcacauugugcagguuaguuacauauguauacaugugccaugcuggugcgcugcacccacuaacucgucaucuagcauuagguauaucucccaaugcuaucccuccccccuccuuugggagauuuuuagguaaugaggauggagcccucaugaugagauuagugcccuuauaaaagggacccucucacucacccucuuucuaccaugugaggauacaaggagaagauggcagucuacaaccuggaagagacccugcaccagaacccaaccaugcuggcacccugauuuuaaacuuccagccuccagaacugugaggaagaaguguccguuguuuauaagccacucaauccaggguacuuuguuaacagcaacccaaacuaagaaaaucaccaauuucuaucuuacucacauguguuaccagaacucaagcacacuuaagaucuaucuuaucuaaaguagaacauaaaggaaagaggcuguauuaauugcaacaugacugggaaagaaaauacuuaaccaaaaugugaacauguauucccacaggcuaucagagcauuuguuaggagccagaaauuuuacaaauauuuuccagucuucauaacccaucaaaaaggauaaaguuaucucuagaaaaaggauuauauuaucuuaaauuauaaaugaaaaaacugagguuaaagggacuucaagaaaccuucccaaguucccacaguuagcaaaugauacaaccaccaagauauuuucaacucugacccugaaguucaagugcuuucucccacuaucuagcagaaaaaaguaucguuaaccauauagucucacaaauacugaauuacaaauggcgaugagugcugucaaaaaaccaacaacaaacaaacagguaucacaaucagagaucaagaaggguguaagaugauauuugaucugacaucugaagaaugagcacacauuuacccagaaaaauaaagggaggaagaacuucaaaaguuaucuccuacccugcaaagaauauaauguuuugcccuuaggggagcuugugaaggcaguggaaagaauaucauuuucuacuauagaaaccccaugugauguuuuaacaguugaaacaguggaagcugccuguccagaaacaucauuuuucaacuuuaugaggccauguagcaagaagcauugaagaagggcugucaugcuugauucaagguagauggugcagcucaucaacuagccaugcuaauuucaguuaauagacaaguucugaccugagagggcaacucuccuuaucaguccuguuugugcuuuguuaccaaagcucuuuuguaaucuuucacagauaaugcuuccugcuuauuaguggagacuuucuccauaaacuuuuuuucuuuuauagacuagaauuauguuauaacuuacaggaagugacuuaagcuuuuaucauuucucagcucuugacaguuuuauuaucaaagugaaaguacagccuagaguaaauauuaguuauuagugucaagcuauccuuugggguguguugggggaagacacaacaaaguccacuuuaugcuagcgcaaaguucacaaacucagaugccuauaguagccagauaaguaguucagugaacaaaauugguccaguaagaacugaucaucagaaagcagaaaagggcagcuaagauccagauccaacaaaauucugugcaggaguuugguccuguuguuaaccagaucuccagguuuuuguuuuuuaaagagaaaccaguaauccaaauucuuauauaauuucuccggauguuuaauguuggcauuuaaucuauuuuaacauuacgcaaucauaacaacacacagccaugagcuuugacuuguugaccuaggcuguagcccauaggaccuuaaauuuuaggaguuuaauaaauauucacugagcaucuucuucauguucauguuccaugcuucucuagguaccuauggaaggcaccagagacacuaagacaaauacaauccagcacuuuuccuugaggaacucacacuugggugaccaaaaugugcaggacacaaauacuuaugaucuaguagaagaaaaugaauuagucacauaaucucacaggcauuuaauuacaaauugugaugggugcuguaaaagaaaaaaauguguaucagaauuggagauaaagguagaagugaacagauauucaaggugaugucugaaugaugagcacauauuuaucaaaaggaagacgggaggaagagcacucuaggcagagggaauggcaucugcaaagacccugagguaggacagaacuuggaugucuggggaacugacaggggacccaagggacaaggagcccauaguaaacaagagaaaagacguaugauaagacugaagagagaaguagagguaaaucauacauggacuugugguccacguuaaggacuuuaugcaagaaguaaaucuagauauaccuacucaacuuaugguuuccaugcucagaaccucaugagauacauugcacguuacuguaguaccugaauccuucauugcuauugaauggaugugccuuauuuuccacucccaccuggagaauccaaacauaugcugaugccaugcaaacucaugcaaagcguuuugaguggaauagauuuuccacaguugggauggggaaagguacaauuaaagaagggaagcugacauugcuguaauguaaaaaaauauuuuauauggaaauuuagcaucucagacuuuggcuucagaacauaaggaaccagauuuacccuuuuucucaacaacuagacaggcagacaaaacauauaaaacagaaguuuucagacaucgaaugacagacaacucaagacaguaaaagaagaguaacaaaccagaugugcccuaugagcaccuaagcuuacugcuugaagaguguuuccagggaacagcacaagcagggagaacccagacagagucucuauggguugaggaaauagaguuuggacuucggagaagcucaaauggcuagaauuugugauuuuagggcagaguccugcagaggacaguauaaucacagagaaagagcucuagagaaucuacagagagguuuugucaaguugaauacugaucugcacauacaugugaggaaaguacugaggguaagaaaaaugucacuugaaaggaacagguggaacagucccuggaccuuacucagggccgguaaucguuuauguuccuaccaucaaacauagaaagaccuccuaauaaaugagcacuggauagaauugucagaaggauuuagaaacaguggguggauaaaauuagacuacaggcugcugaggaggcaacagaauaaaaaacaagauuugauuucaaguaucuuaacugugaauaaaacucaauacuaguuaacaagaaugcaacaaacaacaauguaaauucacaauguuaauaaaaauaaacaagcauuagaagaagcagaaagagaugacucauaaccaagaaaaaacucaacagauugagaagugaaagagagaauagaagcagcaggcagagacaguaagacagcuaucauaaaucuucucaauauguuccagaaagcagagaaaagcaugagcaugaugaagauagagaauauaaauaugcauacacagaacuucuguagaugaauacaauuguugacaugaaaaguaaaaaauaaagcauagaaaagaaagguaaaaaauaaaggauaaaaaaauauauuauaaacugaaggauaccacuaauacaacaaacacuggaugaaauuaauagcacauuagacacugugaaaggaaauaguagaaaauauuaauacauugcaauagaaacugcaaagugaaauacagagauuaaaaaggcugaagaaagugaacagagcaucagugaacugugggaccauaucaagugaucuaacauauguguaauuggaucccagaaguagcaggaacagaaaaaguauuugaagaaauaaugacugaaaaauucccaaauguaauguaaacuacaaaccaacagauucaagauguuugacaaaacuaagaagaaggaacaugaagaaaaccacaccaagccacaucacuaucaaguugcuggaaaccagugauaaagagaaaauauuggaagcagugagagauaaaaacacacaccacauacaggggaacaaaaccaagaaaugauagcagacuuaucguuagaaacuaugcacaccagaagacaauuagggacaucuuuaaaguguugggaggguagaagauaggggaaucugucuguuuaguauucuauaccaagucaaaaagucuuuuuuaaaugaaggcaaaauaaagaguguuuuagacauacaaaugcagaaagaauuucucacuaacagagcagaaaaaaauguuaaaggaacuccuuuagauagaagaaauauuaugucagagagacauuuagauucauaagaaggaaugaaaaguuccagaaguugauaaauauagagaaauuuuuuccucguuuuaaucuauuaaaaaggcaauugauuaucuaaauguuaaagcaaaauaguaacaauuuauugugggguauauuauguauauauaaauaaaauguaugacaauagcacaaaggcugggagggaagaaauggaaauauauuauugcaagguucuuacaagugaaauaguauaauauuauuugaaggaaguuugugacaaguuaaaaauguacuauauauuguaaacggaagggcaccacuaagaaaacaaagcuaagaaggcaacaauggagauuaaacaucacuaacuauacucaauccaaaagaaaacagaaaggaaggggaaaaggaauaaagaccagauagacaaauagaaaauaaauauaaagauggcaguuuuaaauucaaccauaucaucaauuacauuaaaaguaaauggaaagaacacuacaauuaagaaacaaauaagauugaauaaaaaagcaaugcuaaacuguaugcagaauuuaagaaauccacuuuaaugagagagacaaagauagguaaaaaauaaaggauagaaaauuauauaccauaccagcuaacacuaauccaacacaaaaggguguguaaugaugauuccauugauaugacauuacagaaaagccaaauuauagugaaauaaagcagauuagugguugucugggcccagagggcauuggcuacaaauggcaugaagaaauguuuuggaaugauggaacucuucucuaucuugauuggaacuauagcuauaagacuggguaauuguuuuaaucaaagcucagcaaauauuauacuuaaaagugguaaauguuauuauaugcaaauuauaccucaaugaggauaaugaaaggaagaaagagagggaaggaggguggggaauagggaaggaagaagacaaagaaaggaagaaaggagaaaagaaaagaaacuaggaaaggaaaaagaaaagaaagggaagagaaaggaaggggagggaaaggauuaaucauuucaguuuucaaaaaguguaguugcuucaguaagaggaguuuuauuggccuuuuaccccaucauguaaaacauuucaggcuuuuuuccccagauccuuguugucugccuacauccacacugauguucucaccuucuucucguaaagaauuuaucaaguuauuguaccaaacaaaaauaacugcaucccaaagagaaauucugucaccagcugaugauagggaaucuuucaccuaauuaaaugaggaauuccucaggcagaggaaacuguucauuccacuuggcucucuauggcacucaccucuccccuuccugaccucacuugcuccauuuuauuauugaaaaccucacccaacccucuacacuucuuuuaauauugaguaucucaguuccuucucuucaauaaagaagaccaauuucuucauccucucccucuccuaucaguagggaaaguccaauauacauggagguguuaaugaugugucuuugggugcacaaaguacaaaguaagacaucuaaguuucaggggauggacacauuucauauucauacagacaaccagccugcauaggggaguuagacgcuguggcucgggggaaaaaauugagauaaucagauggcuaagaugaaauaaagagauaaaacaaagcugaggaucacagcaguuggaaagaagaucugaaauagcaaaacaaaauaauacauaaacagcucugacuauccucccaucucauguuaauaggcuaaguaugucuuauuaaacaccacaaagaagauaucacccauucuuauauucugagaugguuuacuaaucaaaggcgauucaauucucugauuauauuuaaauaauaauuguucagguacccuggaaaauuaacuugcuaaacuuuaauuuacaaauaacauuuguuauucuuaagaucaccauguuaucaaagccuuuguaaguacaugagcauagaaaugggcauaugugaaucuuuccaaauaauaaaaguucacuauugaaggacauaugcaucuccagagaacucaucuuagcuauccccagauuugagaguggugaaaacgcaauccucagaaacugcccacaugucuugauggcuguuacuccuccaggugcuucuuaccuugaccacacauucccugcggagaagauggacgacgcuguggcuccaggccgagaauacaccuaugaauggaguaucagugaggacaguggacccacccaugaugacccuccaugccucacacacaucuauuacucccaugaaaaucugaucgaggauuucaacucggggcugauugggccccugcuuaucuguaaaaaagguaagaacacccccaccaaaagauucaacaacuaaauguuggaauggucaggaguucugucaugggacaaagcuugggagcaucuugguaacuucuuguacaucaagcagaggaagacggcacggagaccagaucauuguuugacaagagaaaaaaacaccugcuauuucaggguguggauccaccucuguuucuucucauuccuccuucaucucaguccuuaagguucucccaggcaaauuccuguuugagaguauguucugaugucaugcuuguaugaucuguaacauuuaccucaaggccaaagucuuuuagaaaguauacaguagccuauacucugcugaaagagcucuuggaaagaacuuuggcuaacauguuugacauaucugagguuugggcugguaauuugcucuauaaacacgugaaaugccagcuuccuuucuuacaaacaaguugaaaacuuugggugguagguuucaaacacacucaagugacuuuacaagaacuuuuauuggcugggcuucuuaggagcaagcuuggauuuucauuuuaucccaugagaauccagcccaucuuucauuaaaacaaacaaccacagugagccacagcaugggaaauaacgugauggacucaccaucugccuauacauacacgcucaggccauaccuacauacaugcccaauguauuuacucauuauacaaagacuuuuuuuccauuuccugguauauauaagauacugugaugguacugaaaaaaaccuuaaaacuuacaaaagacucuucuugcauuuuaccaucagcagcauguuuuucucauagugagaauggauuaaugcugauacuuccacccaauuaucuaaugcccccuuucauauacaaauaagaugacagcauuaaacuuggggcaugaugcuuuuaccaacugagcuaacguaucuauauacucuucuauugagacugggggaaauggauacuuguacagagucuugagagucaccaaauguuuucuucccaagcuggaugaaauaaagccuguuccccaaagcaagaagguaucaaagaagacaguguggcaccagauuuuaaauaacccuagaaccauuauuacuugauaaauaugcuauuuuaaaaaauaagaauuucuucaaguugaaaucauuaugguugauugcuugcccuaaacucuuugcuauccaggaaagcuaaugagcgucuucuaucugcagugcuacugaaaacaugucuuuccuuucauagggacccuaacugagggugggacacagaagacguuugacaagcaaaucgugcuacuauuugcuguguuugaugaaagcaagagcuggagccagucaucaucccuaauguacacagucaauggauaugugaaugggacaaugccagguaacacgagggcuguguaccauuaaacaacaguaaaaucauuaguaauuuuucgguccuguuuucuucaaagcacuagagaaguugaccauacucacuguuuugcaacucccuaucaagaaggaaauauuuucucuuuuuuuuuuuaaacaggaaauagaagagacaaauuagaagcuagagaagaaaugugcagccuuguuagguauagugaccugaguagguuucaccuuggccuguacuuugaauaagaccuuaagguaucagcucagccacucucuccgaguucugcaguuccucuauaugaugaccauggcuucuucaaggacaagcccuagcaggaaggaucagcaggaagauugcaguaaagaugaacagauuaggaguaauccucaacacacaaaaaaaaccagcauuucaaaaggugacagaagaguaauauucaguggcaucuagaauauuuucucuuuccauuugcauuugggcacuuaugagaaggcaaaaucauagcaaucguuaagagaaaaaauaacuaauucccacuuagaccacaucucuucuauuucucucugguagaacugaccuacaacuaaagauccaggguauaugauacuagccugagggaaaaacauuaaaaaauuaaaaugccacuuuacuaaauaaaccauauuucaaaacacuaaacuucuuagagguuauucucuaaugccaucugaaaaucacaaauagcuucacuuacuaaaacacaaauauuguuaagaguugagaucuggguaguguuuuuaaauuguauucuauuucauuugacuacauuuuccacuugguuuucugaaaauauacucauaugacucucaauguugaucccaaguuccaauacuaggagcuuguaaaaacuggggcuuaguuaacugaccucgaccuuagauaaucugaguucagacuucagauuaucagacuaccuucuguggcccuggauaaauuaguugucucaaugugcuuacuuacaaaaguggacuaaccauuuauccuaacaucuauuuccuggcagagugaacaaucuguauaaguauauggaugccaagaaaagcaaaaccauaugcacaaaaauaaaaauaaauugaucugagcuuagaguuuacgaauuuauaguucccaaaagaauaauuggggguaaaugggacaagguagggaaagaccaucaguagaaacuaagaauaguaaacauuuguaaaaacccucugccuuauaaagcagaauaaauugaauacauaugauaaaugcuaacacagauauguuaauugcugaacucaauauaagcauuucuuuggcauggauaaacgcuuccaccaaagccuccuagugaugcaaggaauccuggcuuuguugcaauggucuccuaaaaaaaacaagccuuuguguggguaaggaacugauucucaggcccauuaucuaguaucuagugauuauguaucugagauguaaaacagaaaccuaaaagccaaggauggagucuccccacagagcaaaugagcauuuucccagugacuguaggagcaaagaaggagcaaaacuaaguuuuuauauucaguuaucacuacuccuuccaugaaaagcucccaauggcucagcauaaugaggacuuguacacugcauuuuaaggagaguguguaaccccaaagugauuucguugacuugucauuaaaacaaucaaaaaguaaguaaaaauaacaauugaaaauccucauaucaucuucacaucuucuucccuuaggcagagcuucgaccacuacagcuagagagcugagaggauuaagugcuugaacucagcccuauuggcgguucuggugauuugacucccuccagcugagaucagacuggggugaccaaacauuccauuuugccguggacuuuuuaccaguucuaauaguuaaaguccugaaucuugggaaaccccucagaccagaacagucgguuaccuucuugguucccuucuuggccuaauccuuuagcaaucccuguguuuuugaguucacauccaccaucucuaagcucuguuguuaccuguauaaugccauuuaucacaaugaguugucacugcuuguuugcuggucacucagaugucugcuuuugcagggcacaaacuacaacuggagugucuguucccucaaagcuuuauacaaugccugacacacagcaggugcucaauacacuuggugagugaauguuugaucacagaguacuugacugaaugcuuauuuuggccugugucucucccucuuucucagauauaacaguuugugcccaugaccacaucagcuggcaucugcugggaaugagcucggggccagaauuauucuccauucauuucaacggccagguccuggagcagaaccaucauaaggucucagccaucacccuugucagugcuacauccacuaccgcaaauaugacugugggcccagagggaaaguggaucauaucuucucucaccccaaaacauuugcaaggcaagaaacucuccugacagucuugcuucucaaugcagaauccuuucuucccaugcacuaacucccucuuucucccuugcccuuucaagccaccugcaccgcagacaaacuuuccucaguuccuaacaaccaaacuuagauauuuugcucuuagauuuauaacuugcucuuuggggauggagaaagcgaaggaauuggcaaagguuuuuuuuuuuuuuuuaauuaagcaaaagcuaaagagaucucuaacuuccucgaaagaagaaaagaggaagaaaacaaaugcauacauagagauauucuuucuucggguuacuucauaugcaaaaaagaccuagaugcuagcacaagacaaacugcaaauuuacagaagcacuaaguuguagaaaguguaaaaguuuagcaugaaaacauuaaccuuuacagugggaugaacacaaagucuagcacagagaggaacucaaugaauguguguugaauggaucauacauggcauauacugaggggugagcuccaaagaacacuggggaauucaggugggaaaauaaaucaacccacguuaugugguaucguguaaacaaaauaacugauuguucuacuacacauuuuugcuuuaaaacuguugagauuagaguucauauaaauggagacuaaaaucuaaggaaaugauaucacaauaggaaaucauuuuguuaccaaaauaauguauaagcaacacauauaaggaagagauacuucaugagaucauuucuguuucuuuucacacgaguagucaaaauuauauuugaaguaauaaaaccaucaugauauccguggaagauagaguucccaauaauauuaaaacaacaauguaacuuuuguuucuuuguugaggauaagugcauuauguauuguuauuaauauuuaauuuuuaacaacaauuuuauuagguacuggugcuacuucauuuuauagauuaagggacagaugacagaaaaaugagaauuuaacaagacuuaauucauaaggucuuaagaaguuaaaaauuauuagaaauuugccugcucaagaagaaauaaagggaaucuuuccaaauuuuuucccuaaccccuccuccuuuucccccuuuuaaaauucuugccuuuucuggaugccacuuaaagaguuccaaacuaaaauguucaaaaauugccugagcauuacuuucacucuuauuauauuaauauaaaccuuccacaaguugauuuaaaggauaugcauuucaaucaaccauaauuucuucucuugaguuauuucauugucuuucuguccuaacucagcugggaugcaggcuuacauugacauuaaaaacugcccaaagaaaaccaggaaucuuaagaaaauaacucgugagcagaggcggcacaugaagaggugggaauacuucauugcugcagaggaagucauuugggacuaugcaccuguaauaccagcgaauauggacaagugaguuguugggguucauaccacugggcaaagguucaagacacauuccauaggguccuagauguuuggggugaaauguaaguucacagcucucaaggggacacauguauugguuucuauucaagucuuuuuguaaaaauuaaucuugaauuacccccaaaucaccaaagaaauucagccuaauaauaauaaaaaugacaacagcagcuaccuuuuguugaauguuugccauugccaagcacuguauugucccuuucugagagcuucgcuucaacucuacaaacuagauacugcucuuauuucuuuuuauagaugaggaaaugggucugagagauuaagagauuuggaaauucaaauagcucuuaaacccuugaaaaguuacucaaauucacucauaauaacagaaaugcaaauuaaacuucaugggaauacuacuuuuaucuaucacauucacaaguccagaugacaucaucuguugacaaggcugugagaaaaaagaacuaucauauauuguucguggaagauuaaauugguaaaaggauucugaagaauaacuuggcaauauguaucaaaauucuaaaugcauauacccuuugacucagcuaucucacucuggaaaucuaacuauacagauacacuuguucacaggugaaaugauguauguacaacauauucacuguugcaacguuaguaguaguaagacuggaaacaacccaaaauguccaucaguagaaaacuaguuuaauaaauuaggauacauucauacaauggaauacuaagcaucaaaaaaagaggaugcaaacacucuguauguacuaauacaaaaaguucuccaagauauguuauuaaauuaaaaagcugggauguaguauagcguguauacauagcugccuuuuguuaaaggagugaaagggauaagaauauuuauauuuucuuauuuguaagacauaaagguauucuggaauuacacgcaugaaauuaauauauggcuaccuagaaaauucagggaggguagggaggucauuuugagagucaucagagaaaagugagaguuuucacuguaauaaaaauuaugugaauguauuuucuauuaaaaacaauuaaacuaggaaaaagaacaaaaaaaauuuggccaagauuauagaauuguugacagaacugagauaggaauccaggaguguuuggcaacagucagugcuuuccacugggaaaaauaaauucauaaaaugauauuccaucuuaaaagauugcuggguuaaaugauauuucugacuuuaggucuuggaggaacugccauacugucuuccacaauggcugaauuaauuuacauuccaccaagaguguauaaguguuccuuucucuccaugaccuugccagcaucucuucuuucuugacuuuucaaucaucgccauucugacuggcaugagagggcaucucauugcguuuuucuuucuuuuuuugagacggagucucgcucugucgcccaggcuggagugcaguggcgcaaucucugcucacugcaagcuccgccucccaggcucacgccauucuccugccucagccucccgaguagcugagacuacaggggcccgccaacacaaauacaaaauacaaaaaauauaauuuuuuguauuuuuaguagagaugggguuucaccguguuagccaggauggucucgaucuccugaccucgugauuugcccgccucggccucccaaagugcugagaguacaggcgugagccaccgcgcccggccucauugugguuuugauuugcauuucucucaugaacacugauguugagcuuuuuaaaaugugcuuuuuggccgcauguaguugcuuuugcaaacuaagguaauaaagagggcaggggaaaagugguucauguuucugcucccaaaguauuuaucccaguagcuacaaaagaugggugaaggagguugcuuuucagucagcucagagaauuggcuagaugguggaagagauagcccaauagcacagaacuaugauuaacaaugcuaguaaauguuuccugggguuggaaguugcuuuuagggauuaagaaauaccuuuaaaaccaaaaaggcuaucauagaauaagugauaggacagacuuuagaaaaauuccuaguaucuuuucagccaguauaggccuuuucccagagauaucaaaugucugcuguagcaauaagaaugacaggaagaucuaaguagcugcuucuaaccaguuaccuaugacuuuuaucagugaugcaggagacaaaucagaaguuuccaguuuuccaacuagacagaaaacauaaggacuuugcaaacuacacuaagaaauuuuuagagaacuaguauguuagcuaaucuaagagcagaauguuuaagcacaaggguuuccccauccuaccgagaucucuauuugagaaagugguuuaauuuuuuuuuacuucacuuuaagaaaauacaggucucagcauuuggauaauuucucaaaccaaauuggaaaacauuauaagaaaguuauguacacacaguacgaagaugaguccuucaccaaacauacagugaaucccaauaugaaagaagaugggauuuuggguccuauuaucagagcccaggucagagacacacucaaaguaaguaacacaaauacagaaucaugggagaaauuacauaguaaaauauuauggaguaccugguuauuuuuuaauuuuaaaagaaaaagaugcucauauaauuuuaaauucaaaugcaacuuuuaguuuuuauuuaguauuuguauuuauuuacagcuuacucaguaauacaaaggaucugagacaguuucucaaguuauaaaggcauaaaacaaggagucuauguaauugggauagaauacggggacaaagaaaauaaagccacagauaaguagauaccaugugacccuguaaggcugucuucaaauuuuguccuaagcuuuauggcagucaguguaaaaaaggaaauaugucagggugaaguuuacaucaucuacaaaaagaaagcaccauuuauccugauguuaagaucuaagaggaacuucuuuaaugaguucuacaaaagagagugcugagugauacaguagauggcauccuugauaaaauucuuauaaccagcauaauagauuaaaaguugcauaaaauaauagauuaaaaguugcauuaaaauauuucucauuauagcuaagauauaacaguaaacacaauugaauagaaacaauuuuuacucauuuuuuaauguagucuagguaugcagcucucuaaugguuggacucugaugaagguaaacuccauguaucaagagcacggaguuuuccucagacaauucuccuuaaaugucaugucacuucaccaagauagauaagaauuggacagcagagaauuaaagguugcaaucuuugacaaaauccuagaguguaguuaaucuacagacaaaggaugauccaaaggcuuugacaaucaaccaaauagaagauaggauuaagguucucuuuugcagauuaaagagccuaacuaggacuccuguguguuuuaugcaccugacaaggucuauucuguucauuuaaaauagccaaaggacaaaagcaguuuuuuuucuccaugccucuuucccuucuuccauuucugaucccuuuuaugugcucucagcaaguguagacauaccuuauuaaaaguucaggaucuggcuauuugucugugccucucaagcaaguagcuuuucccccccaccaagggucuuacucugucacccaggcuggagugcaguggugugaucauggcucacugcaaccuccacuuccugggcucaggcgauucucgcaccucagccucucaaguagcugggacuacaggcacacgccccaacgccuggcuaauuuuuguauuuuuuuguagagaugagguuucaccauguugcccaggcuggucuugaacuccugagcucaagugauccaccugcuucagccucccaaagugcugggguuacagguuugagccacugaaccuagcugagaagaugacuucaaagacaguguccuaaaaaaucuaccgggcaggggaaggggaucauggucuagagaugagaagcagauucaaaaugagauguggcccaagcugaaaagagaagggcaggggaaggaggacuugcuuggagagagugauacugugaggaaaacgucacuucuccuaaccuauccucuaaagucagacuucucuuuccauuuuccaccuuaaugugugagugaaacacucucuccaaugcuccugccaagugaugaggggagguuacugcucagauaaacagaucuaauuuuccuacuguguguacacauguauacacacacaccauccaaaaggugaauaugcaaagcuaguaucuuauauuauuugucaugaucaaccuuaaauccuagaauaaauuugauuuaacuuuguagaucguguucaaaaauauggccagccgccccuauagcauuuacccucauggagugaccuucucgccuuaugaagaugaagucaacucuucuuucaccucagguuugaaucuuucacuucuacugaauccaacuaguaacuucugagaggcugccacauuuuucugcuauucuccuugcccgguggugucacuacugcagucagguaguauacauguaggaguauccuaaaaaucacagccaaacccuucucacuucaggaguuuugucucuuagugguaacaaaauauggugucuuuuauuagugucauaguggccucuaguggagcauuaucuaauggcuacauguuauccagguuccaaguagaauauuuaaagaauucaauugaacaaugagaacauuuagacacaggauggggaacaucacacaccggggccugucgggggggggggguggggggcggggggagggauagcauuaggagauauaccuaauguuaaugacaaguuaaugggugcagcacaccaacaugacacauguauacauauguaacaaaccugcacguugugcacauguacccuagaacuuaaaguauaauuuaaaaaaaauaaaaauaaaagaauuccuuuugcaauauuaauugguuccagcgaaagcuuauuuauuuauuuauuaucaugaaauaacuuugcaaaugaaaacaauuuugaauauauuuucuuucaggcaggaacaacaccaugaucagagcaguucaaccaggggaaaccuauacuuauaaguggaacaucuuagaguuugaugaacccacagaaaaugaugcccagugcuuaacaagaccauacuacagugacguggacaucaugagagacaucgccucugggcuaauaggacuacuucuaaucuguaagagcagaucccuggacaggcaaggaauacagguauuuuguccuugaaguaaccuuucagaaauucugagaauuucuucuggcuagaacauguuaggucuccuggcuaaauaauggggcauuuccuucaagagaacaguaauugucaaguaguccuuuuuagcaccagugugauaacauuuauucuuuuuuuuuuuuugucuugucuauuuuuaucaguaccaucacugccgaaggcaagucuagagugugauaacauauuuugucuuaguuucaaauuccaggucuguugguauuggauguguugagcaaguugauuagccuuuccuaauuucuuccuuuuaucaaauggguaauaacccuccuaaaaauguuacaggucuguuuggggguucagugagauaccaucugguaaaaguauaaagcucuuuaccagucuuugcuauuuuuagagaccugcaauagggagacagaggagagauucucugaaagcaaccaaauuuagagacauaguuccuagugaaauuggacccagauuauggcccaucucuguugagacuaaaguauacagaagaaugugaacaaagauacugaauuucugaguuugucuucauugaagaauuguagucucauauuauuaaacuaaaauucccaauuaugcuaaacuguaaccaaagaggucuuaucucaaggcauacaaaauaaacauaugccuagaaaaagcagaaaugaauuucuggacauauggaagauccugauuuauugagcuaggaaaggaaacagguaguagaagcauaaggcuuuucuauugcaaccuucucuuucauccuuugcacuuauucagagcauauucagucaaucauucauguugaaaggugugcaauuacagagauagacagacuuucagcugccauagcgaaaugagauuuuucuuuugggauuuguuuuuuuuuuuuuuuucuuuugagacagagucucacucugucacccaggcuggagagcaguggcaccauuuuagaucacugcaaccucugccuccuggguucaagugauucuccugccucagucucuugaguagcugggauuacaggcgcccgccaccacccccauguaauuuuuguauuuuuuaguagagacaggguuucaccauguuggcuaggcuggucucgaacuccugaccuaagguguuccaccugccucagccucccaaagugcugguauuacaggugugagccacugugcccggcucuuuugggauauuuuaaucucugaauuuucuuaucuguucuguuugcuuuugcauauuaccuuuagcucuaacaagugcuguguacacaauggacucucauaaaugccugaauuauauggcuucaguaguuccaagaacuaugucacuuugguuucugagaacucagugguguagauaauuugcugcaauguuaaugacugaauacagcacuuuuuuuucuuuuuuuuuuacucuuaaguucagggguacuuaugugcaggaugugcagguuuguuacauagguaaacaugugucauggaggucuguuguacuuacuacuucaucacccagguauuaagccuaguauccauuaguuauuuuuucugauccucucccucuuuccacccuccauccucugauaggccccaguauguauuguucccuucuauguguccauguguucucauaauuuagcuuucacuuguaagugaaaacaugcaguaugugguuuucuguucuugcguuaacuugcuuagaauaauggccuccagcuccauccaugucccugcaaaggacauaaucuuguucuuuuugauggucacauaguauucuaugguguauauguaccauauuuucuucauccagucugucauugaugggcauuuggguugauuucaugucuuugcuauugugaagagugcgaaaaugaacauacgcaugcaugugucuuuauaacagaaugauuuauauuccuuuggguacauaccaaguaauggaauugcuggguucaaagguauuucugacuuuaggucuuugaggacucaccaugguaucuuccacaaugguugaacuaauuuacacucccaccaagaguguauaaguguuccuuuuucuccacaaccuugccaacaucuguuaguuuuugacuuuuuaauaauagccauucuuauuggugcgagaugguaucucauugugguuuugauuugcauuucucuaaugaucagugauguugagcguuuuuuucauaugcucuuuggccacaugugugucuucuuuugaaaagugucuguuccuguccuuggccuacuuuuuaauggggcuguuuguuuuuuucuuguaaauuuaaguuccuuauaaaugcuccauauuagaccuuugccagaugcauaguuugcaaaaauuuucucccauucugaauguugucuguuuacucucuugauaguuucuuuugcugugcaggagcucuuuauuucaauuaaaucccauuugacaauuuuugcuuuuguugcuauugcuuuuggcauguucgucaugaaagcuuugcccaucccuaugucccaaauaauauugccuagguugucuuccaggguuuuuguaguuugggguuuuacguuuaaguguguuguuguuguuuuuuguuuguuuguuucuguuauuuuugagauggagucucguucuguugcccaggcuggagugcagugguacgaucucagcucacugcaaccucugccucccauguucaggugauucuccugccucggccccucggccucccgaguagcugggauuacaggcauaagccacgaugccuggcuaauuuucuuuucuuuucuuuucuuuucuuuuuuuuuuuuuuuuuaguagagacggguuuugccauguugaccagacuggucuucaacuccugaccucaggugauccacccgccuuggccucccaaagugcugguauuacaggcgugagccaccgcgccaggccuacauuuaagucuuuaauccaucuugaguuaauuuuuguauaugauguaagaaagggguccaguuucaauuuucugccuacggcuagccaguuuucccagaaccauuuauggaauagagaauccuuucccuauugcuugcuuuugucacagaucagauaguuguaggugcgcagccuuauuucugaguucucuauucuguuccauuggucuaugcgucuguucuuguaccaguacuauacuguuuuguccuccagagggcagcagacaucgaacagcaggcuguguuugcuguguuugaugagaacaaaagcugguaccuugaggacaacaucaacaaguuuugugaaaauccugaugaggugaaacgugaugaccccaaguuuuaugaaucaaacaucaugagcaguaagucagaguacuauuuuuguucaucaguuuuucauuccugugguugaaauaugacugugccuagagucagagacauggauuaaaaucuacucgcuaaggggcaccuccaauccucacuuccaguccaaagacuuggugaugaaauccgugggugacaucauagcaacauuuuuaagcaagaggucaaaggcucacauccuuagaaaugcguuugaucuucuauuccaagcguguguguguguguguguguguguguguacacagacauacucugcguggugaggaaaagggugagagaguaggacuaauggaagguguuauaguccaugucaauaguauccuagacugaguucagggugaauauauggcuaggacagaaagaaggcaaguaauccaaagauggauugacacaucaaaguagagcaaaaugaguauagggacccaagagucuuggaaaggcaugcaugaagacauuucaagugaucaguaagauuuucagaacaaaaggaauucccugaaugaggguuccggcauuugcugcaguucuaaaguucaguggccaaaagcacugccauggcagucugagagaaaugucacugagccagcuggaagcaaacuucuccacaacagccagggucccccuacugauccucagagucuagagucaugguaaucaccuucucuaguagguaaucacacaugugaggaugauuucugcauguucuguucauauagcuucagaugacugacagcuagggauuaucagagcugacaggugccaggucaaauaauucaaacagaaaauuacucucagcuuucuuugcauaacuuccuuuuggcagugaaucuaucauaguucuagaccagugcuguccaauagaaacuacguaugagcuacaugcguaauuuaaaauuuucugauagcaacauuaaaaaguaaagagaaauaggugacauuaauuuuaguaauauguuuuacuuaacucaguauauccugaauauuaucauuucaacauguaaccaauauaaaaauuaaugagacuuacuuuauuacuaagucuuugaaauucaauguauauuuuauacucacagcauaucucaguccagucuacccauauuucaagugcucgauaaccacuuguagccaguggcuaccauauugaacaaugcaguuauagaccauuuagaaaaacaucuagaaugagguauaaacuaauaauacaucauguaaauuauuaaagucacuuaagugauuuaaguagguauuuaaauauuuguuaaugccagucauuauacugguacuaaggcuaagagugguaaucgagguagacaugagcccugcccuuguagaaaucauaccuuugguuuuuuacuaugcuuaguacauaaguaaauaaaaauauugccuacagcagugucccuuuuaacaauaaugaaauguaugaacuggauacucaaauggaaacugugaauacuauguagauuauaagacagcaauaaaaacuauaaaauaugcuaaaugggcuuuauuuuuagggacauuacuucuuacccaaugacuaauauaucaaaaagaugaauuucuuauauuaugcuuuuccuccaaguggaauuauuagaauaucuuuaaaggcagagaauggagcacaaaauauuuacuauacauuugaugaaugacuaaaucaauguaaauggaaggcuuuaucuuuuuccugagauuucuccuuuggcuaauuuaggagaauaaucucucauuugaaaauucugaguuugaucuucuagucacauguuagacuagauaaagcuuaucuuggauaaucacugcuuugacacaaccaaauuaacauggagacauuuaucuuagguauaauuagacacaugcccuuuuguuggcauagacuuggaauuuuaacagauuuuacacuuucagcuaucaauggcuaugugccugagagcauaacuacucuuggauucugcuuugaugacacuguccaguggcacuucuguaguguggggacccagaaugaaauuuugaccauccacuucacugggcacucauucaucuauggaaagaggcaugaggacaccuugacccucuuccccaugcguggagaaucugugacggucacaauggauaauguuggugaguaagagucuggacacucacagaggaagcuugcuuugaauuucuggucuauaaaggucugcugcaacucuccaggcuaccagugcuccucuauguaucucccugacccccugcaggcuuuucuuucaauguuucucaugauuucucuuugagaaauuaaugacuuaaauggauccaguucuuuaguguggguuauauuuuuccuucucugggcaaaguaggaaguaaaaauauacaacagcagaaaaauaaggcauaacucugaggaagaagcauaaauauuuuggccacaaaagagcauuucuuuuaucaaaaugcccuauucgguuuuuugcaacagucaucuucaaucaucagguacagugccuuaaaggcugcuucagcaacagcuuuggaguuugucagacuggaaugcaaguccugaucugccaaucgauugcuguguaaccuuacacaaguuacuuggccacacugagccacaagucauuuaucuggaaaacaguguaaucacaucucacagaguuacuuugaccauuaaaauaguaauaugcgccaagugccuagcacucaguagacaccaacaaugguaacuauuggagacucaccaagaaaucuuugauguuccagcaaugcaugccauuucagagauucaaaauuguccucgugaauuauuacuuagaaacaucuaaaugucucuuauuuguggggauagagcucaucaccaucccuuuaauucuaagacaagaugugcuguuaggauauuuaugauauuaaaaguccauuuuauucuugauucaucccuuucuuaauauauuuuaaaauagugagcaacuaucugugcugaaagaccuuuuuuccccucuaaucuccacuaagcaacacuuuuguuuuuuauucuguuaagcgagaugaacgcacuggucaugugcuuagagucacagcaaugucaaauugcuuuagaaaaacaaaaguuuacuaaauauuucauucucauuuuucucuccuuguguuauuuugacccaguaaucaauaggucacagacaagcagugguccacagcccauacuugaauauuccugacgaaaguuuauuagaaauuaccugccacaauggauuauuguguuuucaugucuuuucccagacuuccagaucucucuucugucugucucucuucuguaggaacuuggauguuaacuuccaugaauucuaguccaagaagcaaaaagcugaggcugaaauucagggauguuaaauguaucccagaugaugaugaagacucauaugagauuuuugaaccuccagaaucuacagucauggcuacacggaaaaugcaugaucguuuagaaccugaagaugaagagagugaugcugacuaugauuaccagaacagacuggcugcagcauuaggaaucaggucauuccgaaacucaucauugaaucaggaagaagaagaguucaaucuuacugcccuagcucuggagaauggcacugaauucguuucuucaaacacagauauaauuguugguucaaauuauucuuccccaaguaauauuaguaaguucacugucaauaaccuugcagaaccucagaaagccccuucucaccaacaagccaccacagcugguuccccacugagacaccucauuggcaagaacucaguucucaauucuuccacagcagagcauuccagcccauauucugaagacccuauagaggauccucuacagccagaugucacagggauacgucuacuuucacuuggugcuggagaauucaaaagucaagaacaugcuaagcauaagggacccaagguagaaagagaucaagcagcaaagcacagguucuccuggaugaaauuacuagcacauaaaguugggagacaccuaagccaagacacugguucuccuuccggaaugaggcccugggaggaccuuccuagccaagacacugguucuccuuccagaaugaggcccuggaaggacccuccuagugaucuguuacucuuaaaacaaaguaacucaucuaagauuuugguugggagauggcauuuggcuucugagaaagguagcuaugaaauaauccaagauacugaugaagacacagcuguuaacaauuggcugaucagcccccagaaugccucacgugcuuggggagaaagcaccccucuugccaacaagccuggaaagcagaguggccacccaaaguuuccuagaguuagacauaaaucucuacaaguaagacaggauggaggaaagaguagacugaagaaaagccaguuucucauuaagacacgaaaaaagaaaaaagagaagcacacacaccaugcuccuuuaucuccgaggaccuuucacccucuaagaagugaagccuacaacacauuuucagaaagaagacuuaagcauucguuggugcuucauaaauccaaugaaacaucucuucccacagaccucaaucagacauugcccucuauggauuuuggcuggauagccucacuuccugaccauaaucagaauuccucaaaugacacuggucaggcaagcuguccuccaggucuuuaucagacagugcccccagaggaacacuaucaaacauuccccauucaagacccugaucaaaugcacucuacuucagaccccagucacagauccucuucuccagagcucagugaaaugcuugaguaugaccgaagucacaaguccuuccccacagauauaagucaaauguccccuuccucagaacaugaagucuggcagacagucaucucuccagaccucagccaggugacccucucuccagaacucagccagacaaaccucucuccagaccucagccacacgacucucucuccagaacucauucagagaaaccuuuccccagcccucggucagaugcccauuucuccagaccucagccauacaacccuuucuccagaccucagccauacaacccuuucuuuagaccucagccagacaaaccucucuccagaacucagucagacaaaccuuucuccagcccucggucagaugccccuuucuccagaccucagccauacaacccuuucucuagacuucagccagacaaaccucucuccagaacucagccauaugacucucucuccagaacucagucagacaaaccuuuccccagcccucggucagaugcccauuucuccagaccucagccauacaacccuuucucuagacuucagccagacaaaccucucuccagaacucagucaaacaaaccuuuccccagcccucggucagaugccccuuucuccagaccccagccauacaacccuuucucuagaccucagccagacaaaccucucuccagaacucagucagacaaaccuuuccccagaccucagugagaugccccucuuugcagaucucagucaaauuccccuuaccccagaccucgaccagaugacacuuucuccagaccuuggugagacagaucuuuccccaaacuuuggucagaugucccuuuccccagaccucagccaggugacucucucuccagacaucagugacaccacccuucucccggaucucagccagauaucaccuccuccagaccuugaucagauauucuacccuucugaaucuagucagucauugcuucuucaagaauuuaaugagucuuuuccuuauccagaccuuggucagaugccaucuccuucaucuccuacucucaaugauacuuuucuaucaaaggaauuuaauccacugguuauagugggccucaguaaagaugguacagauuacauugagaucauuccaaaggaagagguccagagcagugaagaugacuaugcugaaauugauuaugugcccuaugaugaccccuacaaaacugauguuaggacaaacaucaacuccuccagagauccugacaacauugcagcaugguaccuccgcagcaacaauggaaacagaagaaauuauuacauugcugcugaagaaauauccugggauuauucagaauuuguacaaagguuuggccaguuuucuccuuuuuuauucucauuuuuccauuacugcugaaaaaaguagcuacuacaauucagggggauaauugugggcaaauuauacuaagaacagugugguuccccuauugcaaguuggccuguucuuuuuccuuugucaauuccaagauugcuucuuuaccuuagaugaccccuggacaauauaagaacaaucacugugagaacucuauaauauucuguaauuaagcauuuuucuguguccucuccucuuacuacccauguuucuacugacucuuauugcuccaggcagagcccaaccuauccauagcuauaugcuaaucaauaugauuuaauugaaguuagccucaaauccaaacucaaauaugauguagaaaucuccuuuuugcauuuacuuguuuagaucagaauuucuaagagauccaaaucccuuuuuuaaaagaauauuuacaauucaguuuugcuuagggguagaaagccauguugaacugggcucuuuguucugggaugaagauacagaaagagaagagagaggaggaaaggagcaaggcuuagucaacuacaaauucucagggauauagcaugaugacugugcaucagcugucuagauaugcccacagcuuuuacuaaagcuguuacacuaaucacuuaaaaaaccaaaguguaauuacaguaggcaaacacaauguauggugugacuuaugcauaugaguucauuaaucugaugccugacaucuccacauuagaacucuguuuaaaacaccuuuuccuaugacuuccuauuuaaauguugcacucaauaccacaugagaacaacuagcuaccugaguauuucuaagcaaggccccgagggagugagaugcagggccuguccagagugaauagggauggaaccaccuucaaaaucuuguauuccauucaaggcucacaacccacuuuuauggcauucggaguugcuuuacccacucccuuguguucugugaguuugcauguuaugcucagagucuggaaagaugggauuaguaggggagguagaccagaagaaaggcagaaggagauucucuguugaugacucacaguauauagcaaauauuauggguuugaugggugaguguuuggcuuguuuccacaggcuugggaaaugugagagucagugggagaauucgacaugcuucaguccuagacugagccaaugaacuagauggaaauaaugugcuuuauuuauuuauuuauaauuuguaauuaaacuuuuuauuuuggaacaaaaauaaaauagauucacauacagucaagagaaauaauacggagagauccuuuggguauccugaguauucuuuacccaguuucucccagggguaacauuuugcaaaucuauaauacuauaucacaaccagcacacugauguugauacugucaagacacagaauguucaccaucaccauaaaaaucccucucauuaccccuuuauagucacaucugccuuccucccaccauagcccuuccuuauucccuggcaaccaguagucugaucuccauuucuauaauuuugucauuucaagaauauuacauaaauggaaucaggcaacauguaaccuuuggggacugguauuuuuucacucaguauaauucucuggagauucaucugguuauugcauguauuccauuauauggguguaccccaguuuuuuuguuguuguuguuuuauacacauuuaugguguaaacaugauguuuuaauauauuuauaaauugugaauuggcuaaaucaagcuaauuaaccuaugcauuaccucacauacuuuuuugugguuagaacacuuaaaauguacucagcaauguuaaaaauucaguguguuguuauuaacuacagucaccaucuuauacaacagaucuucuaaauuuauuucuucuaacugaauuuuaucuuuugaccauuuucucaaugcuccaccucuguaucccuuuguuaaccacuguucuaccuucugcuucuaugagcucaauguuuuuaguuuccacauuauaagugagauccugcaguacuugucuuucugugccuggcuuauuuuauguaacauaacgaccuccugguucagucauguugucacaaauggcauuucuucguuuucuuuuuuuuaaaugcuaaauaguauuucauuguuuauguagaucacauuuaagaaauccauucauuuguuuauagacauuuggguugcuucccuaucuuggcuaauguggcuaaugcugcagugaacgugggacagcagauaucucuucaacauacugauuucauuuucuuuggguauauacccaaaagugggauugauggaucaugugguaauucuauuuuuaauuuuuaaaggaaccucccauacuguuuuccauaauggcuguacuaauuuacacucucaccaagaguauacaagaguucccuuuucuucacauccaugccaacauuuaucucuugucauuuuuauaauagccauccuaacggugugaggugagcccucauugugauuuuaaauugcauuucucugauuauuaguaauguugagcaucuuuucauauauuuguuggucauuuguaugucuucuuuuacgaaaugucuauucaagucuuuugcucauuuuuuaaucaggcuauuuggguuuuuugcugaauugaguuccuuauauuuuuaauauuaauauucuuaucagauaucugguuuucaagaauauucucccauuccaaagguugucucuucacucuguuauuuccuuugcugugcauaaacuuuugaguuugauggcaaucccauuugucuauuucugcuuuuguugccuguacuuucgaggucaaauccaaaaaaucuuuguccacaccaaugucaagaagcuuaagaauaauggacauuagcaaaaaacaaaugugagaagaguggcuacuuuuaggguacaaaacauucacccauccagugacuuucauaagugugaccuucuaauuaaucugaccauugucaccugauagccccaagcucuggcacugucccauuacauggcuuugucugccuuugaucuuaaaauuugguguguuaacauacgauuauauuuauacauucauuuauauguuugacaaaaauuuauuaaguuccugcugugugucagauaaugugcuuaccacuggagagaguacuaugagcaaacuaggcacaauggcugaccucauggcacuuauacccagugagagacagauauuaauagauaaucucacaaauaaauuauauauaaucuacaauauauauucuagagauauuauaagaauacuacaggaauuuacuauauauacuauaauaauacuauagaaauaugagaaauugauauagagacuugaccuagucuaaaaggucauaggaagacuuaccuauaaaauaauauuugaguuaggaauugaaagauauuuacuggcuuuuguuuuuauccacuuauauauuuacucauuuauccaccaaguauuuauuaaagaccuucucuaugcuagaugcuauauuuagaaagagacaauuuccuaaauucugggaacagucuuuaauuucuucuuuuacacaaauaguauuauuauuucagggaaacagauauugaagacucugaugauauuccagaagauaccacauauaagaaaguaguuuuucgaaaguaccucgacagcacuuuuaccaaacgugauccucgaggggaguaugaagagcaucucggaauucuugguccuauuaucagagcugaaguggaugauguuauccaaguaagucuuuugagcacugcuaagaucuucggaggaauuuccacaagcaccagaggguuguaaaggugcagguggcaagagagcuauaggugauuuguuuguuuuccaggauuaaugaauaauuacauuucuuuucaaagacuccuugccaagcaauuuggcaaucuucgaacuaaaaaaaaaaaagaucucauuuuuuaaaugcugaaaacuauauaaucuguggaaaaucuuucuguaauuucuaucuaaagcuaaccuaucuaaaguuaacacagaaaauuaauauauucaagagcaauugaauuggguuucauagcaguggugguggugguggcaguagcagugcuaguaguaauaguaauuuagaaauaucuucagguguuuuccuaaaaauuaaauaaaaugaaguuaaauaaaaugaguaaggaaaguaaagaugucuccaugcccuccaaaagugagcaaguuucuucagugucuuccuaguucugguaauuucuuucaaaaucuuguguccagacccacgauuauaacuugcuuuuauaacaaaguuuacuuccgccauuuuugcuaaccgcucacauucaaaaacccagaaagaacccugauucuaaaguaagcuauucuagauuuuaaaauauaaucuacuauaccuguguaagcauucacuacauuuucagugaccauuugcucuuuuuaaaaacguaaacaaguacauagggauauaagaaucuuaauuauucuaaauuuuccaugaagcuaugggaggcaauauucucuuuuaugauuaggggauccuuuuucaagaugaacgauaauuuaacacaauauuuaaaaaacuuauucuaaguaacucaggaaucaaaaaccagacacuguauguucucacuuacaaaugggagauaaacugcggguaugcgaaggcagacagauugguauaauggacauuggagacucaaaagggaacgggggauggaugaaaagcuaccuauuggguacaggguacacuacucaggugacagguacacuaaaauccuagacuucaccacuauacaauucauccauguaaccaaaaaccacuugcauuccuaaagcaacugaaguuuuuuaaaaaauuuaaaaaucaaaauuaaugcacgaaagccacaauaaacaaaaccucacaauugugaauaaagacaggauaaguaacaauguugcauugagacauacuggagccuuaggcaaaaggaaaaaaaucaaauacugaaucuuuguuuuagcccuggauuucacuagauaaaaaugacuucauuuguguauuuuuaaaauaauuuuaacuuuuauuuuagauucagggggcauaugugcaguuuuguuaucuggguauauuaugugaugcuguuguuuaggguaugauugaucccaucauccaaguagcgugcauaguacccaauaguuuuucaucccuugcucaucuccuuccuucccccuucuagaaguccccaguguuuauugccaucuuuauguucaugaguacccaauguuuagcucccacuuauaagugagaacaugugguauuuggcuuucuguuucugcauuaauucacuuagcauaauagccuccagcuggcauccauguuguugcaaaggacgugauuucagucuuuguuauggcugcguaguauuccauggugcauauguaccauauuuucuuuauguaguccaccacugaugggcaccuagauugauuccaugucuuugcuacugugaauaaugcugugaugaacauccuaguacaugugucuuuucaguagaacaauguauuuucugucuuucuuucuuuuuuuuuuuuuugagauggagucucacucugucgcccaggcuggaguacagagguaugaucucaacucacugcaaccucugccucccagguucaagcaauucuccugccucagccucccgaguagcugggauuacaggcacccaccaccaugcccagcuaauuuuuguauuuuuaguagagacaggguuuuaccauguuggccaggcuggucucaaacuccugaccucgggcaaucugccugccucagcuucccaaagugcugggauuacaggcaugagccauugcgcccggcugaacaauuuauuuucuuuuuuggcuauauacccaguaauagaauugcuaggucaaauuguagcaggacaagccacagacaaaaaccccucagacaccaaguuaaagaaggaagggcuuuauucagccgggagcuuuggcaagacucaugucuccaacaaccgagcuccccgagugagcaauuccugucccuuuuaagggcucacaacucuaagaggguccacgugagugggucgugauugauugagcaaggaggggguacgugacugggggcugcaugcaccaguaauuagaacagaacagaacaggacagggauuuucacagugcuuuucuauacaaugucuguaaucuauagauaacauaaccgauuaggucacgggucgaucuuuaacuaccagguccaggguguggcgccgggcugucugcuuguggauuucauuucugccuuuuaguuuuuacuucuucuuucuuuggaggcagaaauugggcauaagacaauaugagggguggucuccucccuuaaaauaguaguucuguuucaaauucuuugagaaacccccaaacuucuuuccacaguggcuaauuuacauucuaagcagcaguguauaagcauucccuuuucuucacagccucaccagcaucuauuuuuugacuuuguacuaauagccauucugacuggugugagaugguauuucacugugguauugauuugcauuucucugaugauuagugauguugagcauuuuuuucacauuuguuggcuauuuguaugucuucuuuugauaaguaucuguucaugucuuuugcccacuuuuuaaugggguuauuuguauuucgcuuguucaauuguuuaacuaucuuauaguuucuggauauuagaccuuugucagauacauacuuugugaauauuuuuucuauucugugucuguucacucuguagauagcuucuuuugcugagcagaagcucuuuaguuuaauuugucaauuuuugcuuuuguugaaaugcuuuugaggaauuagucauaaauucuuucccaaggcugauauccagaaugguguuuccuagguuuuucuucuaggauucuuauaguuugaggucugacauuuaaaucuuuaauccauuuugaguuaauuuuuguauaugaugaauccaguuucauuggauucauugggguucaguuucauucuuccacauauggguagccggcuauuccagcaccauuuauuaaauaugaguccuuuuccccuuguuuuuuguuguuguuguugcuguuguuguugacuuugucaaaguucaggugguuguaaguguguggcuuuauuucuggguucuuuauucuguuucauuggccuaugugucuguuuuuguaucaguaccaugcuauuuugguuauuguaacuuuauaguauaguuucaagucagguacugugauaccuccagauuuguucuuuuugcuuaggauugcuuuggcuauucaggcucuuuuuugauuccauaugaauuuuagaauagcuuugucuaauccugaggaaaaugauuccaguaguuguuaaaaaauaguguugaaucuguagauugcuuugggcacaauggcuauuuuaacaauacugauucuuccaauacauaagcauagaauguuuuuccauuuguuugugucaucuaugauuucuuucaucaguguuuuguaauucuucuuauagagaucuuucaccucuuugguuagauguuuuccuagguauuuuguauguguguguggcuauguuuaaugggauuucguucuugauuucgcucucaguuugaacauuacugauguauagaaaugcuauuuuguacauuuguacauuuuauuuuguauaauugauuuuguacauuaaucuugcauccugaaacuuuacugaagucauuuaucaguuccuggagccuuuucauggagucuuuaggguuuucuagguacagaaucauauugccaaugaagagagauacuuuaacuucuuuucuucuuugguugccuuuuauuucuuucucuugcuugauugcugugacuagaauuuccaguacuauguugaauaagagugaugagauugggcauccaugucuuguuccaguucucacggggaaggcuuucagcuuuugcucauucaguaugauguuggcuguagguuugucauagauggcuccuauuaguuugaaguauguuccuucaaugccuaguuuguugaggguuuuuaucaugaagggauguuagguuuuaucaaaagcuuuuuccacauuuauugagaugaugauacuguuuuuguuuuuaaugcgguuuauguggugaaucacauuuauugauuugcauauguggagccacuuugcauccuaggaaugaagccuaugugauugugaugaauuaauuuuuaauuugcugcuggauuugguuugccaauauuuuguugaagauuuuugugucuauguacaucagagauauuggccgguaguuuucauuauucauugugucuuugccagguuuuguuauuagggugaugcuggcuuuguagaauaaaauaaggaacagacaauuagggagucuuuaaucacuagaaguuauagaagggcugggaggagcuucaugggucugacugcuggggugugaagacuucucauauggcauuuaaguccuuuaccaucuggccccaaccugcuccuuuucuagccucauuucucaccagguuccaccugucccugugcauuucacagcccaguuccaccgagauccuugcuauuccccaaacucuuccuuuacuccccugcucacaggcauccuucugcccuucugagagucugaaaugucuuucuagcuccuguucauucuaugauggccaauuccauuuccucuaagaaacuuaccuuaauucuuccaaccacuccuaaauauucaaccaaauuguuccuccagggcauugucaucugaacccacuuagacuuuguauauagcaccuguugucuccagauuuguaguguggaugcccaugugcaugucuguuucagcaggagcuuaaaagcuucuuaugaacaagaaucaagcuucuuucaucuucacaucuccacuaccuaucacucucauuucauuaguagauaaugucaguacuuuagccuugagccuaagaacaaauaucuuuugguauuucuggagaaaacuacuugggccauaucucacaggaugguuaugaaaauuaaaugaaauaauauacauaaguuauuuuguaccuuauaucuuagcuccgauuuuauaaccagccauuuugacuuauaaugcugacauuuuugugguuuagauuuuuguuaagcuuaaguacauuuguggaucauuccuuuuccuagguucguuuuaaaaauuuagcauccagaccguauucucuacaugcccauggacuuuccuaugaaaaaucaucagagggaaagacuuaugaagaugacucuccugaaugguuuaaggaagauaaugcuguucagccaaauagcaguuauaccuacguauggcaugccacugagcgaucagggccagaaaguccuggcucugccugucgggcuugggccuacuacucagcugugaacccaguagguacuuucauugaaaguuuuucucauuccccuaaccucguaaucugaaguccaccaaauggaagagucgggguuauuucuugucaaaugucugucuugcuuuucaugaggaaugcauaagggugugguuaacagucugcauuuaucauaaccagggacucuccaugcagcucuucagaugacagagagagaaacauuuauucaguggagaggaggaaagauuacuugaaugauuggccaugaauuagaaugccuacauuuacagaagauggcauuuauuugaaauuuucuugaacaaguauuagcuauguucugcucuuucuuuaugaaaagaacugcaaagucaagacuccuuuaucugacauucugcaauguauauauacuucaaaacaauaugucauacacaguauaugcauacaauuuuaucugucaauuaaaaagagaaacaacuccuccauuucaggcauaguggaaagagcacagacucagauuuaaauuuuuacccugucaaugcauaauccuaggaaauuccuugaccucucuuagccugguaucagaaguuaaaaaugagauaacaguacauagugcaugguaagcacuugguaaauauuuguucaaugaaugaauuuauauuuaccauauaagauaguugucaggauuaaaugggagauugcaggcaaaucauuuaauauaguaauagauucucaauaaauaguaucccuuauauuaucaauuuauuauuaucaucauuguuacugggauaaagaucaaucagaggaaggaggauuaugaauacaacagaauuaggugauaaauauccaggcuuauuaugccauucauuuauaaucuucaucuucaaauucagagccuaucagaaaguuuccuuuucuauaugaugagugauuaucagaagagcaaggaaauuccugagaaagaggcaauacaauuuacucuguuuuuccaggaaaaagauauucacucaggcuugauagguccccuccuaaucugccaaaaaggaauacuacauaaggacagcaacaugccuauggacaugagagaauuugucuuacuauuuaugaccuuugaugaaaagaagagcugguacuaugaaaagaagucccgaaguucuuggagacucacauccucagaaaugaaaaaaucccaugaguuucacgguauuuuccucagacuuugaucuaaucuccuaauuaaaucacacugggucacagugauuucugcccuuagauauucacaagauuagacaugagaugcuucugagacacccagagcuacaacuaaaaccgguuccuuaacauuccagagggcugauguaaucuggcaggugacacugugggugaggcaaaaagagaaagucugaaagauagcacagagaagcugcugcaaaacaaaccaacagaaaaccacaacaacaaaaagccagugugcuucagcugguaacauacauugaaaaggaauuaacauuguucugcaauuuaaaguuaauaagcuuguuucuggaucucuaaaggcacaaguguuuauauaaaagaaaugaucaccugugugucuuuucuaaaauaagaaugacgcuaacaguuuuagcucucagcagcuaccagguggcacccaaagcauaugagaacaaaaugagauaagaaacuagguacccagguaauaggagaauaguggcaagagagcauuuggguggucacacugggaaaagugugccuauuuggaaauucacaaggaaaauuugcccuguaagcuaguaacugaaacagaaacugagaagagaaagguacgagcuuguguuaugaauauguagauagguguucucacgccugauauaauuugaaggaugcccaaaugaucucaacccgucccucuccaaaaauucaccugccugguuucugaaauuucacagcaguuccucuaacuuaagaaggaggaaacaaagcacuuccuucacuuugguuucaguuaaacguuugguaacacuaaacuuuaucuuuacaguuuuguguuacauuuuuaaggugaucaaguuucucaggaacuuuuuaaaaaauccgcguauuuuacuguggggagaguagauaaagccugagaacccuaguuaucuaaucugagaagugggcagaggaguugucauaccaauaagagaauaaacaugacuugcuaugguugcuggauacaccaacgauaaacuccuaauuuuauaaacuccuagacuuccuaauuugccugaaacuuucucugaauuuagaaggccuuaaggugacaugcugcauaucuccuugcugacucuaaucccuggaguuuacuuugucugcccauauuuguauuuaucuuuuguaguuaaggaaaauuaagacuguuaauggaaaguauacacggguaaagcacggaacuguaaaagcugaggaaaagagugauaaacugcuuggaaagggaguucccccugccuucugcuguaggcuggugugaaugauaugagaaggacuagugguucugcuuuagccucucacuaaugugacauacaagagggcccuuuccauggcuagguaggccugggaaugcagaaucaugaggaacauggguguugaguggguugccccauauuuccuuaccacucgcccucucugugucaacagauuuuuaauugauuucaacucuuuguccuuucagccauuaaugggaugaucuacagcuugccuggccugaaaauguaugagcaagagugggugagguuacaccugcugaacauaggcggcucccaagacauucacgugguucacuuucacggccagaccuugcuggaaaauggcaauaaacagcaccaguuaggggucuggccccuucugccugguaaagauuggguaaugggaagaggucccugcuaagaaauacagggaaaaggcaaucuguaacuccuucucauuucuuccuugugcauauacuuccuaaggggucagaacacaggguucuggcauagagccuaggcaaacccauagacccaaaguauauacggaguacaaaaaugucaccuaauuuaugaacuauuugcagcaccacacaggcuaaaugugugacccaacucaguugcaacauaacaugcaguuucucccaagccacugugugucauacagaugaggucuuaagcagaugaaaaaaugaaucccacagggcucaggcagcuacagcuaucucugcugggaggguuuccagauucuucaguucugcuccucuucuaggcccuaucacccuaauaucuuugggcaagugacuccaggaaucacauucuuaaacugacuuauagacuguuugaagaggaaaacauuuuuaaaaaauaauaauaaaaguuaaagaauaacaaagguauuuagaacuuuucaugugcaaaauaaagauaaauguagauuuaaacagucuacaauuauacagaagggauguuucugugccaaugaguuguuuguaaguguaucuacuugugcagcaguauaaaaaccuaggaagucaguuaaaaugcagaugugaaggcagagggauuuuguucucagagacuuuaaaguagauuuugggcagaauuccaaggagucuguauuuuuaacaagcagccuuccuucuauuuugccuucuauuaaaaguaauggcaaaaaccgcaauuauaguuugcaccaaccuaacacaugcugccugaggaguuagugaaggcagccccucgacagcacuuugggugacguugugugaaucugccucagaugcaggcacagaaguccaaauggacugguuugauuaagagcagggaaaaaaagaggguucuuauugguuuuucacaugccaguaacucacuaauacaucuagagaguauuaauuguauuauauuaauaucauauuaauuaauuaauauaauaauuaauagauaauuuauuguauuaaaaucagagacagaagagauucagucaaauuuacucaucuuuucaucaaguauuagaagaucagucauccuuccuaucagccugcagacagacugagaagcuaggauuggcuggugucucuaaaucugcaaaccuaaauaccugcauuggagagaggaaaacuggagacauuuuucaguguguuugaggaagauaaucauaucuauucauuuucacccacaaucugggaaacagucauaaauuauagucaacagaauuuaaauauuaacugccaggggguaauguuaaauaccagaauggauagccagagguuuuagaaaucucauucuuucaguguuuuuucugagcaauuuauguaaaucucuauucaaauauguaagcuuuauggaaaacuugaaaacauggaggaagaagguuuuauuuuuauuuucuuauauaaaaaagagaaaaaagcaaaaaugaaaagagggaaaggaaacauguaugauauuuuugaagcccaaugaugucauucgaggucacuuugauaauuaggacugugaagcuguauuguaugugaguuaauuuguaacauuauauuuagauaagugaaaguuucuucuagugaggugugguggugauuuaaaauuuuuuuuaguuaucucuguguauguguuguuauuguuuuguuuuuaucuguuauacuuucaguccuaccuaaagaaaaaugguuaaauucuauuugaaagccucuugugaagcaggaauuuuaggauucuuagagaacuaucaaccacaauauuuacuuguuaauuuuugcaaauguaauguuguucuuuuuauuuuagguucauuuaaaacucuugaaaugaaggcaucaaaaccuggcugguggcuccuaaacacagagguuggagaaaaccagagagcagggaugcaaacgccauuucuuaucauggacagagguaucacaagagccaugugauauuugguuuggcaggagagugccuauuacuagaauauuaccaacuuuuagauuggaaauauucaacucuaagaacucugaugugacaaaggcauaauuuguagccauaauugcuuuuauuccggcccauggucugauugcauugaaaacacaucagucagaucaaaagcauuccugucaauugggaaaccuguguaaagcauccuucuucaugacuugugauccauggacaagugcauauaagaaauuuuccagcuuccaagaguugaggagggaaaaggucacaggaauuuaacaaugacugagucacuaaacuugacauuucagcauuuaggaaacacaguuuucaucuguccaucuguucauccauucuuuaagccauuacuaagcacuguugaguaugaagcacugugccaacauccagguagcacaguggcugguaucccuuccuugaucaagauauaaauaaccuuguaacuuugaggucaacuuuugagaacauagucucaucaggacuagaacuuuuuuucauauuuuuauauuuuguauuuuuauuuuuuuuguagagaagagguugcccaagaucaaacuccuggccucaaguaauccuccccccucggccucccagagugcuaggauuacaggcaugagccacugcaccuggccauggaugguaccuaauguuguaaaauagcauaauuuaagauaaaagcagaagaaaaucaguuuaaaaaaugauuacauuucaggauuucaguugcuuucuucuaggaugccacuauaucuauuaaagcaccagucuuguuagugcauuuaccauuuuauaaucagauauauuuaagucagggccacacaagguagguaaaaauaucuaauuauugagucagaaacauaaucccuaaccauggaguuuuacuuuauuguauauauuuucuaagcaaaaauuauucauuuuuuuucuguuuuucauagacuguaggaugccaaugggacuaagcacugguaucauaucugauucacagaucaaggcuucagaguuucuggguaaguuguagcaccauggucugugaaugguacccccuacaguugugcagcaugcagccuaugaaaccauacaugacaauccuaucuaugaaucaguuuuucucuuuaugcuuuucucuacuacaauguagugaagcagcuccauuugggguacauauaugguaaaggaaggaacacuaugguaggagcuaaaggccuguuagugugcucuuaacacugccaccucuucugguguauaaugaucccaaagagucuuuuccaggaaaaaccgauagcugggggucauugauuucucuacauaaaaagcccagccucucugcagggauuuggcaaggaucagauaccuuacucuuaugaccacgcgcccauuuccaaaacucuccucagucaucuuuucuggguuugaccacacauguaguauuucagccagauucacagggucuuaucagccaggcauuauaguccccauuaauauggcccuuugccuguggcaaccauucaucuauucagaaaacuuuguugaaccuccacuauaugugaggaacuccuccaaaguuuucccacacugccucaaagcccuucccaagaucaagaggucaugaucaagaggaugaugaggcucccauauacccuuccaugucuuccuguuaggcaggcacauucagcauuaggaauauaaacacaacagaaaaaaucaaacaugaccugugugcaagaaaggggauaggaggugguuggcaguugaccaaacacagaccugaagcccagauuucaucaucaaggacuggccuaguagcugaggcccaugccuagacuccugacuacaacacagguccuccaaggaucugguuuuccacuggauuaaacucacuugagaaauugcuggguuuuuaaaaaauucagaauaaaucuuuuucuucccuugaguuuagguuacugggagcccagauuagcaagauuaaacaaugguggaucuuauaaugcuuggaguguagaaaaacuugcagcagaauuugccucuaaaccuuggauccagguuugucuuaauagacugauaauauuuacugcuaucguaauaauaaaaaugaaagugauuuaguaauuccuuguuauuguucuugcaauguuguuaggggaaauagcaaguacuaagugugaggcacuguucuaaguacuuuauauccuuaaaaucaacccucugagguugguucuaauaauaucuuguuuuauagauuaaaaaacaaaaggcacagagauacuaccuaccuucccaaaguaacacacagcuaauuagucauugaguugggauucaaauuuagguacucugugcccaaauaugaauugcauguagucauuguaucaguuugcuaagaucuuaugugcuagcucuuuaguucugaagaaagcugauuguauaaugaauuuaggcagugugugacuuguugacaaggacaguucuguuuacuggcuuuccuauauugcagguggacaugcaaaaggaagucauaaucacagggauccagacccaaggugccaaacacuaccugaaguccugcuauaccacagaguucuauguagcuuacaguuccaaccagaucaacuggcagaucuucaaagggaacagcacaaggaaugugaugguuugugugcauauuucuaucugaaucucuagacucuagacuuggccuagaauuauuaugacuauaccuaaugauuauguauuuuaaaaaauaccuuucuggguauuagaaaugugaauggcuuucuaagggucauauggagaaaagcaguaauaugauaggucugugucuuacaaauuaaagagagaagcaggguuacugaaacuucaaaaccccacaaaacuuuaaaaaaucauuuuaucaucaaacaaaauacccagauuucucagacuggccaaugguauacggcagaguagaacaucuggucuugcgccucaaggagcucaugcuaaaaauuggcuaccaagacuuuugauuuuacuauuguaguuuguuuuguucuuuauuucaguguaccugaaguaaauaguaguguuaaugcuaguaagccucugaggcagugugauucucagacuuuuuggggggccaugccugaggaaugacauucuccuucugguucuuccaggggcucagccauaagcccuaacucuucuccuccucucuauucccuuccccaaagaagucugaaugcaaggagucugccugccauuauuauaccaauaaccuugagucuguuucugcuuauauuuuauauaaaauuauuuacuguuuauuaguuaccuauuuuuaauaauuauuuauacuaugucucagaaccauugaaauccuaaauuaugguucuuacuaaucaguauuaugagagaaaacacagauugcaguugaguccauagcauaaagauuuugucgucuauguucaugagaggauauugguauauaguuuuauuuuuuuaauugucuuuuucuguuuuugauaccacaguuauacuagcuuucauaaaacugguaagcaugcucuuuucuacauucuaggagaaaaugucugcaauugguaauaauucuuuaaauauuugguaggaaucacuagugaaaccaucugggccugcagauuucuuuuugggcaguuuuuaaauuacagauccuauguucuaaauaguuacagggcuauuaaaauuaucuaugucauauugggugaauugaaauacuuuguauauuucaauuaacuggucaauucccucuacguuguuaaguuuauauguguagaguuguuuguauauucccuuauccuuuuucauguuuguagugauuuugccuguuucaucucugauauugucaucugccccuccuuucuuuuuugugugaaucuugcuagagauuugucgauuuuaaaaaaaucuucuuggccgggcgcaguggcucacgucuguaaucccagcacuuugggaggccgaggugggcagaucacgaggucaagagaucaagaccauccugaccaacauggugaaacccccucucuacuaaaaauauuaaaaaaaauuaggcaggguggcgugcacuuguaaucccagcuacuugggaggcugaggcaggaguaucgcuugaauccggaaggcagagguugcagugagccgagaucacgccacugcacuccagccuggugacggagugagacuccgucucaaaaaaaaaaaaaaaaaaaaaaaaucuuuucacagaaccagccuuguuuuauugauuuuucucuauuguuuuucuguuuucaguauuaccgauaccugcuccaaucuucuguuuuaaaaaguuggcuuuuucugacauugcucugucaggaaaagggguagggcacagccuguuuacugccaagugggggucaaaguccagguuccccacuccauugccaccuaagaagggauuguuccuugguggcugggugggaagggaaguuccccauuuggccuccacugauacugcaggggcaggagcuucauuaggggcuggagaugaaagcccuaaaucccuacauggccuuuucugacacaaccccagugaggguguagggugccucuuuagccucaggagcauagaagucuaggcuccccauucagccuuugcuguuguggguuggggaggggccucagguuuuucugugguguuugacuaaaggacagaagucaguguccaccaguuuucuaucauaucucgcuaugcugcccuuuacugguacuuugguuagagaaagcagauuuuauuugggcuuuuucagucuguacucauugguguuuccagguugccggcuucuucaucucuaagucugggauuuaugaggcaaaaagaaaauucaagacacugaucaccauuuuguuccuuccgagaacccuagccagucugucuucugagcucuuuucagggucuuauguuucucugagcuauaauguccaaaguuuuuaguuguacuuagcaggaggaauagggcaaaguacauauauacaaucuuccuggaacuggaauuauccccaaguauauuuuauaaccaaauugauuuaguuuggaccccaugaaaauguaguauuacaauauuaaauuagaucaaaauuuuaauauaaagucacuuuauagaucauuguuacauaacuaaacuuuccucuuuucuucuaguauuuuaauggcaauucagaugccucuacaauaaaagagaaucaguuugacccaccuauuguggcuagauauauuaggaucucuccaacucgagccuauaacagaccuacccuucgauuggaacugcaagguugugagguaaaugguaagguacaaagaugcauuauuuucucacugccacucaaagaaucaagauuugggagguauaggagaaugaguagaauuuuuaguucuuuucagugacuuaggcuccuaggaaaaccuuugugaaacagagguucuacucagguaaacucucagugugaucuagaccaagaaugguucugccaaucagagugccgacagcaucucugugaagaaagugccuggauuauauagacacaucacaacucuccaaggaagggcucuaauuuggaauuaccuccaucagcccauuuucaauaagaccuaccugagauucaaacuaggccugacucuuccaaaguccucaggucacucaaacuucaaugucaugacaguaucuggcaacaucacugccauauauaugguguucaaugaguguuuuugaaaucugaauuggcuucccaacuuccugaaaccacaauucuucuuuauauuuucuuucauacccuguguagguacucaagucuuuucuauguuagcugcuauuucucaggggcuguaaugugaccugugguauaaauaaauccagguaaucauaaauggucauaauaaaauucuacuauauauagcaaggauguuuaagagucuuaacuguucuucuuggacucuuaaagcagugcuuuccaauauuuuuuacuucaaagcacacaaagaaaauaauaucugccuggcauucugagguaaaagaaugaagcaauaaaucuaaggcuuggcugauccaggccccacuuggcugcugaagggcuggaggugggaagagggaucaauaaauaggugcacuagaaaccugccguggcacaccugucaggaguugcaguacuucccuuuggguggagagaagccaccaugauucacaauggagaaaguagcugaaaccuggaaucaguuuccuguugaagcagauaauggcacaguauacccuuggauggauauggguauuuugccaauguccagauagcaguagucuaaaacaucucccaaauaaaacacagaucuuguaucggcaggaccacuccuugaaacaguuccauaagucauugcguuuuuuucuuuccauaugguauaaauagauuuguucagauccuaauaaacuacccuaaaaugugacauucaauucugcuaacuuauuuaaaacaucuauuuuuuauacaagaagcauuauuuucuucuuauucauuuucuugauacuuagguaauuauuagcaguggguauuauuuuuaggacccuuuguuuuuuucauggagaaaguaaggcaucacuucaagaaaauuucugcaugauuuaccaacaagaacaaagugucacagagaugauggguggucagccagguucacucacuagcuguguuucuuacagucacaggucugccuugcugccuaugauauucaaauuacaccuuggaaaaauuccaaaggguacauaacucgaauuacccucuaaggguugaaacagaaaauauuaaauagugacugaggguccauuguaucuucuugguagcuuuuguuagaagaaacagaguauuuuuauauauagauaauuuaggauuauugucaccugaaagcaaagaccaaaguuuccaagacucucagaaggaggaagugaguuuaaauguuuagaacaugguauuugguaucagauugucugaacucaauucaguuucugauucuuguggcuguguuaccuuagacaaguuacuguguuuuggcuguacuaaaauggagauauuuaugagcauuauauaauacauguaaagccugagaacaguauuuggcacuuggauucaauaaaucuucauuguugugguuauuguuuuugucauuuguugguaguaauauuauuucuuaucuccucugcagugcaugaagccaugcagggaauauugguguguaauuaaucacguuacuuuucuuuugauaggauguuccacaccccuggguauggaaaauggaaagauagaaaacaagcaaaucacagcuucuucguuuaagaaaucuugguggggagauuacugggaacccuuccgugcccgucugaaugcccagggacgugugaaugccuggcaagccaaggucaaguauacucuaugcaugguguucucuuagggcuccagaagaaagcaaaggcccucacuaccacaaacauggaggaucugggaagcaggaguauuuuaaucuguuucugcagauuaaaauccuagguccaagaguccaggaugucuguggacuugauagcuuugacuauaacuuugucucagagagaagucauuuaucaucucugugguuuuuggucuagucuugauuuaaaccaauaauaagcaaauuaauuuuucugcaaagggauagaugguaaauauuuuagucuuugugggccauacauucucugccauaacuacucaacucugccauuguagcaguaaaguagccauaaacaauauguaaaugaaugagcuggcuguguucuaauaaaacuuuguuuacaaaaaacaggcagcgggccaaauuuggcccauggaucauaguuugccaacuccucauuuagacagcuuacauuagugauaaaaaaaugauuuagauuugcaacaucaucucuuauuuuuucuuuacaauuuagcaauauuuuuucauuuuccuaaaugaaaugucaucuaaacuuuuuuguucucuuccccgcccuccuuauuuuaagagcuuugugauauuccuugaggcaacuagaagcauaguaaaauguugcaaaaccagaguuauaaaaucagugaucuaaguuaaacaaacaccuuccagagaguuauacugucccugauauuagcccacugaguaauucaggugauuuaauuuggggguaacucuuaauauuugacucauuuuuauuaauucuuuaaaugaccugagauaucagaauggcaugaauaacuugaugaucccuucagccaacuaaauccaaauucccuaauuucuauccucauaucucccucccuuaagauaccuacacuccaauuuccuggcuuucuauagaauuccagggccuauccuuaaauuaggccacuagaaaggaaaaaagaauuguggugcugguggcguaaauagaaaagauuggauuccacacagucuugggaacugauaucugugucuugaaacucauucuggcccaauauggaaucacagaauguuacaguagcaaggagcaaagcaucuggucuagauuuuuccuuuuaauucuaaauacacaggagauuaaauaauuuuagcuuaguuugguagcagaaucaggacuagaaucccauucucccaguaaacaggccaugcuccuuccaccauuugaagcagcccaaauaccucauuuugcaauuuugcagagggcaaagcugacacccagagaaguuaaaauaauaaaaauaguguuauauuacauuuauauaauuuacauagcaauauaaauaauaauuaaagagauguuauccaauucuuuuucagaugacucuuuagacuuguucaugguauaaccuugucacuccauacuucauuuuacaaucuuuuaaaaaaauuugcacucucuauaauuugcucuuagucuuugugauauaacaagggccucaaagauaaaaugcuaauuuuuaauggugucauuucaaaguuagaauucgggaucagaaauauguguuuuacuuaacccccuuccauucacaugaaaugucuuuauauggucucuuuagagagguugaaaaucaaagcuggacauaugcagugaugcacauagaugcuguucucuccauaacuaaaaugucucuaccucuuuuaugccugugaaaaccucuagcugguuauacucugcaucacugguacaaccuugauaugaagacacacuaagauaccacccagaugucacuagaggauguuauagacuuaaaaguuuucucauauaaucauucuaauucaguuaauuugcuuuuaaaauacauauagcaugugaauuuuuguguauacacauauauacacauacaccuauauauacacauacacuuauguaugugugggugauguugaagaaacauaucaauauuauuuccuuuagaauugaaugagguuaugguagacgauaaaucucccaaagguaaaaauuuaucuuagaugacucuaaaacucaguuuagaccuucugaucuuucuccaaacacauaucaccaaccaugugauuaggcauuuuguuaggccagagacaggacaauaacuguacuguguaucaagcucuacuuaugguuuuaucaggucucucaaauguuacauuuauuugaaauauuagaagaaauugaacuauuucugcucuuugacauuaacagggggaaagagaaguuguguuuuguaaaacaggugaaauagagagagaaugcuauccaauuauuucccagauaacccugcagcaauauuaccagaguauuuaaagaaauuugcuuaagaaaauaauauucacagauaauuuagcaguuuaauuauuuuuccaaauaaagcucauuuauucauucauuuauucaacaacuauuuauugaacaccaacugagugucuuaacauuguggugaguaccaggaaacaaaaugaaauaagccucuacccuuaagcaguaaggaaugcuaagaaggaaacaauuauaguacaaugugugaaauacuucaauaaaaauuuacacacauauuguggcaaugaagaagaaagagggaaagcuucuaggagacugugaauccuaagggauaagauagaacaaaauccuuuugagcucugugcuuuuuugcauaacuuggucuaaaaaaaaagcaaagguuuuaacaucuuccuuaucuauguguuuuugucauuuucauaggcaaacaacaauaagcaguggcuagaaauugaucuacucaagaucaagaagauaacggcaauuauaacacagggcugcaagucucuguccucugaaauguauguaaagagcuauaccauccacuacagugagcagggaguggaauggaaaccauacaggcugaaauccuccaugguggacaagguagaguggcaucugggcaaagagaaagcaaucugaagacugugcuauaaugagaauaacaguauuuugcauuugacaaauaugcagugacauguaccaccucuuuaagucuucuaaaucuuaguucuuaaggugccuggucucagacaaacuccugguugucuguuuugguuuguuuuauuucucacuacaccagguugcccucauaggaggauaaauaucauugucauaaaaaaaaagagugauuuuauuucugguguguguaaaccuuggggaacuugcugaugauggaagggggaaaguuauacacuuuaguugaggauauaagguacaugccaacaagaauaaauaaauuaaaaugcauggucacauuuuaaauguuagcaauagucaaacauuuauugguggccacuuccuggcacuuacuaugcacuuacguugacauacauuuuuaaauauuuacaaugacuucugugagguaaaauguuauuauccuuauuuugccaaugaggaaaugaagaaucagagaauaaguaacuuguucagucauacagcuaauacagacgggcugaaggcagaaaugguuuugcagcugcuccacagcaccaugugagacuuguuuauuuuucacuaauuuaagucagaucacuggugagaugaaaucuaucuggcaugugauuucauaacugauagaggaucaucucugugagaguguucuauguguucuuugauaugcucauuuugagcuaauaggauaaaaaauuuucuggguugggcaugauggcucaugucugcaaugccagcacuuuggaaggcugaggcaagaggauuacuugagaggaguuuaaggcugcagugagccaugacugugccacuggacucaagccugggcaacagaauaagacccugucuaaaaaaaaacaaaaacaaaaaaccuuagccauuuauguugucauuaaagauuuucucuuauuuggcuuucagauuuuugaaggaaauacuaauaccaaaggacaugugaagaacuuuuucaaccccccaaucauuuccagguuuauccgugucauuccuaaaacauggaaucaaaguauugcacuucgccuggaacucuuuggcugugauauuuacuagaauugaacauucaaaaaccccuggaagagacucuuuaagaccucaaaccauuuagaaugggcaauguauuuuacgcuguguuaaauguuaacaguuuuccacuauuucucuuucuuuucuauuagugaauaaaauuuuauacaagaagcuuuuauaauguaacuccuugcuaccaguaaguaagauaauggcuauuacuucugcauuaauuugaauacagguaggaaaauaucaagaaccaacaagaaaagggcuuaucuuucuuaaugauugaaaaugcuaugaaguaauauuuauguaguuaaaaugcuucauuauaacucuuuuaaauccuuuacacacuaguaaaacagauauuacuuuaaauaauaauugauagaccuggauaacuuucacaaacacaugauuuuuuaaugguuuuucuugagugaagagaaaaacaauauuaucaaaugaaauaaguacuuaaaauauccugucuu

SEQ ID NO: 12932 - RNA, 22040 nt, Homo sapiens
ugauuaaaaagagaaaauauacuguaaaauauuuauuuaauaaaaauaauuuuauaaucuauacagaauugaauaaaaaguacaacaaauuauuuucacuuauuuacaaaacugcauacaguacaacuugcacauugaguucagcauucuauaaauauggccacauaccaagaugugaacauauucuugucuuauauaagaaaaggcucagguuguaugccacaaacuuugaauuaaauuccagggaaauauugcuuugguaacaugaacaauuuguaccacauuccauuaaaaaaagauuuaauaaaaucccucaaacagcacuuuucuacuuguuucggaguacacaauucccaaauuagcacaaacaaaacaaagcaaaaaaagaaaaacagacagaauguaaaaugaagguugcuacuuuuaugauaucacuucccuuucccuuccuuagcuaguguucuuuuccuuucccuuaauaguaaaggauggugaauagaaaaugaccuauucuuauccccauccauuugcuucuaggauuccugcuuaaaccaaaugaguaugucgacuuugcaaucuugacacacuauuauuaacacuguucagcugugucauucuaaaaaaguuaauaccccaguuaaaagcaccuaucuagauucuuuucaagauaaggcaacaaagucagcuuuaaaauaguuuucaugucugacauauacuagcagccccuugguagacugauuucagaauuaaaugcauauagaacauuuuuucaaguaacuugguaaugaaaucacuagcaauuuuaagcaaauauucaagaugaucuaccuuuagaaacaaaggcagauuuaagguaaaaaaaugcaggaaucacaucuauccuaguuccugucccauugaaauaauugaaaagaggcucaguuuaugaaaaaggccuuggacuaaugcaauuccuauugacaucuuuacuuggauaagaaaaacaaauuaauauaaaaacuauaaauagggaugaaauuauuaaaaaaagauuuuucauuuuauuuuggaaauaaaagggaauacaaauacaaauggccuaguuacaucuuuagccuauauaugaacuuuuaaucuuggaauuaauaguccuucauauugaagauuuaaagacaagcaagcguaccuuaagcuuucuuaagucucuucauuuagcaggcuucaaaacuugccuuauuuucuaacuaaaugagcuucucugggaagcauaugaauaaugcaaaaacguacuucuaaacaaauuuuacagaaauaaauaaucgucacaaugggaaccaagaacauucauaugaugaauuuuuuuaaaauaacuuaaaauuagaaaugauacguacaccuuaaaauacagaacacuaaaccagaacaaauauugccagugauagaauaacuauguagaaagaccaauguacaugaguaacacagaaauaagaauuaaauugaauagaggcagaugcuguuagaacauauuuccauccaucaugacuugcaacauuuuguggccucuguggagcccuggucccaccaggccaagcaucuggcuaaguagauacagacauaugugaccuauaaaacaccaaacucacuugcuaaugaaguauacaacaccaugugcugcuuugauugcucuugacugguuuuuaaaaucaaguucacuuuugaaucagaaaaaaagucauccuuaaauuagcucucauaaauaauccaugaaauaaacuuuacuucuggcuccucugaauaguaucauguuauucccggaacacaagguauuagucaaguggcugcugugaagucaagaaaugcacauucauaaauauaugucuacgcuuuaaaaaaucaaacacauccaggcaguugcugugcagaguucuugcuauaagaagaagcccuucagcaguauauuaugaagugguuacuugagaacuugauuguggaucuuccagcuuucuacauuucuucauaacacugacugcaccacuggccaggaaaaccacagcgaugagugcaaaauaacuggcauagaucaaaaacuagaagggggaaaagcaguuuauugaauuaucaaugacaagaggauuacucuauaauaaaguauauucagaauuuguccauaaagccucaaaaaauauugcauacuuacaccacgugccagacccugaagacacaaagcagcaucacagcacggugguacuaaauaaagccugacugccugagugugaauccugacuucaucccuuacaagcugcgugaacuugauugagauacuucaucucugagcccuucuucacuuacaaaauggaauucauaguaguucucacuuuacagcgauguugguacccaucagugagaucauaaaugcuuauuagcacaaugcuaaugcuguuaguauuacuuuuauuguuguugcuguuauuguuauaauucaguccuggucucugccuucaagcugauagguggguacaaauaggccaaauucugaagaucaagaacuucucuauuuuuccccagaagagggcagcggcaggucaacuauauuccauuacaggauuacuuaauguaagaauucuucccuaagacaauuuuuuuuuuuuaaguucugggguacaugugcagaaugugcagauuuguuauauagguauacgugugccauggugguuugcugcaccuaucaacccaucaucuagguuuuaagcccugcauacauuagguauuuguccuaaugcucucccuucccuugccucccaccccccaacaggccccaauguguguuguuccccucccuguguccauguguucucauuguccaacaccgacuuaugagugagaacaugcaguguuugguuuucuguuccuguguuaguuugcggcggaugaugcccuaagcgaaauuuuaaugugacuauaugguuuauuaacaucaucaucaucaucaucuucuuaaaauaacauacuaaauacuuacaaacugguucaaaaguacaaugagaguauggccuuaaaucacugagccaguuucuuucaauguuggcuacacuucugcaggaagccauuaaucaaucauggcaguuaggguuucagcaccacccauaaaauccuauuauuccacguguuuaaauccaccauuucuauaagaaucugcugacaaauuuccacuuccaaugacagccauguuucccucaacuguaauaguccugggaacucucccuuauacagggaggauggcaagcacuuaaguuucucuccuacuuuccauccugaaauaaguuuugggguuagauguugguuuaacucuaagcucuggaacacuacuagugaugguauggacaagucacuuaacaucucucagacucaucuucuucaugucuaauacagcaacccuacaaauccuauauaaagcacuugacacguagaggcacucaaugcacauugucuauuauuacuauuucucucuuagaucgcuucaguaaaaacaaaguuaauuacggcuaauauguugggaagaaaucauuuggguugggaugggggugggaguaaauacuucuugauucauucaguugcccauuuuaccaaaguacaaaacaagauauacuuaaaacucacaaugcaugaaggcauauacaacuauacaauuccugaacguaaaaaguauucacauuguuguuggguguuggugcaaguuucucaauagucauaaguuacaaaucauaauguuguucaucagcagcaaggcauuaccgugguauuugggugagggguguuuuaaauaaagaagggaggagacuuaaagaguugugagaugaagcagggaaucucaaacaugggauacaguauuccaagcauagauuuaaguauagagggaaauaauggaugaggaagcagaaggucuuggucuguaaggaaucaauauuaccucucagcugaaacagccccauugggcugaugaguuacacucgggaauguucuaagaccugacaaucccaacacccucccaggagaaaagaacuaaggauaggggagaagauguugaaugaaggaaggaggguaugcuuuuacuuuacaucuguucccuauuguuuggauuuguuuucauuaagcauacauauacuucugucacccugaucaagucacacauacuaccuucgaugccaaaggagagaucuuaccugagugguaauuucuaauccaaggccacuggcaucuaccacaauuagagugagcagcgucugcagugccagggcaaugaagguauuuacaccaaauacuagggcauagcguuccaugcugagguuugcagcaauuugaaaacuuaaaaaaaaauaaaagagugaauaaauaagaauuacuucuggaguacuuauaauauuuauucuaaauaaaaguaaacauuuaucuuuaaacaugaagaguccuucuuucuacugucaauugccuuuccaaccaaaugaaaacauucugcaacuaaaugauauaaaucucaugcaaacaucugaaaacaguaggaacauacaaacaugggaauaaacaaaacuugccuaaaugcuuccucaggagaaaaacugauaaugcacauauaauacaaugcuuccucccauuugccucauuuaacuagaaacuugaauauuuugguuuguaaagaaaccaaaaaauuuauccuguuacaauuuuuccuaaggcuucuaugagccaaaauacauacguugcuaucgugaugaguaacauguagaugauucugaagacaacauaggaugcauagcacacccaaauguuacccacaguguccaugauauacacugcagcagcaaucaggagagaaaagagagauaaugucauuucuccccaaguugaccaggauauuuuuauauaaccaacugcaaacacagcaacagcaccuacagaacaaacaaaaaaaauccaauuauuuugcuacacaaaugcuguugcaauaaauuaaaaacucagcuuagauuauuaaauuuuaaaaucugcaaacuuauaaacagaauagcucaagauuauggagggccuugaaacucacacagaaauuucugaacuugauggaaucaauaaaauggagccacugagaugacagacugaauuaggagagguggcaaugagaugaaaaugcaggacaaagacacagggacauugcuaaggaaaaaaaaugcugcagcugaagcagaggcaagagucaaaaagaaccauagcuucuaauuuggcaucauggcaggaugagucaucucuccuucaaaccaaggagcagucuagaacauggcaaaagggcuucucugccuuuugguaaaacagugaugaugauaaggauagcuaaaaucuaugaaguguuuucugagggccaagacagauaauaaguguuuacagaaaucauauaacaccauccaacaaccucaggagguaggucaacaaauuagaaaugaacaauagaguaagauggucaaauacacaggcucugaagccauccugccugaguucaagucuugacuuuacuacuuaccauccauaugaccuugagcaaguuauuaaccuaccagucccaaguuuccauugcaaaauggggauaaauucuaccuaucucaggaauuuugugaggauugaguuaauguauauaauguccauagaacaguaccuagcacauauuaacauucaacaaauauuagauacuauuguuauaaacuauuauauauugccauucaaaauuucacaucaagugacaaaacuacccaguaaauacagagauaauggaaacuuggauaaacaaucuugaaaauuauuauauuagguuuacucaaagcuuauaaaaaaauuccaguuuguuagucauaguccugcuccacuugaguacuucuaaguuguccuccuaaauuguaaaaucuagcucaaaauaaucauuuuuugaggcuauuucaaauuugggaggggugaauaaaucugauuauggcuggcuuaacuaccagaggaaucccucccccaccacgacccucuauuauccugcauugcuuacccaguaagguugaaacggccuccacgccaccauuauagauagcagcauagcgagaaggcaucacuuucucccacaggcccuguguguaguucacaacuugaaaauagccacagguagagagggcccaccacacagaccagcagagaagagggcgagaggaguagcacaucaggaaaucauuccauaguacuuucaauacaaggagacggucuggcuuggguuccuacauagcaaaagggaacaaugcucaaacucugaugaaggcaauuauauagaaagcaauuuacaggcccaauuacuuaccuaacagacuuuuuuccuugugaaaacuaacugcuuacuucauaaacuuauuaacaaauacauuuauccccucuggcgaaaaauauguucucauaggauuuuugcuuuaaaugcacuauagcauuaacacagcuguauguaaucaacccagcaaaagauguacuguuuacaaaaugaagaugaugaaaagagaccgcaggcuucagccaaugggagucuguaaucuacaucucccauaaacuggcaaacaacauaacaagaauaauaauaagcaacagacuagcaacccuaauaaaucacuauucaguuaaggccuccuaucguuauaauugacagacugauccaacaguuaagauagaaauauuggaaagaaguagaccaaaauauuagcaguucucucuaggugguggguucuuagugauuuaaauuuucuuccuuaaacuuuuuauauuacuuaauauuuaaacaaugagaaauaguauuauaauaaaguaauaaauaaagcuacugggcuuauaauugagugaagcaagacauuacugagcuacgcacuaucccaagaagucaauaugagaugucagacacucugugagauaucucugauuucaacuguaugaaaggacuaaucuaccaaagguuacuguaaucccugggccuugcucagaacaugggaaggccggguguagugacucaugucuauaaucucagcacuuugggaggccaagacagaaggauugcuugagcccaggaguucaagaccagccugggcaagaaagugagauccuaucucuaccaaaaaaaaaaaaaacccacagaaaauuuuacuuuuguggcuaacauggaaaggcaaaaugagagccauggaaagaugaguacaauauaccacugaguaaaauaacagcaaguuacaagacuacauguagaucacaauuucauuuacuauaaaauguauacguacauauguauauaggaaaagagauguuugaaaagaaguucacuaaucuuugggugguaguaguucaggugauuuuuuauuuuuuauauagcuuucuguaacauuuaauuuaaaaaaauaaguagaugccaggcacaguggcucacaccuggaaucaucacacuucaggaggccguggcaggagaaaugcuugaacccagaaguucaagaucaagcugggcaacauaguaagaucccgucuccacacacacacacacacacacacacacacacacacacacacacacaauuuaauuagcuggguguggugguguacacauguagucccugcuacucaggagacugaggugggaggaucacuugaaccuagaagaucaaggcugcagugauccgugaucacgccacugcacuccagccugggcgacagagacagacucugucucaaaaaacaaacguguguguguguguguguguguguauauauacacacacaccauauauaucauuuuuauaaaauuaauagauauuuucuccucuuauauacaguaacagugaccaucaacauuaguuaaauaaaggccauuuucucccucagaggcuagaaaaccucacuggacugagaauccgaguuucaucguuguuuuaccuucucauaccaucccaaagcaaccccaguguggugcuuccuucuuugugcuguuuagcccagagggggauauccuucaaguaccauuacuacagccccuuuccaaaauucagggaggaguacugagguuaaucaaaauaacucagagaaagaaguaccgacacuugaaaauucuacuugaugaauuugcauaagauaaccaccuagaaguacaacauacugcuguuacaagauugauuucuuggcacuguguaugagagcaaaccuugugaauuuaaacaaaucacaagacaauuguuaaucauauauaaugugaauuugcuaagagugagugaaugguaccaagcacauuuucauaagucuuuauucaagguccaccaguuuuauugaacuacaucagaauuuuacuauuuagcuucaguugcuuaaccaauauaacuuggaaaacaacugggauaucuaaaacuuucaaggaugcuggaaggauuauaagaaaagaaaguauauuccuggaagaauggaacuauuaaaaggauucacaaguuucuauuagaaauccuaccauaaacugauaagaaagccuuacuuuucucaucuagaaaaugaaaaugauaacaauaaaaccuauccacaaaagauuauacagaguuacacuagauaauguauauauuuauuauagaggggcucaauuaguguuauuuuuauugcauagcuuaaaaagucauggcauacauaaaauaaugcccaguauaaugcauuugagaacuuuagaucuauuacauaauaaugaauuccacacacagagguuaauaacuacucaaucuauuaucuggccaugccaaaaagaaaagauggcagguccuguuuauaaaaucagcaccucgugcuauaaucugcaggcuuccuucuaugcuguuuucuaggcuucaaauguuaagcuuauaugaaucacacuuuauaaaguagcauuugacauauuaccuuuuauguuucuuguuaaauuacaucuacaaacaaagguuuauuucuauuacaucaaaacucugagcugcucauaguuaaucaugcaugcucuaauuuaauaaguggccuucacuguguuccauggagcuuuaagaguuucaugugggaugaauaacaggcucaaguauguaaaauuaucagaccugcauuccuguuucaaucagaaaggcucaauuuuuauuuacuuaucauaacgggcaucuaguuucagauuucauuugaacauaagauuuugacgcuguuuuauaaauuuaaaaaucuuuaacaauuacuucccucuaucagggaauggaaguuucuacuguaguggugguuuuugagucaacuagauauggguggaaauuuuauuuauuuauuuauuuuuuugagacagagucucuguugcccaggcuagaguacaguggcacuaucucagcccacugcaaccucugccucccggguuaaagcaacucuccugccucagccucccaaguagcugggauuacaggcaugcaccaccacgcccagcuaguuuuuguauuuuuuuuuuuuuuuuagcagacaucguguuucacuauguuggcaaggcucgucucgaacuccugaccucaagugaucugccugccuugcccacccaaagugcugggauuacaggugugagucaccaugcccagccugaguuggaaaguuuuaaagugccacuuccuaugugccuuugcgcaagucaguuaacuaaauuuaguuuccucuucuguaaaaugagcaaauaucuacauuauugaguuuuaauaagaaucaaauaacauacugacucuaaaguucuuagcacaguaucugauacccaggucaaaauaaacaggaggugugaugaugaugaugaugaagaugaccaggggugauuaauucaaagagaaaaggaaagauugcucuauuuacaaccucacaaauacaugacuaucuaccauaaaaguacagagcuguuccggauuauucacguguaaugauaaugauaauaguaauaauagcaauuaccauuuauuggaaaccuacuauguaaacucauuugaaagcuuuaaauacucaaaauaacuguauaagguagauauguacauaaggaaacuaaaucucacagaauuaaguaacuugcccaaguauuagaacuaggguuuggacuucacuuucuuaaaaacucacaaugaaugaagcgaauagauuuucguucauuuugguucucaggguuuauuguaguuuuuuauuuuuauggguuuuggugagggagguaggugguaacucacuacacccugcugcuagaaaugacauuauuuaauaccaaaguggaagcauuaauuucacuguugucauuguuuagagaccuuagacaugcagacacagaaagaacacuuacuaguaguaaaagauaucaaacuacaaauaaaagcauggcuauauuaagagaaucauuuacuagguauuaauuacaugucagaaccugugcuaaagaagugguuuaauuuaugucauuucuaauagaugaagaacucaaaauaaaucaguuucaccaaucagccaacuacauaaugaauccagcucugcuuguaaaagaaagucaccagcuuugguucuucuuucugcaagaucagcacccuuugccccaaugcaauagacucucuuuaaaaauaacucacaaauacucuaagguaacuuguagaaugagcuaucacuuagacuccucuuacuucauuuucucuuucuauaaaaaucaagauaaaaccaccuaccuaccuacucuucaauaauuaccacaauuauaauuuaugguuuaauuauaggucuugucaacuuaaaauagcucugugaucccuaauauccauauucugaauuuucuucaugcuugccaaagaaaaacagcagcauuuuagggccagucagugccaauaccaagcagcacugcccaucugcuaugguaucaguagcagagccuaggauaucagggaacugacuugaauccuaauucugaaaacaguguaacugacaugaugguucugacauuguuaccccaguuaaaagacuucaccgagaaagguuuagaaagaacuggaucucauacacacuuuuaaauuauguucaagaguauauuuguacaauucugcauaaguugcuaaucucugauccuaauccuuaucucuaaaaggacagucuugaugaaaucuaaucucuuuuuaaaaugcucugcuuuuucuaugacuugugauuagagucauuucuaacucuaaaauucuacaauucuucaguauauaaaauacugacacacuguguaucuauaaacaaguauuucaaguugaucuagaacaguuuuuaaaacuauaggucaucacccauaaguuggcaauaaaauugauuuagaggacagugaacugaauuuaaaaaaaauaaaagaauguaucagaauaaaacacuguuguaaaacuuguuucuguuauauauaaaauauauacauaccuauguauguacagguuuucuauguaaaauguuuucuauguuucuuacuuauauucaaaaaaguuugaaacugucuauaaaaaucuuuagaacuauggucaauauguuaauaucuaaaauauauauuuauacacauauuaucuguauauacguuaauuuuagcuaaagccacuguaacacauucaaaacagauaaagaagugucuuuauuuuuuuuccacuucauaaaaucuaugaaaugauuacacaccuccuucccucccccaucaacccucuguugacucucuaauaucaccuaacaaacuaugaaaaaaaucagcauuucauugccacuuaauccuuggucauucugacaaaaagugcucacaggugcccugguaaucaaggugaguuucaugaugaggguugcccaggcucuacaagucuacccaggcucucugggaugauaaccuaaauuucaaguaguaauuugagagcugaagaacggggauagagaaaagagaguaauuuucaaugaggacauuagaugccacauuuaaacaauucaguuaacucucaguagagaaugaaagacuuuacucauaaugguucuuuauuaucagccagccuacaaagcuuauggagcucaguccgacugaggccaccuacaaagcuggaauguuaauaggcuuauuuccaaacaugucccaggaaaacuaagacuacaguguggcuggaauuaacuuuguuccucacagcuuauaaccuaauagaaacaaaaaaaacacuugaauauuuaaaaaaaaaaaagggugggugucuagggaaaggaauucaucuuccuggcuagacagaacagauggauaaauuauuuuaaugccauaccucucucuuccaagagacagcuucauaacacacuuuuacuauuuauuccaucaccaccucaaacuguccucuugugaucucuucgucuguauuauucauuacuacuucacuucagcaaauugucauuugaaaaauaaauaacagauaucccuucuagcacagaagaggaaauuaacuucuuacccuuaaauacugugggcuucaugacugggugcgguggcucacgccuguaaucccagcacuuugggaggcugaggcugguggacugcuugaggucaggaguucgagaccagccuggcccacaugaugaaaccccgucucuacuaaaauacaaaaauuagcugggcgugguggcgagcgcccauaaucccagcuacuagggagaggcuggggcaggagaacugcuugaacucuggaggcggagguugcagugaaucgagaucgcaccacuguucuccagccucagcaauagagcaagacucugucucaaaaauaauaauaauaauaauaauaauuugggcuucaauucagaaacuagaaguagauacuuaaucauuuauuagaaucauuucaucuacucauuuagcaacaauuuucugagugcuuuauuuauaugccaaacacucaaaagaugaagacacagcccuugcaauccaaggcaucucugacaugaacaauauaaugcuguaucagucugacuuuggaggucacgcacuccaggaaaaaauaaaugugucaucccuaauauaaauaaaccauagcuugaaugaaugaaugaaugaaugaauaaagcaauaaaccaacucaggauaaaacaugaauccaaauaaauacaagaucuaccaagagggaguuugcuguuuuuuucaccacggguccagcccccauaguagcaauuacaagauauuuaaggcugagcuuaccgguuccuccacgggaggcuccuccauauuuagagggauuuuugacucaauguccucccagccaggaaggugguuagaagcuggggugucaguaacaaugccaccauuuuguaccuugaugccauucacucucuggcagguagaaggaauguggugaaagaagaggcucuucuguggcauagguaaaaaccaggccacagcaaaagccacugaaacacagguaagagagaugacauucaggcugaacagcgaccagccugccacugagacaaggauuugcccuaggacagagcccacuguaaagcccaccaaaguggcacuucgacaguaacuugugacuuucugguacaugcccagguccaccacacuguagauauaagaguaauaggcaauuucaguggcuguggcgaugccauaaaaaaauucuagaaauugaauggccagcagucccugggcauagagcagcauaaaccauguaacaauaaggcugagccccugcaguagaacaacagguuuauaacggagguagucuguggcaaggaacacaggaaacaguagcaccagguaagaguaaguccauacuggauaaauuucauugaagaccugguagaaagagaaaaaaaaaaaacaaaaaacauuagugaugaaaggaccuggaauacucauaaagaauuuauucauaaaaaacaaccuacaaauaccucaaagaucucaaccuugacaacagcaguucagauaacuuugaaaaugucuuuucucucuuuuuuguuugagauggagucuuguucugcgcccaggcuggagugcagugguacgaucuuggcucacugcaaccucugccucccagguucaagugauucuccugccucagccucccgaauagcugagauuacagggacccaccaucacgccuggcuaauuuuuguauuuuuaguagaggugggguuucaccauguuggccaggcuggucucaaacuccugaccucaaaugaggagccucccaaagcgcuaggauuacaagggugagccaccucgcccagccugaaauauccuuuccuauccccaauaccaucaucuuuuuccuaauaaauucuucccauuaaucaaggccuaguucaaagacuuccuuauucagaaagacuuugcggaagccaaaaguacuuguauuacaacauucaaacccuuuuuuuuuuuuugguuuuguuuuuuguuuuuuugagacagggucucccucugucaccuaggcuggaaugcaguggcagaaucaugguucacugcaaccuccgccucaggugaggcucaggugauccuuccaccucagccuccccaguagcugggacuacaggccuguacuaccacaaccagcuaauuuuuuuuuuuuuuuuuuuuuuuuuuuuugguagagauaggguuucaccacguuacccaggcuggucucaaacuccugggcucaaagcaauccaccagccucagccucccaaacugcugggauuacagacaugugagccaucuggccuagccucaaacucuccuaauacugaucuauaugcaucaguuuccccaauuaauucauaauacuggcucuucaccauggcugcaucuccuaagaagcuuuaaaaaaauguguuagccaagcguuguggcacaugccuauggcugcuacucaggaggcugaggugggagaauugcuugagcccaggaguuuggggcugcagugacuuaugaucacaccacuacacuccagucuguaugacagagcaagacucugucucuuuaaaaaaaaaaaaugcccagccacagauauuuucuaaaaacuucccaauagaguuuuaaaugagccagaguugagaacaacugccuuauaggcuuuuuaaggauagaccccuacauucaccuguauaaccugucuaaaagccagcauacuguuuggaagauacuauucaauaaaugcuuugaaaacggaaucacugucaauucuuacuucuagacacaagauagggagccuuuauccuacuguuucauuaagcuucucugacuuuaaguuuuguuucuuuuggggcagaggaacaaauaaagauggucaauguguccuacagucuugacagaauuaagucucucuagauggcaggaauauaggcaacuuuuauguccuucuuuuugcuuguuuuuaaauagaaaaaagaaguuuuugcuguuuucuuucuaaugcauauuuuaaaauugggauauaguagaaaugaucuuuaaaauaaacuuuaaaccagaaagaccccaacaggaauuucaguuccaucacuugcugugugauuguagacaacauucuuuuaguuccccuuagccuuaaucuccauuaucaguaaagggcgguuguuuguugcaaaaaguaaaugagacacaacauguaaauuacuuacuccaccugauuuauucacaaagucugaagacuagaggacaagcugacaaggacaucuggggcaguaugaauuaacuaaauuaauugagcuaucauucccauucuuccaacaacaaucacuguaggagauuuuuccuuccuuuugucaguggccucaacuuuuaagugcuuuuugaaagguaguuuugguaaaaggcugaauacuuugugaugaagcaaccuaaucccagacuuuuacauucugagaccaauaguaacuuucuuuuuaucuuuccuguacaucucaguucacucaagucuaauaugagcuaagguucuaagguuuuaggcaaacaauaaaaaauuguugcaaaaucucuugccagugcagagcauagcuauaaaaguaaaacauaaucccuguuuucugaaauacauuccagacaaaagugaucuguuuaauggccucaccuucaugaauuuuggucuaauuuguguugguaaaucaguuagcaagcuccacuugaucaggaaauuuuguugcaccugacuaugugccuaaacgaauaaucaagaaauguagaaaugauucguauucaaaacuguggaaauuuuagcaaaugaggaaaaaagugcccuuagcugcauuaaauaacucuaaguagaaaaccaaagcagguaaggguaaucuugagauuuccaguuguguucuaauuaacaacuugucauuccuuuguggccuauacuuuuacagauacuaucugucagcuuucuuuuuuuuuugagacggaguuucacucuugucacccaggcuggagugcaauggcgugaucucggcucacugcaaccucugccuccugaguucaagcgauucuccugccucagccucccgaguagcuggaauuacaggugccugucaccaugccgggccaauuuuuuguauuuuugggagagacaggguuucaauauguuggccaggcuggucucgaacuccugaccucaugauccgcccgccucagccucccaaagugcugugaaccaccgcacccagccuguccauuuucuaaaguuugaaacugccuccucuguuugacuaagugucaccuucacaauuuccccaacauagcaccaugaaguacuagccauuaaaccuuuccuuuaaaaauguccucuacugcucccuucaauaguucaucuuccuuuguuuugggauuuuggaugaccucuucacuccaauaauauugucugugcuuagacauguuacauaacuuuuaaccauaguugucccaaaaugauuaacugcuaaguuuucauugucuaaguuucauccuuuaaauuaucaauuuaacguaucuuuacucaugagucuaauucuacuauuacaaaacuacaauuuagauaaugaagauggaggagaguaacacugccaaccuugcaauaacaacuaaaaacaaaaagaaaggcaaauaggggagagggggaagaccagauaguuucucuuuaacuuauucuaaauaagaaaccugcauuuucuccuuuaaaagacaucaacccagggggaaugccccacucacacuauuaucagcaucauaauaacaaaccucuacugcuguguuacacaccacgcuaagcacuuucucuaaauucucucuauuuaauccaaaccacaaaccuaagguaaaugcuucuaucaucucuauuuuacaaacaaggaaacuuggccuuaaagaaagguuaagugaauugucccaaguuaucacaggauuggcagaagaaggaucugaauucauaaauucugaauccgccacacuaaaaugccugguuucuucaaucagaaaacugcuauuaaucaucuacuaucuuccagguuaauucuaaugcuugcaguagcuuuuccaaucugcacugaggugcuuuuacagggcauucaugaagagauaaagacuacagucuccagcacuuaacuaaugggucuccaaggcagauccuuuucuuuuucaguguuuccaaugacagcaaaaaaugcuuccuugauauuuugaaucuugaagggaaacauccuacaggcaaaaauguaccaauuacagacccuuauuaauuguccauacuccaacuucucacuucacguaacaucugcuaugugagcaacgggaauugauuuuauuaugaccaaggugccuuucacaacucuuuggaucagugcuuguguuuucuugagcuacaaagucaagggaaaacagauguucauuuuuaaguucuaauuuagauuuaggcuuuaaauuagaaucaaguuucaauuaaacaacuaauaggcaguuauuugcacaacauuguuuucaaccagcacggaggugacaaaaagaauaaaauggccaggcgcaguggcucaugccuguaaucccagcacuuugggaagccgagguggguagauuaccugaggucaggcguucgagaccagccuggccaacauggcaaaaccccaucucuacuaaaaauacaaaaaaauuagccgggcaugguggcgugugccuguagucccagcuacuugggaggcugagccaggagaaucacuugaaucugggaggcagagauugcagugagccgagaucacgccauugcacuccagccugggcaacaagagcgaaacuccaucucaaaaaauaaaaauuaaaauuaaaauuaaaaaauuuaaaaaaaaaagaauaaaauaaggcuaggcacuguagcucaugccuguaauccuagcacuuugggaggccaaguuggacagaucacuugaggccagggguucaaaaccagccuggccaacauggcaaaaccccgacucuacuaaaaauauaaaaaauuagcugagaguaguggcacaagccuauaauccuggcuacucaggaaacugaggcaugagaaucgcuuaaaccugggagguagacguugcagugagccgagaucgcaccacugcacuccagccugggcaacagagcaagacugucucuaaauaaauaaacugagauccucagcucuccaggaguauugaaccuagugaggaauauauaauauaugcaguauuuauaauggaaauaggaaauacaggguuguuucuucaaaauggaccuugaaggaugagaaaccuaaaggcuaacaaagauaucaacagauauauaugggaagauuauuccaagaagagaauaagucuuugaguacaugucaacagaugagacuguggauaugcuggacuuaagacuauuagauuaauaugaauggagcuugguuauguggaagugguaaggggaagaagguuuguaguaggauauaaggcugucaaggagguaaaaaccaaacuucgugaggcucugaauaucaggcaaaauagguggaauguuuaaaaaaaucuaagaaagguaguaaaugucugucaaaacacaugcuacaaugaugaaaggauaaaaaaguuuuuagagauaaagaucuguuuuacugaaagucuggccuucaacuauuaacauacagucaaauuuuagccugcuuaaaacuuacacacugguaucuguuuuaaaauuaaugcuuuuccugaaaucuaagaaaaaaacuuuugagaguagacagaagaaaucuuuuucuccucuccuuuuguuuuaggauuuaguuaacaauagcucuauucaaaccaacuuggcccuucugcagucuucuaagagcaaauacaaacuuuaauacaaaugucgcugaauaugacuuagcauuagcuuugcuuaaaaaucauguaauuuuuuuuauuuaacuguccauggcaaaaaacaagcauucaguaaguaaugaauaaguuguucuauuuauuucaauuauuaguuauacaaaaaaacguaggguuugccacaagguaagcagaggagaaucagccaugauuuggugguccucugagaagacaccccuuccccagacuacuagauuucucuucaaaucccacgcuuuuccucaacuaauuugcaauaagagaaguacacuuauguuuuuuguuacacaaucagcaaauaguuacuacgccuggcaacucugcuuuauuucugugcccccugaacacacuucacucaccuugaaaagcuuucugauaggacagagcacaugaucuugguagcacgucacacagcaaccuucuacccagagcacaugacaaaacagaucagcuuucaaauaucaacacugggaacauguuucucucccuguguuucacuauccggaaaggcgcacaaacugugcagaucacauggcaguucacaugaaacuuuaauggucagcuguucacagcaguaucaauucugccucaguggcuacaccucagauucagugguuguuuugggucuccagaaucauacuuucucauaucagugcaguaauuuucuuguaaaaucauucugucaugaaauuuggcuguuuugacauuauugcuuuaaaucaguauuaaaacucaaauagguuaugaauaacuguuacggucgcuuauguaaugauccacaagacugagaaacggcccagccacuccaucccacaacuggcaggucaauaggguaauuuaaggccaggcaaaaagucagugauacuugcuagaagugaacaaaugucagacucucaagugaaacccucaauacguaagucaauacugauucuuaauucucucucaagugcccuugaaaaugacggagcauugcaacaaacaaacugcaaacaacaaacuaugaguaacuauaucucgccagugugcaaaugauuccgguagugccaucucuuguucugaccuguuaugcaggguuacugaguggcuacucaaaagaagugacugacuacuacccacauagagaagaguaagguuuaaaugggaggaguauuuuacagcaccuggggcaaggaggcaggguggaaggaacagguguaggaaaaaagaaaaagcucucaaguggccccuugacugauaguaggaaaaagaacaugagaccucagcuuucacccuuuguuguauucaaggaagaggguguugaaucggcuuuauuucgguuuuguggaaguacuuuggguuuaauuucuuucucaguuuauauauugucuuucuucugcaaaaaucaagugcugguuuugaccaugcacuuaaauaggucagcacauuucuaaaguacacuaugcgcuucugaaguacuuuauuuguaagcccucaucuagggaaaaaaucaaucagcaagaaacucuugaugauggacuacgugcucucaauuacccugaacaucacagaaggccuucaaagacaucaccuuguaucugagaagcaaaacuaacaucugugaagcaacaauucgcaauacaagaaacacuauaauuaaaagucaauuauguuucaccaucugccuuuaucccuggagguuggucuuaagguagagaggggcaggauauccuuggacacaaccucacccaauuaaaaaucaagacaaauuaagauguucuguacuucuguccuguccuuacuugauuaagcccacccauucugccaaaugcaaacaaaguaagguauggacaggaagcaggugaaggagguagagggaagauccuuucagaaaagcagugguugccuacuuucagucaaugaauauuuacuaagccguguccaaaguacacuuugcuguuuucacuucuuugucaaaauauugcccccucgcccccagcaggaacugcuggaccagucugggcagucacgcuaagccacauuacaacacgaucagcauacugccugacgcacaaggcacggggccucuggacgcguguucugagcccuucgcaggagacucguccuacagagccgaagaaaacagaaaaucaugaacacaaagaagagcacgaagccgaccuccaacuggcaaaaucagaaaucucugccgagaauggcucgagcgcuuuucucgguccucucuuccuccgcugcccacccgcaggccggucgcccgcccuucccgcgccccgcguccgccgcgcguaccucccucucggucagguucuuguccggccccagcagguacggggucaggaagggcucggacggccugaggcuggcgaagaagccguaggcgcagagcagcgcggucggcaagaaccagcauucgcgacggacccgagcgguccgcaggagcacaguggccgccgccgccgccgcccgccgagacaccgggccgggcacauccauccggggcgcgaggggaggggacccggcccggccccuuccuucuccuccuccgccaacuggagugagggucaggcacuuguaaccgcgagugacgccuucucccuguaaggccaggacguucuggacucgccgccgccuccggcuacagaacccccagcuuuacccuacagacgccucuagggucg

SEQ ID NO: 12933 - RNA, 26957 nt, Homo sapiens
ccguuucagguucaauacuucuucaagaucuuggauaauuagugguguggaaaguaaagaagucacagguugggacauuuagacaagagugaaucacacacgaggaauguguucauucuuuuauuguccguuguuuuaaccugacugaauacaagaucaacaagagcacuguacuccuggcaauuauuacauauguuagaacauggauuuugcacuguagacaacauuuaacaccagucuaugggguacugcauugcuuuuuauaaaguucaaaauaaagauuuauuuucaaacaagugacuuugguuuauuucauacauuacacuuuuucuugcagaaaaaaauaaaauuguacaacugcauaaauauaaaauucuuccaccaugaaaaugguuaaaacauucauaaagacacagcaccagcaugugaugccuccagaaaggaaaaaaggaaaguaaaagaaaauguauaaagcaaauuaauuagcccugucacuagccaaagugaugggcagauccagaucucagacacagcuuuagaacauaccggaggacaaggcaagagaugucaagacagcauucaauacaagcauaacacaacccaucaccuuuuuguguuuuucuguagugucacuuaaaauuuaaagggcaguucccccaugacaaacccccaccccagcccccaggaaaaaaauaaaaauaaagaccuaacaccacaggaaaagacuauggaguauguuaaaaaugcucaucgaugggccauuaccuuugaaagagccaaaaaacaaaaaaaaaaaaaaaaaaaaaauuaccaugccaguuuuauucccguugaauauuuacaccuuggacagcaaaccuugcucacauaaaguagaaaacagauacaauaaaacauggcuugaaaaaugaccagaguaugcaccuguaguacuguacacuaaauaaaauacacaaggcagcaauacuuaggggccagaaacacugcuuacuacaagucaguuacggaaucauaauuuacaguaaaaaugggcacgucccaaggcucaauuuuucuuuuucuuuugucauuuacaguagaauaaauauuuuguugcuauugcuacacuuuaauuuacauucuaaccuauuaaaugcagaaagcuaguguaaagcauauagauuaaguguaggucccauacguaugacaguuuguucaagacuaguagguuuuuguuuuuguaucuuuuuuuaacuuauuaaauggcuagugggaaagauuugugcuugugaucagcucuuaacuucaauuuuuacaucaaaacgucccugaaaacggucuuucucacuguacccaauguucucaccguacgccuuacacucuaugcgaauuucaguguccaugguaagauuggugaacuguacggccagcaggggcugcagguauuugggcugcaggaguuugccauaguacggauaauacugcagaggaaaaccaggggaguugcccaguccaaaauacuccacauuuccaacuuuauccuuaucuucaucucgcugaaauccagaaugaaaugaaauuuuaauggcucacaucaugcaucacuauguguacucaaaaacaagacucaaucuacacaguaguuugcaaacuacugagagaggaaagaacaucuacucagucuauuccauugcagccuugagaaauggucauaagaagagacuauucucaaugugcaaauggauggggaagcugagucaaaugccaaauaagcauucuucaagccuccuagaaacaaggccaacauugaaaggcagaaacaccuugcuguuggcccaguaaauaaucugucuagugauauuaucuccaaaguuuacuacuugccucucauuuucuuguugagaaaucaaucuccacuuccuugcuuggugcuagcacugucugggaacucccuuucuuuguucugccuuucucucuaaacgguccauuaguuuuuggauccaaaggaaacaugcacuaauuguuaccuuagucuuucaauuuuuuuuuuuuuuuuuuuuuuuuuuuugagauagucuugcucuguccccaggcuggagugcaauggcgugaucucagcucacugcaaccuccgccucccagguccaagcgauucuccugccucagguccucagcugggauuacaggcacgcgccgccacgcccagcuaauuuuuguauguguaguagagacaggguuucaccauguuggccaggcuggucucaaacucuugaccucauuaucugcccaucucggccucccaaagugcuaggauuacaggcgugagccacugcaccaggcgauauuucaauauuuuuaaaagagaagcccaaaccacuaauuuuuaugugacauuaauuuuuuuuuaauguuggccccaaauuuuuaauacaugcugugggccagaaaguacuucugugggcuaauucaccucucaguucugauaagcaaauaucccaauguauuaaauucagauauuugaguuucuuaugccaguggagaaacugacaucagucuuauucugauuacaucuuucuguucuuuuaaaaaguuuuaccuaguauagcuacaauucaucucacugagacuuauacuugaaagcaauguuucuuauuucuucuauuaaaauucuaccugucacuuaaacagucuucuucauucuccccucuuccucugccuacccuuccaccaccccaguaacccuaaauuugucuuuaccuugccagugcacugaacgggaaggacauuuggguuauacuucaucacuggguaagucuccaaggacucauucuugggaggcuaaaaauaaaacccauuaugaucaguagauuguaaaugauuucuuaaguuucugaaaaauaaaacuacuccguaguccaaacaaguacacacuggucacaguaagucaaccaaaauaacaaaagacaucaggacagcagaaugaaugacuccccuaaccaauuuaaggucauguuugugauuuugcugaaaugaaaauaagugcccaaguuuauaacgacuacaauuaagcugugaugcaaaccaguacuaaauggaacuuuuaauaguagcccauuauaagcuuugcuuaaagacacugaaaacuaagucaacccaaaauauaaugcucguuauuugcuaagauuagauuacaugagaaagaugauugacauuucuguuuuuauaaagcgugggcuuuccuccugagucaugaauaaauaaugucauccuuuucccucaagcaugacuucaaguaggcuuuccuuuuuuguuguuuuaaucuccagucggggagacugccauuuaaggagcguuucuuugcaauuuucuuaggaaaguccaauauguaaaaaaggcagaggugucacugcccuaagaggaaggguggucuugaaggggugaauccacugaagggacccagaggacagucugaaaauuacugcugucaugaaauauccagagccuccucuucuacacccauggcucaaaucuaucucagaagugugaugaacauacuucgcuggaagacagucacuugcuuacucagaucagcacagcaagugagucuugaugugagauguaacacauacauagucuaaucaaagucagauaaaauauuaguuccacaucaggaaggaacuacuauuuugcuacuacucuguuuuggaugcaagaaaaugaucgucuagauuugacucuuugggacguuucugccagcaauguauuugucuuuaaaaauauguagagaaaaugcucacuaagaaguugccagaaucuauccuccaauggugaggauagugagaugcugggauacucugaucucugacaaaaauaacuccaaaauaguuggagauuuggguggaggugaugaauuaggcaguggcaauggauaaccaaguagagaccaaagaaaaaagaaaaaaaggacugaaaagaaagaguagcugaauuuaucacugaaccaaguaacucuaaagaugugggaagaaaucaaucacaauagacuagacugccucugugggguccaaaugucauucagugucuacgaugaguaaugucaaaagcaagguacucagaaaguaugggaugagucuucucuuggccaugccacaacaauuucuuuugcugcuaaauagcugauugaucucagugaaguauuccccagcaauaugaauaucaaauacauuuuggcauaaugguucucaccguuuuucuuccauuauauccugucuauguggaaagaagcuuaaaauccuuuugagagguacauuaauuucugccagcaguccaucaaacuagccagccaggcaaccauccauccccaccuacucauuuuugccucugauggcaauaaaggaacuuugaugcauccuucaguuaacaaaacuuuuuaucucuguguugauuuucuuuugaaaauauuauucauggguaacaagcauuguagaaauaaauuaauagcauucaauagaaaauuaaugaacaaaagugccagauuucagaaaugaaaugaguuuguucacauaacucaauauacugcagucaauuucuaucaaaauuagaaacaacacucauaaugccaacgcucauauacgggugauuagggggaaaccugccagaagaagccaggcuuaaggggaaaggacagcauuaauucaugaucuggaggagaggaugaaaugaccagcuuuacaaaagcagacaacaacgauaaauuuuccauucuuauggagaauauaaucucaccaaauggugagcaauggcaauuugcucauuuuucagugauccagaguaauguuuauccauuauaaguugcaguaauacaaaaagccaacagcauggcuagcaaaauucagccuagaugauguuaaacuucuacuuccgcaauaaaauucagaaaaaauauuuuuucagauuaucaauuuuuuugaaauguuccuguggcuuccagaggaccaaaacuggacuauacaugcaaguggguuaaaauuuuuuuuuuaauccauucuuuaugaaguaaaaaauaaaaaacuuuuuuuuuucucuaaccacuagaccaccagggaaaaaauauauuuuuccauuuuuacuuuuuuaaagaguuuauguuauagaaacuguuaucuggauacugagcaggaguauuaagaaaagggccacagacucacuucagaaugcagcuuugccucucagaauuccuuuaacuuuagaaaaugagauuaauguccuaacuacaagaauugcaggguggauacagaaguuuuugguguuacucuacuggcuacguuucaaagucagcacugaguauacuuuaaaacuaucuuacauugucuucucagaucaauuaaguacuuaguguaaaugacucaucuaaauucuaucauuuaaaauauuacuugccuuagguuugaagccuagaacucgguugagcuuuauaauaaugcacgguuugcccucuuuguagccauaaguuucaucauuuaauccagagcaauuucccagccauucaagcuugaaucugcagaccuuucgcucuccucguucaugauuaaagucuccucguucuuucgguucacugggcacaucuaaaaauaaaaacacaacuuuuauauuguaccagcaauucccuuagcaguucuaagaaaaagaaacugucuuccuugucauaguuaccuauucugagaguacgcuauucugcauuuaaugcaugaucugaauuaagcaagaucuccaggaaaaccaucucucaccucuucacucauauuaaaagauauuuuaccaaaaggaauagcugguauauggccccacaccaaagcuucauaguacuugaucagcacguaauauuuagucucuggcaauauuucccuucuuuuaaauaauggauuacucagcuauuuagaagacugaaaggagacggaucacacugcgugaguagcaucauucacacugucaacacuggcuuagcucaguaacagggauauuauaaucagaauacaaaaggacugucaauaauuuucagaacuagguuuuuuuuuuggucagaauuuuuaaaaaggaacugguauuuuccuuuucaaccaccacuuaaggguuuuuuugagacagggucucacuccguggccuagguuggagugcggcagcaugaucauggcccacugcagccucaaccuccugggcucuaaagauccucccaccucagcauccugaguagcugggacuacaggcgugugccacccuguggcuaguuuuuuuuaauuuugcagagacuggggucuugcuguguugcccaggcuuuuuugauuugaguuucugccuuuuaaagcuaugcauuaagcauuugcuggacugagaaauuuuauucuggcauuuuuaauucaauccucauauaaaagccagaaaaagaccaagugaauauagaauucaaaguuaauguauagcaugcuggaggaaaauaaugcaaaccauaauuuauguauaguuuuuaaauucacaaaugaacuauuuucccuucaaauagcgaagagucugaauuuagacuaucuccuugaagugauucacccugauuaucccucaggccuuuuaauuacugcaaaguaagaugaaaaccucauuuaaauucuaaugagaaaaauucacacugaaaauguucuuuuaaguuacuaaauauuuccaaaauaacuuaaaauggcaauucgccccauacucugaccaagccacagccugccuuauaaagaacuggaguugguaaaugcuugaauugaaucagaagggaugauauuaccuaguaaaacucagagagauguuuuauguuuguuuguuuguuuuaacguuuuugagacagggucucacacuggugcccaggcuggagugcuguggcgugaucauggcuuauugcagccucgaccucccaggcucaagugauccucccacuucagccucccaaguagcugggaccacgggcacacaacaccacacccagcuaacuugucuuauuuuuuguagagauggggucucacuguguugcccagguuggucucgaacuccuaggcucaagcaauccucccuccucagccucccaaagugcaaggauuacaggcaugagccacugcacccagcgagaguauuuuuuuguggaaagaaugagaacauggacuggaaaauucacaguccagguaguaagagugaggacauguauucaugucaaugacuuaaugaaacuaagagccucucuuuacccuucauaagucauuuccuuauccaaaacgaucagcugccuaacacauauuucauuaucuaucccaaccaggaucaauaaaaguauacccugaccauacauccuccuucaugaaugccagugcagugauagcuaaucacaccaaaaggucuuucugaugagagaaggcccugugcacucuucuauagggagaacuuuuugggggaagauaaggaaauaaguagcuguacuuuucaacggauguaagagaaagaaaaccggaauugcugucuuggcucugaauaguaaaaaauaguaccuaggaguguuuuaaaguaagacaccuuuccaaugcagaaaacagucauacuugaggcuguacuguuuuucauugugucuuccugcuuuuuuuaaaaaaagugucuaaauauggccagaguucaaucuuucauuauuucaggauuaucucucgaucauuaaacaaaaaauagaagugggaaauaagaguuaaagagaaagaaaacuagccacagacaucuacaaugagucuacuuaccgccacaaucuucaaaaaucaugucaucccucugggcugaaucuuuguacuuuuccaggaaccuaacuauguucaguacauaugccucauagcucuugggaucauuaggacgaaaggaaauuucagucuucuggaucugaggaaucuguguuaauccuagaccaggcagagagaaaaacauuaguaggaaggcagaaacgaagacaauucaaaaguagacuuuccacauacaaaacauacuuugcuaacuccacuuggcuaaaaagaaagggucuugccucccuuguuaaaucacuccucuggcauuuagauuagguaaccccaaguaccagugacuaugcuuuaauaucacagaucaguuaauuuccauagcaacacuucaugguaggcaucaccuccauuuuaugaaugacaacacugcuugcacugaaagauuaacuaccugggccaaggcugcacagaaagugguagaaccagaauuccaacccaggugugcuguacuccaaagcccauuauguuucuaguaccccaacgugcacaguuuuuuaaaauacccugcuagcuagcauugugugcagguggcuuuacccucccuaauuacguguaagccuuggacacagaggucuucuuuuauaauccuuauugucaguaaauguauaaccauuccaaauucucuagacucaagccuaccuaaccaagauauuucuuuggaucuuuuaaacuaaacgggaagaauuugggacauacaugcaguaaccacaaaugcuuuccaaucugaaagucucagcaugucagugccggucagauaaaauucaaaguccguaugccuuggguuugcacucucuaaaacucuguuacauucuuuaauauccaaaagccgcugccuucaugagacuuccuagauggguaugugaaccacacuacacagcacuacucaggagcaaugguuggaaaaguccaucacaacugcauuuuauuguaggacugccaaauaaaagaugccugguuacauuugaauuuuagauaagcaaagaacauuuuuuuaaaaaaauauaaguaugucccaaaugcuaugugggacacacuuacauuuaaaaauuauuguuuaucugaggccgggcaugguggcucacgccuauaaucccaacacuuugggaggccaagauggguggaucaccugagauccagaguuugagaccagccuggccaacauggugaaacuccgucucuacuaaaaauacaaaaauuagccaggcauggugacacacaccuguaauuccagcuacucaggaggcugaggcaggagaaucacuugaacccgggaggcggagguugcagugagccaagaucgugccacugcacuccagucugggugacagagacucuaucucaaaaaaaaaaaccuauauauauagauagauagauagagauauauauaaauauauauauauauagagagagagauauaguuuaacugaaauucaaacuuaagugggcacccuguauuuuuauuuauuaaaucuggcaacuugauucuacuccucacucccagaucuccccucucuguguggggcccauaaggaggcacaucaucacuauccuugauaagugacucuacccuggcuucccacccccaccucccagcaggucaggaaagcaccuaugucacuaucauuuaggggcuugucaaacaugcagucucagagacuccccuccagaccugcaaaaucguaaucucuaagaaagagauuugagaaucuguuuaauaaguacgaaaagaucuuuaaacacccuuggcuuacaacugcuucucuagggaauuauaaucugagaguggcaacagugacucagauaugaagacaacgacguuaacgaauguggaagugauaacuagagugcagcaccauuuguagggcuugagaagcaggcaucaguaaggcucgacuaaaugcuauucuuucuagugauugaggaugcuuuaaaagugguuacauaaugaggugggcucaggggguuguauagauaugcuuuuucacacauguaguucccuagaggaauggaagggauagagaggaagacaaguaaucacuggagcaaggcacaggggugcccagggcaaaggacuuaaggacauuaacaaucaucuucaggccaggugcaguggcucaugccuguaaucacagcacuuugggaggccaagauggaaggaucgcuugagcccaggaguucaagaccagcccaggcaaccuagcaagacucuaucgcaauuaaaaaaaaaaaaaaaaaaaaaaaaucauccugaaaaggaugauguagaaccugaagaauuaugggggacaaaaauuucaacagugauagaaaugaaucaaaggggaaguagcagaauuugcucauaaaaaucuucaguuuaaaauaaacacagauuacaguuuaaaauuuuguaaaaaugccuacaagccauaauuuuuuaguauuucuaaagcaauuuaaauauacccugaacaaucuuuuucuauguuaaaauuggcauugugaucauuuauggugcaaaacagcaguauuguaaagagaagagauaccugcaaaaauaaaggugagcagaagcuuccacagauaguuaaugcuugagacagcaaugguaaacagaguuacccagugaaauggggaagucggguagggagggucacuccugguuuaaguuguaaauaagacacuuaagucaaggugacuugccuggaccugggggaaguacaccagcagacccaaagccagaggcucaacaaaauucagaaugggagaauccuggagucaagagagaauggagccuugagggacggucaugcugaggggccacccgaagagccagugcauaggcagccagagagagagacaaaugccugugcaucgcucaggcaggaggucugcaggaaccuccuccaaguauucugugugauguuugggagucaggaacagaaauggacuuauguacacaagguuaaacaguguuuccaggcuugggaaagacaaggcaggagggugguggauggcuagacaagugaaggagagcaaaugucagaaaccaaggagggaucucaucugaccuucagggaaggucaggggaagacccacagccaggggaccauagggacauuggugugauaaacaacaauuaugcaagcugugguccaucagcagagggcgggaugcagcaaaagccaaaauauaaacaagccugauacugagauuuggagagucucaccuaacaagcugaaaggaggagugacccuagaaggucauguugagaguaaacaugguaaaaccuggauugcgaagcaagugucacaaacauccuuguucucccuggccuggcuucagugagccucuccagugguuugccucucacuuucuggcugcuugcauucucucuuccaguggcugcucaagguuccauuacuuugauaugaguaugaggaauagugaugccauuucucagauucucccacacaaaaaaaaggagaguaagaacaggaggagguauuaugcugagcgcuuuucauuccuucacaaugucaaguccacgguuuccacuauuaaaagugaccaggggacaugugucagacucaaaacaucagcaacucucacucaguccucugggcucuuuacuaacaaaaugauaaggcuagugcauuccccaggagccuaggggcuaugaccaaaacuaaguucauguuuacugauagacuaugacaaaucuuucuuguaagugccucuguuguuaaucaucuaggaauauggccgggaaugguggcuaaugccuguaaucccagaacuuugggaggaugaguuggguggaucacuugaggccaggaguucgagaccagccuggccaacauggugaaaccccaucucuacuaaaaacacaaaauuagccaggcauaguagcacaugccuguaaucccagcuacuugggaggcugaggcacgagaaucgcuugagcccaagaggcagagguugcagugagcugagacagcaccacugcacuccagccugggcaacagagcgagacucugucucaaaaaaaaaaaaaaagaaaagaaaagaaaaagagaaagaaaaaaaauaucuaagaucacauuugugaaaauaauagguauuacuguuacaugaagugguacuacuggcccagaagagaguuauauacacaauuggccucaugucucucuagacggggcaaauaagaaauaaugaaaaccaaguaauggaaucacaucccuuucaaccugaaagcccaaauuuuucaguaagcauagcucaugaucuaagccagucaaguuuauaauuacuuugugagggaaacauagaugcaggcugcuugaagaaucuugacuuugcucuuacagaagcaucagaaacuagugaaaccaagaaagcaaggggugaaacauaagacagcuaagcacggagucuuagaacccugugacuugcccagcuggauuagacccuaggccaaagccucugcccuguccuuuccauuuuaaguaacagagaaccuugguagaaggagccgaggaaugacagauaaaccccagaaagcucagucaugucuuacuguuuugugagcucauguuucccucuggagucugaggggucuuagacggugguaacuaacauaagccuuaaugaccauucauuuaagauacagagcuuuugauccaaacgucauuuccaguaaaaaaacagauggucuggguuuaggucaugcaaucagcucacacaugcuuacuacauaaacaaauguccaggaggccacgccacagucaaguggccgcugccuccuuaguagcucuucugcucucuuuccucacauuuccacaaggucucucacuccaucacccacuaucucugccuccucucuuuucuuuauccgaagccugauggccugagaacuucuccuggaaauuaccacagaucagcccccgggucuguucuguucuggauagucuuaauuaggacaguuuuugaugaggucuucuccaaagauuagaaaaauuccucuucucaaguuauuucucuaaagcaacuagauacucacaagagaaagaugaaagaccuuugaaaggauguccaaauccuuuaaaucauuuacuuuaggauuaucagacuguuaagaagagauagaaagcaaugggauuggauuugguaauuauuacagacaguucccaacuuacaauguuugccuuaugauuuuucagcuucacaguggguuuagcaggguuaguaaaugcauuuuugacucacaguauuuucgacuuacaauggguuacuagaacauaaccccauccuaaaucgaagagcaucugcauuuugaggccacacccaaauucuccaaccaugacauucuccaagggcugcacaaaucccaccuugcugacuggaguucucaugagucauauuucacacuagaccagacgcuuucucccaucaugccccucuuucuacugcccacuucuuaaaguuguuaguuaugacucuggacaaggaugagcucuguuugcacugguaacucccagagggccaaagacagcagaacacccaaucgcuggcacgcaauuucaaguuauauuccaggaaacaaaucuaaccuuuucccucuccagucuucuaaacuugaauuuacauuaaccacccugagcucuagagacagcuuuguucugauaggaucauuugccuuaagcuauauaucauuaauuaacaaagccacuugaagaggcagaaaucauaaucuggguauguaaaauuuuaauauuugguuuucaaugaguauuucaacuuuacauaagauuuagauuuagaaaaaacuucuggcuucccacuugcuuuucaaagacacauuuaccugccuuugguccccaucucuugagaaauaaggaagauccuccauguuuagcuuuaguaaguguugauagcacaagggggaaaaggcuugagggaaaggauuuuguuucuuuagguuuauaauguagcaaguucaucauuucucaaucuacaugugaguuuaaaguauuuaaacuagaauguagccauuucaaccuuguaaguuauucaaaugcacagcugcuugcaccugucauuuaauacaucugauaaaucacuagaucaaaucucuaaauaggaaucauuucccauggaaaccuccaggaagguacccauaugacugagaagggcacaggaagcaaagaaaugcuuuuaaauguagccaugcacaaaucaugugucuccuauacauuccgaguugaaaaguaauuuccaauuuuaaaaaaaauacacagagguaugaauucauacauacucacacguauauguacacauaaacacacacauauguaugcauacgcacauauaugagauagaaauuucuccuuuaagugccacucuguaggaccuaagauauuucuggauuuuguuuguuuauuuuuguuuuacaucugugaguugguaucaacuuaccuagcaaaguaaggggagaggcacagaaaaaaggcgccuuugcacuuucuggaaacuagccaccuuugacucaccuucugccuccagcucccagacucaggcucugagauuagcaaggaauaaaucucccugccugcaggcagggucacauucacacccuccgacacucagaaucugcucccuuuacaaagucuuagaaaacugaauccccggacugucucuacagccaaucuggauguuuaccaacacucaggguaaagaaaucauuccuccugucuaagcuaaaugccgugaacucugauuuaggcucuucucugauccguccucuucuuccuguggcuguauauucacuuucaggcaagcagggaguuauuuaguucaguugaccuaucuuuaaaaaugcauauuccauaggggcaaauccuugguauuuuguauagcucauaauugugcuuauucucaauacaauaaaggaaaggugccacuuuuauaaaagaauaacauaaacaaauagauaaauccuaguauuuuacauuaauuaugcucaaggccaaacugaagagcaaguacauauaguauauuugacuuaucuagauauaaaacauaacauuuguuaaguaauauccugaaacaagacacugcauucuacaugacauuugauaagaucuacucaugcauguaugugggaaaaagcuggaugauacaucccuguucccuucaucuccccagcuucucacuagucuugacugcauccgacagaccagcuggucaucagauuacuagcaugagagcacugaccaacaguuaagagcaaccaguccaauaaccccaucagauuuuaugguagaaguggaccugucaggcuacugcucuuuccaccccacuuucuaugacccuugggugaaugcagcaaaaaauccuuaaaugaagcuucacaaauccagcuuuuuuuuuucccccaccaucacucccacagauuuguuaccugguccuuccuacuuaucaggucucuguucugcuuauucaucauacaaugggcauacaauguaagaucuguuuuucuguggcuccaagaacauuuuaaaguaaaucauuagguuuccuguguacccaagagaugacuuacuaguuguacccuugucuuuagaaauaaagaaaucaccaccuggguaguugaguuguugaagccaaacagaguuccccccacaaacccuuuaccaagucauaaggcugugcaguagcuuuuggaaaucuaauugccaccaaugcuaacucauccacaaauucugggaccagguagacaggauccauuugagggugggaagggaggaggagagggaaagugagagacagcuggguguauacagauacaucgcgucagcugagagauuacaaagcaguguauucuaacuggaaacaccuuacuggcacuuugcacuaacaaccccuccaaaguauaaggaagccaaauguuucuaauuuccccuuauuucuccuuugaagugugagugagagauaguaauacaaguaugagguaguuugcgggggguggaaaaauuagguauucugagacugacauaaugacuucucaggaauuuuacuuaaucaagcugagauagaaugauaaugacucgaacccuaauggguuuuuuguuuguuuuguuuuugguuuuuuuuuuuuuagauggagucuugcucuaguugcccaggcuggagugcaguggcacgaucuuggcucacugcaacgucugccuuccggguucaagugauucuccugccucagccucccaaguaacugggauuagaggugccugccaucacgccuagcuaaguuuuguauuuuuaguagagaugggguuucaccauguuggccaggcuggucucaaaauccugaccucgggugaucugccugccucggccucccaaagugcugggaauacagguaugagccacugcgccaggccccuaaugaguuuuaagauuagauauuuccucuuuacaaucaagaugaaacugaaacugcugguggugccaguguggucagcuggucugcauccaccccacuucuccugcccgauucugauuaccaacaagccaagaauaugacccuuugaaaaugugucugcuagcacugagccgucuauacuucagagcuaaacaaacagccacccacaaccuuaaaagagagaacagcagcauacauucauaccugccuaccaggaagcaagccagcugggaaucucccggacccaccgauugacacacagugaccuucauuucacuccacuguugcuaagugagccugaggugggggaagggcaauggcggaugugaagaagagacuuuuccauuacaccacugggcaggcagcaaggcaagcagggucaaaucagggccagggcuugguagccugaguguguguguauauccaugagcaugcgugugugugcacgcuugcauguccgugggcaugcacgugggugugcgugccugugccugcucagcccucuccagcauagcuaauugcugcgucucuccccagauccaacugcaucaacagaugagaagcgaugcugcagagcagcacugcaggacugccuaagggggucuccucuggagaaaagcuuggcaggcgcuaacccaacaagcauggguuuguuaaagggagagacugcacaacaaauacaaugccauuuaaauucacuuuaaaauuuuuaaaaacauguuucccaaaugucucuuaaacauuuccauggaaagcuaagguuuuauugacuccaugaaaaucuaagugugcaaagcaucccugucauaucuggaaauuuaguguccaaaaagaagaaacugcugcuucuaguagaaagauagggcuauaaaaacccuggaccaggugcgguggcucacgccuguaaucccagcacuuugggaggcugaggcggguggaucaccagaggucaggaguuugacaccaaccugaccaauauggugaaaccccaucucuacuaaaaauacaaaaauuagcugggcaugguggcgcgcaccuguagccccagcuacucgggaggcugaggcaggagaaucgcuugaacccagggggcagagguugcagugagccaagaucaugccacugcacuccagccugggcgacagaagaagacucccucuugaaaaaaaaaaaaaagaaaaaaagaaaaaaacagaaguugcucucaacaguuacccuacacuuaauaccauugguuuugccaccauaaaguacuauuugcuuuauauauguuuaucaucucauuuaguucucacagagcauaugauuccccaccccccuuuuuuuucuuuuuuuuuuuuuugagauggagucuucgcucugucacccaggcuggagugcaauggcacaauuucggcucacugcaagcuccgccucccggguucacgccauucuccugccucagccuuccgaguagcugggacuacaggugcccgccacuacgacaggcuaauuuuuuguauuuuuuaguagagacggaguuucacuguguuagccagaauggucucgaucuccugaccucaugauccgccugccucggaagugcugggauuacagacgugagucaccacuccuggccccaccccuuuuuuuuuaacaggagacuuaaaaaaauuuuuuguguguguguggauauggggucuugcuauguugcccaggcuggucuugaaccccugccuucaaaggauccuccugccucagucucucaaagugcugggauuacaggcaugagcuaccacaccggcugcaacacgacuuuguaaggaauaucaugugcauuaaacggccaccauuguucagggccaagaagcuguacacauucaccauuuuuucuuacauuucacuuccauucuguaguuuagucucuccucucagauuucauguuuggccucucaguuuauccaauauuaucgccauacaggcccaaauacacucacugcacaauugccacugcuugauauggccacauucacacguuauugagaagagauccaacuacaagguauuccgguguacaaagggcagucaauacccagucaggcuggauuugcauucaugccucaaauucagcugauaauauuauuaguaagucuuuauaucuuuaaaucauaugcaaacuuucacacccacuagguguaucuaacucaaauuuacaauuuucccucuuuaacuaaacaugaaaauggaggcuuuaaagauacuaaugugaagccaaaaaauugucaggguauucuuaaacacacuguuugucugcauacuuaaggaguuauuuccuaugcaaaauacaaacuucuaacacguacucugaaaaaugccaaggaggguccuuggcauugaaaaaugccaaggaggguccucaggcaacacagggccauaagggguggcccaagagcugcacuuuguggcagccggcacucugcuggccuggccugaucaagguucggcacucugcuggccuggccugaucaagguuacugucauuuucauaugaaugucaugucccuugguaaaggcccccgaaaaaccccacaggguaaggcaggugaagaggaggggccuggccuagacucuccugaaaggugaugggggaagggaugaggaaaagaagagacagaaauuaccaggccaaagaacaaggaagauggaggacugaggacuuuuccugugacucagaccacaggacaggaaugcauuuuuccaagaugagccaccagcauuccuuuggagaagucaggguuugucaggucaguccaacugcugugagcacacuaaauauagguacuaagaacaugucuuuuaggaaggggauggaaggaagggaagggaggcaccgugagaggguguuggaaaggacugagcacuucagccaguugauuuacaggcaaggucauuuccaaguccuuacuuacaagguugggcccuuuggcuauuucuuuuccaaaguuaaauuuuccuuucugcaaagggcacaaagagaauuuuuaguuucauuaaaggcugacuccucaaaguuuauauagucaaggaccauuuuuuuuuuuaaucuaggaaauuuccugaagaaaauauuugacuuuguagucguauuuggcuuugaguauaagaauuauaaaacagcagcaggccaggcaugguagcucaugcucacaccucccagcacuuugggaggccgaaguggguggaucaccugaggccaggaguucgagaccagccuggccaacauggugaaaccuugucucuacuaaaaauacaaaaauuagccaggcaugguggugcaugccuauaaucccagcuauuugggaggcugagacaggagaaucgcuugaaccugagaggcggagacugcagugagcugagauugcgccacugcacuccagccuaggugacagagcaaaacucugucucaaaaaaaaaaaagaauuauaaaaucacaucaugauggaagaauaacuuuuaaauggcauaacaaagaacaaaaacaaaauauccgcaccaauuaaaauuacaacuaaugguaccacaaaguucuagcagaagaggacaugaaaagacacaaugcuucccuaucaccauacccaacguaaaacauguuucagcuucucugcauacuccagaauucuugcuucaaccuuuccacagacccaccucuuguggaaaacaguugcuggaaacuggauuauuaagcagguuuaaguuauguuauuuacuuacgugauuuuuuuuuuccacuuccccaaucccucagcucuaaauuuaucuggaaauauuuugaguuuuucuuacaguggagaacuauuugacuuagggcuacacaacaaugcuugccaccuccguauuuugaagaucuuccucugugaauccuucccacauucaaggagguacgcaggaaaagccuguggcaggcaguagcccuugaucuaggcugcucagggccacguagaucaucugaagauugucaccuaaauacagcuguuacuaaaccuuugccaagggaaagcagagaagggacaagucauugccaucccucagcagcagcuucaaggucauucguaagugagagcccggaaguuaugcaacacuuucucucuagguccuccagacaaugauuuuuacaacagccagaugguaaauucacguuuguggcuauuccacugccuuguccuaucagcaucaggcaugauggccaugggccuuucacgacugguguggacacacauagcucuacacugauggcacccaagucacagcagggacucguguggcaguuugcauuucuuaugauaaucuuuuuguucacccaaguuuuuaagagcuaaaagagacaguuaauuaaacuacaaagugggaccagaaagcuggcaaaugagaugcuuauuaaaucaauggguauaaauauugagaaguaagagugacuuuguucaagcucaaacugcaaauuaacagcaggugggacaauagaccccuaaagucauggcuccucucccugugaguagcugcccauuccacagcuucuuaucaucucuaaaaauaaguucaccuuuuaaaacaggagcccaagugacuuuuuuaaaagaauuuaccugagucauagccccccucaagaaguaaaaaaaugucuguuagaguugaaaaggucuggaaaggaucccacuaaccaaacccuagaauaugaaaaaugagaagacagaggcccccaucagaacucaaucuguucacagucacauagcugguggguagcaggcuggccaagaaccaggacgcuucacccucacucuagaacugggcaaauaagaugucugcaacccgugggagcucugccugcaaugcggguaggacaucuggcugcagccgagagaaguuucucuuuucccuuuucaugguugcuuuaagacuacauuauagaguaauuuuccaaagaauuuuuucucaauagaaaaagugacacccaugcuaucucugaaggaaaugaagcuauucauguggauuuuaccuggcggggccacucgguccugauaugugggcuuaaauucacugauggugagcagcaucacuuggaugguuccgaugaagaugccagccaggcagccauaaaauauuacguagaauagaaggaucuuaacugcaagaagaacagaaacaaaaagcugugaugcagucauaugcucagaaugaaaguuuaaucuucccacggaugaacaagcuuccuuccugguucccccggucccaugauuucuuccuuguccaacgucaagagugcaccucaccccacugacacagggugaaaaucgagaagcugggcagcccuccacuugcaguguguaugggaggugguuaaggguaggaggaauguucagcuagaacuaggauccuuauauuuuuuuauucccuaaauuuuaaaaaaaguauccauauuuuuuauucucaaaauuauaaaaaaaaucaugaagaucaccaauaaaaucuagagcuauguuuggaugcuuaugcaaugaauuuaaaauaugacaguauacucccuuagagaccuauguuuucuuugcuugcauaucccuugacauuuaaauacuacaauccaagcucugcuguuucuccaaaugcucagaugccugaggguuauuuugcuauggcagagcaaugaauccugagaaacccagugaugauauccuccuguuuuuuuuacuaucacucucccuuugguuuguauuaucaacaaagcacacucuuuccccucggaggacaagacaaggggaaaaaaagaaaauucuauagugaaaaugaccagcacauuuuaauuccaucuucuggaacuggaacaagaauaaugacugacuugcugggcugcauuuucuuuuucccauaguuaacaagacaacaggauggaggcugaaauagcugcaaaagcaaaaaaaaaaaaaaaaaaagacucaacacauagaugggaaugaggguggcuaucaguuacugguuuacaaggauuaucucccugauuagcugcauaguaacaggcuguacuaggcauugccuggcaguccugugccagccaaacgacucaaugugaaugcaaaacagggaacaagugaacuguaagguuaucgagucagaagcacgacugcacaaaggagccuuagguuacugcuaaaaagguccagaucucaugcauuaaaaaugccaggguacuuggagaaaagccacugaaaaacaguauuauugaaaagaaguauaugugguaggagggggccagggagggaguggguacacaacugcaggaauuagccuuguugcccuguccauacauuuaaaagcccaacuuuccuaucaggcacuaaacaguuaaaggaaaucaggcuacagagcuguuaaaacaagcaaaacacacaaaaccacagcaaaaugcuuaaucauaauccuuuuucuccucuaucaaaagcaaauaacaaggaaaaaagcaaagacagaaguaaagauaaggaagaaagaaaagguuguguaauccagaacuacagcacccaacucaaucacucccuccccgcaggacaaggguuaagugcugcauucuguauccaagcagcaguaggcaaauggcaacgcugugacgucaagagaucuggaaaauuuuuccagugaaugcuccuaagaggugcaagaguugguguaacagucagcaaggcagcuaucguagcccugauucaaguuuccucuugcugccccccacccccaccucaucuuggugcucuuaccuuaccuacaugugccccuucgaacaacugaaacaucucuauacucauucccuggacuccagaugccuaauucuaacaacauaagaggguacauaauugaggcuacaguuuaaaauacaaauaagagcaacggaaaaacaagucauuuugcaaguacgccgauuaagcucagaaacagacagccuuucuauucugcccacacgauauccuaagaaaagugaggaauuuucccuuuuugcucugagauguuaguugauaaaaucucccuaguuacugccgugaggucacugggagagaguggagcacucaggacuagaggggccuaugcaguggcucacucagacacaggccaccaggggcuccccacuagccaaaaaaaaggcuagauaagucacaccaacuaucugggguggcacugugaggggagcugagaggcuucagaggcaucucccuuucacgcaauuuuucuucuuuuaaaaaaaaguaauacagagguuuuuuuggaaaaacaaacaaaugaacaaacaaacaguguguacccuucaaaaggucacaggcaggcauccaggccuagcuguaaauauaaaaccuaccaaugucuguauuaaccuaauaaaaaggcagaaggcacaaagugauuugcaugcugugauuucuccagcaggugacaggcgagucuccugcguccaucuuggugaaaaucuaccuauaagcaaaaucgagccaagggcauccugcccucgccccaagggcauccauguugggcccagugcuggaaaaggggcauuuucuccguaggagacgguaauugcugccgccuuuucuaccuaagagaggcucugacaguuuuuacacugccagaaaggggcagacauauuagcacaaaacaaaaaggggauuuuuagcccagcaccuguaccguggaacauggaagggaagaggaggcaaguacagcaguccugggucuacauucacaaaucagcauacugauagcuugcuggauaggauaucaagacauaaaaauugacacacacggucucucuuucucucucucauggaggugcugcccauuaaaugucggcuuaaaaaugagucaguccauacugccuuacccucuaaagcaaguauuauucugagaagcaugaaacuggaaugagcaaagaugcauauuauacuaaggggaaaaagacaagaaggcaaauuucacaaugugccuagagucaaugcagccccugccccugugacgcagcagggucagaccaccagagaaggaagccccagcuaaccuggggagaagggugcccauaccgcagugcaccuuccaggccucccucaaguuacaaggaguugccagggagcuguucauucuacacacaccccacaguucuucagguuuuccuuuccacaguaaaacacaggaaacuaccuuuaugccugagacacuaugacaauaaucucaaugaagaagucuccccaaaauaaaauauaaaacaaaagcuaaaagccauuaaagaacuacauuuuccauggcucagggauaccuaugcuucccaguaacaccuuggaaagacgcuucaccuugacuaaccuugaagugugaugcauuauuaacccuuuaauuuucaaucaagagagacucacaggcugcauuuuuuuuucuuuacaaaaauucauauauuccagcuucuuccauuucaaaaugucagcuaagcacuauuucccugacucauucuccugccgauucccacagauccucccaagcaggaacaccaaucggccucuguucaggacucccugaaugacugcagugguggugccagugguguugguggugauggucaugaugaugaugaugaugaugaugauguuggaggaggagggggcagugaugcagcagggggaguucccucccuccuucccucacgcagucacgacucauagauucgccuacaacucugcccuucaaaaugaccuuuuuuuuaaaaaaaaaaaagucaccuuuccggagaggcugaaaacaagaaaucuaauuuucgauggaaaaaagucuauccaaccaagcaacaggcugcacaaaauauuuuaagaucagcugcucugcguuuauauucccuucaccauaaucaacccaaccuacugacugauccacaacugucuguguagaccuugaaaacaaccagacuuugccagguuucgggccaaagcuaagaaucggaguccugaaauggagcuuauugaaccauuucuggguggugaugacuccaggggaggucauggagggaaauccuuagccaucgcugugaaauacuacaguguggauggauuccucuccacccuucucuuuccucucuuuugagauacguauuuagacuagaagaaagaugcuguaacacacaaccucgucugcauuagaucccaucaccucacgagguucucucaagaccccagaucucauuuuuuuuuuaaggacucaggacacgggagagacaaauguagucucgcagagccugacuauucccaggaguaaaaggcucaaccgaugcacgguaggaaagacugcaaauuaccaagccaagaucgcuacgauaugcauaaccuuccgccugucguguuccagccccgacccugcgccccacucuggggacaccgcauuccgcacaggacugcaagcccaggccggcgcgacccagcagcguccaccacccucgcccccgccaccccggccagcgcggugggugcggaaccggccgcggacccugcgcaggggaugcgccgcccgggaaagaucagacgcggcggccgggagcugcggaccccguacuuacaccaacugccaccgguccugcccagaaacuccuucuucucugaguuccagaugaauuucuuccagcugcccuccuccuuggcuuucccgcgggccauggcgauggcgggucagcagcugccgcgguccggaggguggguggcugcggcgcgcgcccuggcguccucugcgccgcucggcuucuccggccuggcucucugcaggcaggacgcgccgcugccgcugcggcucucggagugcgagacgcgcggcggaggagccaaggcaggagcaggaggagggggaggcggcggcggcggcggcggcggggcgggggcggagggagggacggcgcaggcugcgcggcuccgagccccgcaccuauuggugggcgcgcagccgcucgcgggcuuucuuugguccgccgagcgcuccucuagcccuuggggggucgggggcuccgcgaacccguagcugccgcucccgcugccacuggggacgugugcugggcccccgccuccccugaccucugcagagacaggcccgggguaggagagucagagagggaaggacggacaagcggacugcggggcgccaccggcacucccgccaggagccgaggaauuggcugcgcccgcccuaccuuuacuauauaccgcgccccggcggccgugcgccccgcccucuagcggcccgguggccaaucgccggcgccaggggcagggacucggcccgagagggcggguucggggccggcacaaaggagccgccggggcuagaggggccgcuuggaucgcugggcgcggggcguugggcgcggggcgaggaggaggcgggggcggcggugagggacgcgcaggcagcgccgcgcagcccccucccagcucccggcugggcgugaaccgccccuuccguggcugggggauccgcaccugggucgcccggagccucgaggaccccagcccggcaguccuggcccagccuccacgccucugccugcccgcccgcgcuuucggccucccugggcuguggguccaccccuccugggcgcuggcggggugggggaaggucacuccggg

SEQ ID NO: 12934 - RNA, 33810 nt, Homo sapiens
cacaucuggaagccacaugucagcggcagcuauauaaaacggucagaccagcaaucuuagagugacauuguuugccaaaaucccaggcagcauggaccucagucuucucuggguacuucugccccuagucaccauggccuggggccaguauggcgauuauggauacccauaccagcaguaucaugacuacagcgaugaugggugggugaauuugaaccggcaaggcuucagcuaccaguguccccaggggcaggugauaguggccgugaggagcaucuucagcaagaaggaagguucugacagacaauggaacuacgccugcaugcccacgccacagagccucggggaacccacggagugcuggugggaggagaucaacagggcuggcauggaaugguaagggccagucccugcacugcacuggggcugggaacaucucugcauaucccuccuccugggggcugcuagacucucaaggaauaucaguaaccaaagccugggcaaaucccaccccaaaccucaccacugcaugcucuggguggagcagggcugcugcugagcggacuacaugacaggacaaaaaccugggauggggagugucugugggagacagacuccucuguggcucuguuccuuccagaagcuguucuaccuacucucaguuugggccaggggcugguguaggucggcgagaagcuugcuuaccagacuaccaaaagauauguacagaaacugaaaguaauaaacuuuauagaaauuaaaacuuucugugccaucggaauggcauuuuucuuuuuuagaaauuuauuuuuaccauuuuacaaaaguacuggcccacaguaguuugggaacaagaaaaauaaacaauugaucucucagcacggaggguuugagaacuauugauuuagagcaagugaauggaaaagaggggacaaggacauuuaggcaaaagaaaguggaauuaaauagcugucuacugccuugauuaaaugugcucucucaauuaugaguacugagguccuucucucugccugaauuuaaaguggguuuuauugcuggaaaauaguuuacuaaaggguuuuggagagaggugcugucuuccccugacugcauucugccuuaagcaguggcauggaauuuuuucgagcuuguacuuuuuuguggggugugauugucucagcugggucucagcccaggugcuuggucaggagcucauccuaguaggcacugacugcuaggcugauuauuuacaacagccuagauggagccagcacucuaggaggcuuggaggagagaacggaggaggcaguccagggaggaggaagcccaccuggagggcugcugcaugugcuaucuguagagcaacccagauguguggcaacaaguacuuaguguaguggggauuggaggggucaagcacaaaaucuggccaggugugguggcucacgccuguaaucccaaacacuuugggaggcuggggagggaggaucacuugagaucaagaguucgagaccagccuagggaacacagccagacccuaucucuacagaaaaaaaaaaauuagcccgguguaguugcaugcagccuguggucccagcuacucaggaggcuaagguaggaggaucacuugagcccagggagucgaggcugcagugagccaugcucgcaccacuguauucccuccuggguggcagagcaagacucugccucaaaaaaaaaaaaaaaagaaaauagaaaaaagaaaaagcauagaacccugggggacacaaccaguagagaggugaugaugggaaauccaagaggaagaaacaccgaugggugggggagccaggaaagagagcgggccuuuaaguaaugacaacagcuaccauuuauugagugcuuacccugagcaggcuccaugcuaagugcuuuauguggaucaucucguguaaugcucaaaacaaggguauaucccauuuauagguagacaaacugcagucuagagauccaguauuuccucggcuagaaagcugggguuuggauccacagagucuuugcuucaaagaguuuguacuuugccacagugacgggcuccugagaggcugcugccuccacccagagugggcucccacccgacagcugacucugucagcagagccagugccacaggaccagauucagggcaguucuuccuccuggagaggguggggaccugcaagaccacagcagaagcccagccccagagggaugaucccuacuugguuaccaggacuguggaggggcucagccggacuguagaagggguggggagaggacucacacaggcagcagcaggugagggugccggggcuguggaggcugcuuggacagccuuugugggccauucucauccacccccauggccucuggugagcagauuuaguuauucaaaaccccuucugacagaugcugauucagagaccaggcucaccuugauuguugucuccaugacuccucacagccaggcccacugccuaauguggagcauggcaaugaccuaauuacaacugucccuccaguccucaccucucaggagcacuaucgcaugggugcgacuccuuucuaacagccguuuuuugugccacagucaagcagcacucagccaugguuccccaagccauagaggaagagcccuaggcucugaaucaggaggccugggucuggauccugguucuaaugacuuguggugugaccuuggcccagacgcucagcccuccagucucccgccucauuuggaaagugagcagucaggcugcaugaucucugaaggcuccacagagcuguggcucaccccugaaaacacucuuggcuuuuucuugcauucuguugaucuuuguguucaucccugcuagagagagaagccaaaugauguuuaguuuuaaacuugccaacugugacugguuugucaugaacucccaaacuauuugaagaaaagcaaaagaggaagaaggugaaauaacaugauuuuauuuggcccaugggagucaagggaaaagcugauaggcgagauaccucuuccaccuccucuuacucggcauuuuugggugugcagugucuaguaauuuugguuuccuuuccuccuuccacccucuguugccuccuucuccccgucuacuaaucacaggguugaaaacucacaaacaugcaaaacaacuucuuuacaauaagauccagcugccccaggacugacacgaauuacccuggaagcacuuuuaaaaaugauuaugccuuugaguucagccuccagucucagugaaaaaucuguaaggaaagaaauugcuuaugggcuggggagcuauuacaucugacguuggcuacaggcuuagucuguucucagggaacaguuguugaugguuuugugcaguugggcugccuuguauaaccaaauuagcuuucagguuuauuuuaaaagaggggaggagucucgaauauaggcuugacaauagcacauaggaucugcuaaaaagaaaaucuuucuaaucaaagugccaucuuuaaaagguguugccaucauagcugaguggucuguggugcugccauugaucacaguuucucuguugaaaaucaccucuucaagugccggcuucugaaguuuggaugauggucucuggcacuaacaacuaccaggaggccuuaccuggguccccaugagugguauuucaccaucccagggcaugccuagguuguucucagggaaucugcucuaacuugggucagcacaggcuguagggcacuggguccuguguggaauaagaugaaggugaaauuuucuagugagauugagcuacuguguagcggaaggagcccugggcuuggaugcaggaaaccuggauucacagcuccugcuuguaucugugacauucgguaucucauucuggcaaaaaagaaagagaagaaagaaagaaagagagagagagaaggaagggagggagggaggaaggaaggauugaaggaaggaaggaaagaaggaaggaagaaaggaagggaaagagaaaggaaaggaaaggaaaggaaaggaaaggaaaggaauggaaaggaaagaaaagcaaaggaagaaaaaggaaggugugacucccaccucacaagcugcuacuuguguuacugugauacuuguaggauaaaguauaagaaaacucuaaagcaaauugaagucuaaaacaaaugccuagcacaucaugggcagguaguaaaaguuuagugaaucugaaauugauguggcugauguugggcaagccagcuuuccacggagucugaguucagaggaaaagugguccauuuauugguaucuacuuuuuaccccgggcuucaaagaaucucaaggagaaguuuuggaguggcaguuuguguuagagcugaguuuaugaauucaaugacaagccacagacuggagaagaggagaaagaaucuaugcaacagggcuauggcagcaucgaggugcauuugaagguggagagguugggugggaacuccguuuuccauggucggacuauuucccuaaucuaagcaagaccaagccucaguguaguucagggcagucguccugagucaugguucugaguauugaguacucacagggcccacuuccucggggaugcuuuccaagaccaccuccucuccccacacaucucgcugucuccacucccucagccugcuuuguuuccuacaaugcccuugucacuaccugauuggcauuuguuucuuguuuugucucccucacuaaaauauaagcuucaugaacacaggggcuuugucucauucaccacuguauccccagugccuagacaagugcugguacauaacaggcccucaauacauaugcagugaaagaccaaaucagcaguccaaaccccagccaguguccccacggcccuccgcaaggaggccugcagguuuucccacaggggaaccauuuugcuuaugucuuugauucccaauauuccagugucuauaguagggguuccaacuguauuguucacaucucauuuugauuuauugcauuuaccaacaugcaggauggucuuucaagauuucuuaaggaucgcuaaaacaugcacagaggauggcugacacacuuugccgccgcagaaugaaguuuuuaucagguuuucauucucucaauaaucuuaaggucucgaucaauuucaaaaauugaaaguaaacucuuuauuucaaaagccauaagggcuaaaugcugcacaguaaccuauccugguuugacauuuguggaagaacugaugaaaucaguuugguguuauaccaagguuaauuucuuagcauuucuuagcauuccuagacacucuagaguuaugaaaauuaacauuagaggaaccugggugaagaguauacaugaauuuugugugcugucuuuacaagcauucuguaaaucugaaauuacuucaaaauaaaauuuaaaaaaauaaauauaaggaugcagcacaaauauaguacaacagaaucguggaauuccagcacuggagggggucuugggcacaaucuagagcaaccuccuuaccucacagaauaggaauaaaggccaugagacugaagcaauuaaaaacugaauaaaaacauugcugucagguuaggaacugucauccucuuuuuacaaaaguagauauaaauaucaguagaaggggagagaugggucauggagcaauucuguuuggaauuaggagagaaauccauaacuuuacauaaguauagguucuauggcccuaacccugaucuacguggugauuuaugauuuauagaguauuccucauuuauauguucauuuguuuauucauucacuaccaaaugcuuauuagcacaaacuuucccaggccccaggaagauggagaugaauaacauacagucuaugcccaugaguuauucaaaagcuaauauuguuugaucuucacaacaguauuggaauccagguguuucacacaugaggagguugcccuugcauggcuagcagauggcagacggaggaccugagccagccagccugauuccacagugcugugggugauaugaaaugcugauguuauuuuuguuccuggauaaagccauagugagugcugaccuaaaaaagauaucaaauccaccuaaggaugacuucugagggcaagaaggcugagugugggagaauaggguuaugacagaucuaggauucuugccaacuuuccaucuaggucacucuccuaagugcuaggaaucaauugucugggggaacuugagcucugcaaaaaugguuguuggcugcucuuguaaggauggcaaaagcucccuccucccaggaggggauuugcuucugucugggaaccugcaggacacaaucuucucaaucaauaagagauuucugcagaguuaagauaucguguguguguguguguguguguguguguguguguuucuuugagggaucuugaaguauugaaaaguuaaugaaguuuagagucagaacaauucucaaaaugcagccccacugaccccacuacuaccuuuacucaagucgucucaacuccgaaauacucagcuuucacaacuaaaacacaccucccuagaacuguuguugugagaauuaaauaagauaauauauguacauuaacuuguguccuuaggggaauuacuuaccuucucuaaaccuaaguuuccuuauacguaaaauggugaucguggugagaagcucauuauuugaacccauuuuauaggauuguuuugauaauuaaaauaauuaaugcacgcauagugcuaagcacaaugccugcacauugcaaguccuugauaaagguuauuuauuauuacuuuaucaugacuacucuguguaaacugagacucauggagacaaguaucacacaguugguaaauuacaaagcuggaguugaaaaccaaauugcuagauuacagagccucugaaauauaucauuuugcuuuuggaacauauaauuuaaucacagucuauaaauauuauguguacauuauaagugucuugaauauuuauuacauuuuaauagacacggagauagcauuagaucucuuguuuaaaaauauuauaauugauauucauaaacucacgucaaauuuacugugaugcuaauguagcucaugcaauuccugugugaccuggaauugcucucaggacauaaaugcaucucacaagauaaucuagaucuucucagaggccuuaggggaagccucuccugccuguauuuuuccaaaaaaaccugaggaauuuguauuuuuggaggcauucucgcucuguccugugcuaggucuuucuauccagagaugcuguucugcaggucauuucugcuucacuguuaaaaccuuguagacagacuagcagacuuaaaaccuggacauggagaagacagcagaauucuuacccagaugcaggcaggaagagagcagaaugugugcaacuuaacacuauuuaaagagacuguucauauccccaccaugguggcaggaggaugagcaguaaacggugcaguguucaaaaacuuugcauuguagccccaugaggcuacucagugacaguauguguuaggugaaauguguaauggugauaucaacaugucacaaggaaggaaaguuaguaugauuuggaauugucaagaaaggaaggaucuuugaaggaggagaggcuugguauugccuuuugugcucugauaugugcuuucugaggcuccucucagugucuaauuggagaaguucaauccugacaauuucuaauguaggcuccaauauuuacugaaagugauguuucgugacuaggauguagccugucuuucuaucagauuacagguacuuuuaucaucaugguaguaauaacuaugacuuccccugccuuucaauuauauacguugugccagguucuaugcuacacuugauauauagcaucucuuuaguuuuuguguaauacugucagguuaagaacugucauccuaguuuuacagaaguagguauaaauaucagcagaaggggagagaugggucauggaacaauucuguuuggaauuagcagagaaauccagaacuuugaaggcuucuuuuacugggcaaacuugcccccaacuguguuugucucugucccuugccacuucacugcuccacuguccccaaccacucuccuauuucucugcuccucugucuuugguaccagucuacuuauuuccaguaucuguauuaucauagugucugcuuaucaguuacagugucugguaauucugccuguccaaugucauaguguuuacuuaucaguaccagucuucugaagagauuccagaccaagugcagcaucagguauagaguaaguucuagugaauauuugucaaaagacuuaaugaacauucuaaaauucugugggccuuuuuauaaaugccugauagcaacucaaagaauuauucuggggaaaauagaauuaacaaaaaucaaagcuuuacucuaaaagaaagaaacucuuuugguacuauuuaagaccucauccaccuuuggggcgggaaagaaauuugggaguguuaaggaugcugugccacauggagugagccacuugucuagaucaugggcaaaacuucucauaguccaucucugcagugggguuggaaacuggcuaacagcccuugaaacaccugugugucugugaagcugggaaaaaaaagaccagcacaaccagcccaucuauuaucuauuuaaugaaauuuugagaguucuugaccaagauggugcugcuuccuuuuaccuuguucaucacuugacucaaccccacaccacaccaccuaaaguccaaacuucuuagcaaguccaacuucuaaaauuguauagagggguucaccaacaaaaccagacacucacacaccuugcaaaugcucuguaauucugccuguccaauagcuuuggacuugguaaagaaugcagacaacaagaagaaguccuguccagcauaccaaucagagcugugggaccaucucgaagagauuuauuauauuucuugagagcucaugaacaugagcuuugaccucagaugaaucugaguuggguccuggcucuuccaguuacucucuuggccgagaguuuuguaggcauuaucacugacuccacacagugccuuaggugaggcuccacaaagcauguaaaggucagggcuaggacuagaacucaugucugcugauuccucaacaagggcucuuuccccugcaccccacugcuguuauguuuuacuauugcagauacaggagaaagucuuccguuuuagcuuucagggugaugacccugagauaaaucauuuucagaaaguccacuuucucagaauagguucacaaauguguuuucagaggaggaguaauuaccuugugacuuuccuucuagaaagcuuccaguuucagauggagcagggcuaacaauacuccaguuucugaaacugaaauugaaccucagccuucaaagaggugguaagaaaaaaaaaaaguaugucuucucagaugggaaggagagucuuguaaguaagguaccagugcccuccugcucuaaggaaauagucuuauuuccuuagagcugcggucauguuauacaauucaccaggauauuagccaucguauuggugacuguuaggaacuccucacucacauccaugaaggggccugaaacucccuccaaguaguuucccuccaagcggaauagagcauugagccacugcccuguucuccaggccauucaggagcaacaaccaggugcugugaagugagucagagcauuagucauuugaccgcuacccaucucuuuugaaauugaguuugaguaacuuuagcaaugcaaucccugacaguucccccaguccuguuccauuuagaaguugccucucuucucaccuagcucuguguuuguaauccugcagcuauggccaguguuuaggugagucuuguuaaauaaggagcuuuguuaaaagugaaaaugagaggaauggaggagaggaaugcccaaagcuauauuuauuuugcccccucaucauggagcugcagggagagaacggaagcaagaaaagggauugcucacccaagauccauguaaacuacuuggagggaguuucagggcccuuaauggaauugagugaugagcucuuaaaagucaauucugccuccaauaaugggacauagucgggucacucauucggucccucauucuucuauuaaacauuugcuggacaacaaugucagacacugcauggaauacuacuuccugagagugguaaggcauacuaaaguaccugugcuccaaaguggguggcuaagacauccaaccucauugagcuuuguuuuagggaaacagcagcucagggagggccuaugaauccaccaguguuuuacugauuagagacaggggagccaagggacagcuuuuacaaaguagacucauaauuacuguguagacuaaacauaaguauaaugacacuaauaagcaauuuauuaaucccaggaauuuuacaugcguugucuuauuuggucuucacgauaacuuuaauacauaugugcuauuauuaugcccauuuuacagaugaggaaacugaggcuauuagagggcacgaaacccgcccagaugauacagcuaagaacaguggagccauccagcagcauagccaaugcucuuggccacucuacuaucugcuccccacagugugaaaagguacccccacaaagauccggcucuggaaggaaugcuuucacauaccaaacuccugaacaggcugacucuaccaaaaugugaaggcaaucaaaccaaagccggaggaggaggguuauguuugguuaucuaacuuucacuauauguucuuaggcucugagucuguaggguccaaauaaucuucacagggcagaguuaucugagguggugugugagaaagugacacacacuucccguacaggcacuggggccagcagccuggccaacagcuggcggggaauuuguggaacuuggauugccuucagaacugguacuccaugaaacaguucggcuuaucuuccuacauuuauuuuuacuuaggggaacuuacccccaugggagcucuguccccuauaggggucugaguacagaagacaagccaaaacaauggaacaacaacuccguggaaaccacagcccagcucaguucugaaagggcuuuguuuuagaggaaggcagcauuuuagugaugguaggagaacaggucacagagagcacuagcuuauggcaaccuucucuuuuuggacacauaugaguuuugcuuaugauucuuagagcuucauauugaaauuaccucucaccuacuuuacuaagaauuaggauagaauagaacacccugguagaucagccccuaaagcuaccuuuccaccauaucaugagccuaguccauuccacucauauagcuugcugaaguaugccaggcauuuacaaagugauuaguauacuccugaugagaugcgagcaaugguagaaugaagaaggcuacaucagucauaugcagaaaacugaaacuggaccccuuccuuacaccuuauacaaaaauuaacucaagauuaauuaaagacuuaaagguaaaaacccaaaaccauaaaaaccccagaagaaaaccuagacaacaccauucaggacacaggcauggacaaagacuucauaauaaaaaacaccaaaagcaauugcaacaaaagcuaaaauugacaaaugggaucuaauugaacuaaagagcaugugcauaccaaaaggaacuaucaucagagugaacaggcaaccuacugaaugggagaauauuuuugcaaacuacccaucugacaaaggucuaacauccagaaucuacaaggaaauuaaacaaauuuacaagaaaagaagaaacaaucccaucaaaaaguggacaaaguauaugaccagacacuucucaaaagaagacauuuauguggccaacaaacauaugaaaaaaagcucaaccucacugaucauuagagaaaugcaaaucaaaaccacaauaagauaccaucucaugccagucaaaaugguguuuauuaaaaagccaagaaccaacagaugcuggcgaggcugugaagaaauaggaauucuuuuacacuguuggucggaauguaaauuaguucaaccauuguagaaggcaauguggugauuccucaaggaucuagaacaagaaauaccauuugacccaacaaucccauuaauggguauauacccaaaggacuauaaauuauucuacuguaaagacacaugcacagguauguuuacugcagcacuauuugcaauaacaaagacauggaaccaacccaaaugcccauccgugauagacuggauaaagcaaaugugguacauauacaccauggaauacuauguagccauaaaaaugaaugagaucauguccuuugcagggacauggaugaagcuagaagccaucauccucagcaaacuaacacaggaacagaaaaccaaacagugaaugcucucacucauaaguggaaguugaacaaugagaacacauugacacagggaggggaacaacacacacugggaccagucggggguagagugugaggagagggagagcauuaggacaaauagcuaaugcaugcgggccuuaaaaccuagaugacagguugauaggugcagcaaaccacaauggcacacauauaccuauguaauaaaccuguacauucuguacuuguaucccggaacuuaaaguaaaauaaaagaaaauuguaaaaccuagauacauguauaauaaacuacacaguugcacauaccaaaaaaaaaaagcuagaucaucaaagagccauaggucucaauuuacaccuuaaccugcauuacugagccccuauagcugaguuuucuagucugccagaacuucuuacaaguccugggaacagggaauucaagcuaauuuacaugguugaccgaauaccgagcccaucucucaauucuucucacaacauaauagcaaagugauugauacagaacaguaguagaguaugagauguuuaauaaaugaaugaauaaauaaauaaauaaauaaaugcauauuugaauuauauacauuaggugaauaaaugaauaacaaguaauaaauaauaaauuuaaaaggacggaugauuucugaugacagacaaguaauauauuuaauaucuaauuuuguuagaucugcaaguucauuuucagcaauggaaaagaauaaaugaaauccacuuguugauaauguuacaauuugugugucaacaaggccucucucaccagucagcacacgguacuuacuuuaugcauuauauuuucugaaaacuuaucuucccaugaaauacaagguugcauuccagcagcugucuggccaugcacauagacaacugccugcucuggcucugcccacucauaagaggggauagaccaauggcugggauggugggaaaugcaaagaaggagagguaacugaagaacuauuuuggaaggguuugugaaagagcucaugcuauaagguggaaauccacuggauuucaucaaagggccauggcucaccauacccaucugggcuuugcaugcugugugggggcagaacaaaugaucauccuugugcucaauuuccagggcucugcuguuaagcagaagaaauguuuauuugaaauucgucaauacauugugcuucucuuugucuucuuuuuauuuuaaauuccaguaaaaugaauuauaauaucuuuuauuuuaaaugacaugcauaauacaaucuugaauuuguaaaauucuagauguaaaauucuagauccuggauaaguagcaagaacaguggaaaugcccugacuguguagagcuuauggucuugugggugguggaaagauuccuggauaaguagcaagaacaguggaaauccacuguggucagguagaaaauaguguuaucaucacagcaaaaagugggaagccugaagacgccauaggaauugggcccgggaaugggagaaaaucauacuagagauggaacaaaggaagaaaugauuguacuauucuaagucaauguuuaguucaaaaggugcugugaagaccagcagcagcacagguagaaugaaagagcaaaaauuauuucuugucuguggacuggaguggagcgguuauauauuugaagaauuaggacuaagcagcuaggacaggaaagggaucuuuagaggggguuugaggcauucaguuggccuguugcaacucuguaaggacugccuccacagccaggauucuugguggccaccaggaauagaauucugagaaaaacaugccauggcuguguagagcuuauggucuugugggugguagaaagauuccuggauaaguaggaagaaucuggguuguggucccagcuuuccuacugggcugcccugggcacauucaccaugcccaucugggcuuugcaugcugugcaggggcagaacgaaugaucauccuugugcucaauuuccagggcucuucucuuaggcagaagaaauguuuauuugaaauucaucaauacguugugcuucucuuugucuucuuuuuauuuuaaauuccaguaaaaugaauuauaauaccuuuuauuuuaaauggcaugaauaauacaaucucgaauuuguaaaauucuagauguaaaauucuagauccacccauuuaugcaggcuuccaucuaacaauauauauugaaagagguaugacaggggcaguguucccuaaauuuuguucaguuagaaaauucugagucacuuaaauuuuaauggaggggcuauguuauuucuacaaauauaauaaagacuauuauuugcauaaaauggaauaaauuguuaagaaucuaggucagagaaagaguguguaacuguggcaguggggucuugggaaggggucuguguaugugucacuguucuuagguuccugggguugucuucucuucagguaccagacgugcuccaacaaugggcugguggcaggauuccagagccgcuacuucgagucagugcuggaucgggaguggcaguuuuacuguugucgcuacagcaagaggugcccauauuccugcuggugagucuggcagccgaccaaacccucaugacuccuggggugggagaggcaccuaggaagugcucuagcuucagguaagcuugagggucacacacaagccuggaaggcagcgcuggcauauagacaagaaugaaugaaugacuuaggaggauguucccgccaagagggaucuuucagguuauccaaccccccacauccuucuuuuggcagaaaaggaaacagaaccauagagccggcacugacuggcccaaagucacccaccuacucugugggaaugccaagucuuaagcuuaggccuaaugacucccaucccagugcuguucuccuucuccccaacuucugguaacuucucaucauauccaaggcugcagggccuauuugggaaccuaguuuccuguagucuuucucugggagaaaccaauccucucaugggucagagucuaguacauaguuauagacagaaaaaauaaaauauuaaaaaauuaaaaaauuaaaaaaaaagauugugcuguuuucuggauccauuuggaauuccagccucugauguuuuguuucuuucccuaucccugggcucaugccgaauaucuccugaccuagccuuccaauugacuaggagaauguguauauugucauuugcccugaugacuuacacuggguguugauaacacaaccggcccagguuuuuuuaaucugaaaaugagccaggcauuucugccuugggcaaggggauccagaagugucaacaugugaagguuggcucccucaagugauugaucucucuacaguuugaugcuugcaaggacagcuucacaggucaugcuuauucucugcaaucagacagcuuacuccacagaugcccaguggcacacaguaucucuagggauacaaagccccaaaagcuuaacguuuuucuuuuuaaaguaaggaccgauaguaaauucagagcucaaagucaccugucacuguaugauggagcagaaaccuccucuaguucuucaaaaucgcuuccauaaagcagcuuuuacuccucuacagugggugaacaggccuggcaaaggauuacgaugccacugggauagguccugaaccaaagaccuaaagaucucuugcaguggaggagguagaaggagcaccaguuugggcaaaaagaaacuugaguuucagucucuguguuggccuuuccucacuucccucccuucuuuccccuuuccccuucuccccucccucucauaacucugcaggcucaagcacaucaccuaaaaugaugaccaccuuuuuugagucuccaagaucuuuaagacucugaugaaaacuauagaccuugucuucaggggggaaaaugcacuuagcauguuaauacaauaguuugcagagaauuucgggaguccuuaaacucccugaaggccauucaugaacacacugccaagaaccccuggaucauaaguugaaauuccaaggacuagaagaucuuucagguuguguugaacccuaaaaaugucuuaauuccaaagacacuuuuggaaaagaugauccagaugccagaacuguuuugagaggaugaaggaaguuccaaagacgagugcgcccuaaugaaaggggagaguagguaggagcuuggccuccacaaaucucucauuccuggucuauuaacagaauggcacuucccacaaggaaaccagccucccuuuguugcaaagcauuaaaagccaguuaaaauguauguaaauuaccugaaagagcaagcaaaaccuaauacucagucagugaauuuauuuacuacauuaguauaacuuucccugaaucagacuccaaaggaacacaucagggcugggguaugcuggguggccaggaggaguggguucaggagcaggggaaagagugaggaggugaggagguagcccugcacgggcugcaguggggaggaaggggaacauggacagccuaggggcagcuggaggccuggauguugguggcucugucucucugcccuucguagaugccucugucacagcacuuuaugcauuuuaccaccuguguacaguugcuccucucuaccuggacuuccagugucuggaggauauggggccacucacugaucuuuguauuuucaaugcccaguauagugcuuggaacauagugucuucuuaacaacuguugaacaaauauccacauuaauaauuguggaggguguauauaaugugaaguggcccagaaaauauaauucucuuacauaaaauuuuuuguucucucccccaucccuccacuucugcccagaauauaagcucuacacaagcagagaucuuugugcugacauaugccaagcccuauaaauaaugacaggcacauaacauuuguuuggaugaaggaaugacuucaggcuacuuuuuguuaugagcauuaaauaagauaauauauuucuggccuugccacugucuaugaucacacagagcugaccugucuugaaacagaguccccuucacccucccagaugcaggagagacccagccuccucaccaacuaacaggacauucaaaggcaaacucugcccaggaacaaccuagcaggugucaggucauugcaggaagcagaacuugagagcgggguugguuaugcagaggaacaagacaugugaccaguuggacagucuguuguuagauguacuaacucauucuuccccaggcagagaggaguaagcugaggcagcaacauuccucaucacagcaaggcucgaggucucugcagagaugagugggagagccugcugugucuguggccaugccaucaugguuggcuggccccugcccaaacagaacaacaacagauagugggcuugggccucaaggcuuugggugaccaggcaggcaaggagcuaaggcucacugguuuuagaaaauuugucaaggccgggcaugguggcucacacuuguaaucccagcacuuugggaggccgaagugggcagaucacaaggucaggagaucgagaccaugcuggcuaacaugaugaaaccccguucucuacuaaaaauacaaaaaaaaaaaaaaauuagccaggcuugguggcaggcaccuguagucccugcuacucaggaggcugaggcaggagaauggcaugaacccaggagguggagcucgcagugagccgagaucacgccacugcacuccagccugggcgacagagcaagacucugacucaaaaaaaaagaagaagaagaaaaaaaaaagcaaaguugucaaacagaagaaauaggggguggaugaagguaagugugagagaaagggauaaacaucuaaauuuuccuggaauucccauauuccguggaucugugggaucuguguuaacacucugagcauugcuucuugaagcuuauccugucuguuuauuugaaugcugagaccugaaaaagacaggucuuuguguuuccaguuccaccguuguuuuaaugaugccccagauuuccaguggucaccuggagacugguuccaggauacuucugcuuccccaagaaugcuagguaucguuccucucacauacuuuagaaaggcuucucaagcucccuuagaugcaauucaccagcuaagaugcuaaaaauguaaugaucauauagacauauauguaggaacaaagucucaauguuaaagauugauagauaaagaugagcaauuuugaguugccagagauauucaugucucugcucacaaaguuuacccaaagccuugaucugcaaugacuuugccacucugaacccaccccaacccccauacccuuuacccuuccuuaccccauccuaccauccagacauguugcuguuggucuguggagccaaaagguggggaaaguacagagaauuaauccaaaaggcaugacaagucaacuuugaaacaagucccacuaaggugugguuccaccugcugguucuauuucugaaggcaugguguuagagcugagagcuaucacggucaccaaauaaaaugguauuuuuucaaagaaaacauuggagaagcagcagaacaagauucaagugugcaccaugguacacaguguaugacucacuaucccgcuggugugucuagacauuuuaguggcaucuuuaaauugccugagucaugauguuguauuauaugucuuucuaaaugccuccagggcauaaauuaggucuuauuuuuucaacaucuccaggauauuacccagcacaaaauagacucuuaauaaaugugucagaugaauaacugaauguugcaagccccuaggaacaguaacaauggugaaaccugacauugaugugaugauguuuuauaguugacaaagacuucuuucauguacauuauuuuauuugauccuuuuaacagccuuacagagugaagugagaacucuuuuuccugcaccuucccacagugaaaugcugauaacccucuuaucugaaaccuucccuuacaugacuuuaauuagcuugaauuaccucccagggaacuggacccaugugggugggaacgacauuuuuccccuucccucuuugaaaggcauucuucagcacgcagccugacaccguaugaacuagcuaagugaauaucuagcgccugcguuugugagcacuuagggauucagaaauaucaucacucugggcuggaaaaaacaaaucauccaaccaacucccaaaugaguaugagauuuauuuguuuggugggaaccaaggugcugcucucguuucagcuugugcgguuucucuuuggauauuacagccucacuggacucuggcaagaaagcaaauuccugagagauguggacaugccauuaggaaauggucuccacuggauuggaugaauagugaauuuuauagauauuuauuuagauaugaaaauucuaauucuuagucuaguggucugcaaaccacaaacacaugucacugaaguugccacaacccuuuagacauuguuugucauaaucucucuucuccaaacagcucagcagcugcaggcugcacaccagacugucuacuguccaggcggagacucugugucccaggaucugaugguugugaaucauuuucuuuuccaaauggcucuucuccagacccauggccuuucauuagguucauuggauaauaucuuuugacuguaaaauaaugcauccauuuagguaaccuuuacuuuucucuucaacccugauauucugucucucagacuuugcauucuccacugccuacuuccccacucucugugugcaagucauaagccagagagugcuuuuuuuaaauuccuguauagcucuaguuaacaucaguugauuagaacauucuuaucucucccaccccaaagcacccagucaaagcuaaucuuuaauucuuagccucuuuguucagauguuaauacaagauagggaguguuugcauguucacuccuguaaugcuguuuuagggacaugaacaaucucacaggccucugcauugcugugccugucauaugccaccugugcccagacagccuccugcaauucagcucccagaggccugguaagaagagcagcuuccauuagguauaucuccuaauguuaguuaacaggugcagcacaccaaccuggcgcauguauacauauguaacaaacugcacauugugcacauguacccuagaacuuaaaguaaaauaaaaaaauaaaaaugaagagcagcuuccauacugguccucugcgcaagcuggaagcuauuacuauagagauggacauacuuaaguuuugaggaaauuggacuagaugucucaauuuaaaggaacuuauauuggguuuagaugcucugcgcccuacuaaaaccauugccuuccauugcaugauguacauagcacucauugugcagacagcagccucucugaacuugagcaaaaucuaucaucccuuucaucugcuggaaugguuuccauaauuauugugccauauuuaaaauguagacauguacaauuggcacuccauaucugggguucccuauccaagaauucaaccaacuuugaaucaaaaauauucagaaaaaaacaauaaaaauaaaaauaacaauacaacaauaaaaaaugauacaaauacaaaaccauauaguauaauaacuacucacauagcauuugcauuaucuuagguauuauacguaaucuagaggugauuuaaaguaaacaggaggauauucauagguuaugugcaaaugcuacaccauuuuagaucaaggacuugaguuucugaaaauuuugguauccauggggguccuggaaucaauccccugcagaugccacugaugacuguuguauuaguccauucucacacugcuaauaaagacauacccgagacuggguaacuuaacaaaggaaacaguuuaauugacucacaguuccacagggcuggggaggccucaggaaacuuacaaccauggcagaaggagaagcaaacauguccuucacaugauggcaggaaaaaaugccaagcaaaagggggaaaagccccuuauaaaaccaucagaucucgugagaacucacucacgaucaugagaacagcaugagagugaccguccucuugauuaaauuacuucccacugggucucuuccaugacauguggggauuauggaaaccacaauucaaggugacauuugguuggggacacagagccaaaccauaucgacuguauuuggugccugcauuauaggugauaccucucuccuuauguucaaacuucaaaagcagaaauaucauagaugugucuggcuaaguauugguuaacccaaggccagcuacuuagaacaaaguaaaccucucaguuacaaaccaaaucugaugcuuuauucuaucuagucugcuucccucuacuauaauagauucuagaggcaaucauucuuacuucuauuuauuaauucacuuaagcagucaaugaaugugaauggauaugaaauaauaacaauucauaggcuuugggugagacccuacuaaugauaaugaugauaauaauaauauuuauuuauugacacuuaccacguguuccuguguuacugcauuuaauccucacacacaaaaauuaugauacuaucauacagaugagggaacugagcuauagaaguuguggcucccuucaaaguuccaaacuugacucaaccagucuaucugccuccaaaucccaugcucuuugcauaguacugagcugucucuagaugaggaauaagacuucuacaggugaaauauuacauaauagcacaguaggcaucugguagaaaacagagaauaaaacuauuuuaauuggaggggagcuguugaaggucaaguagcccccacugacaugcaggcccagggugaccaccacauaauguggcuaaugaaaaucaacacgagucaaagugaaugugcuuacugacuagcccugggcuuggacagugaguuagaaacucaguuccaagagagcaauuuggaaaguguucagggacuuuccucuacucauuuaagcuacagauaucccuggaacuguuauucccucguguugugauacaugucugaaauguuugaaauguaaagucccaaaaugccauaaaaggacagacauggacauuuguuuuuauuucacacaccucagagccccuggguucagauuuucugugcagagaagggcacuugggugacuaccagaggucccgcuuggccaauccccagcucuugugggaagaagccuggggauuguucucuguggcuguuuuccuuuacacauaacuccauuugggguuuauuuuuucugucuuuacaaaacuaauucaaagggggucugauguagcuccuaauaaagacaaacuaaauuaaucugaaauauguucauuccuuauagcuuacuuggaaaagcauuaugcaagaggauugaucaugaacagacuggcuuuauuuaacaaacuucucaaugauuugacugucagaaagggacaucuuuuuagcugaauauauaaaacguaagccaaccucaacacaccaaauccgcaaauguugaguuucuccuccaaacccaccucugaaccagaucauaaaagcauauuugauuccaugcaccagugaucccucaaagagcucacuauauuggccaucaugauguuauacaguauucuauuaucuugcuaaauauauagugcugauguauuaguccauuuucauguugcugauaaagacauacccgagacugggcaauuuacaaaagaaagagguuuaauggagaacucacaguuccauggcugaggaagccucacaaucaugguggaaggcaaggaggagcaagccacaucuuauguggauggcagcaggcagaaagagagcuugugcagggaaacucucauuuuuaaaaccaucagcucucaugugacuuauucacuaguaugagaacaacacaggaaagaccugcccaaagguucaauuaccucccacuggaucccucucacaacaucugagaauucaaaaugagauuugggugagacacagccaaacuguaucagcugacaugucacaggacauuugaaugggauauuuaaaguaaugugcuaauugagugguagagaaauagaagaaaaacagaauucaauauugaaugaccaacagaagcuucucuaaaauguuguuugagcauaagcugggcuauaaaagaucauuuggaagacauucuaauuuuauucuuauuuuuuaaaaagcugaaguauggcuuccucagguacccguucugaucuguucauauguaaaugcugggguuuuuuuccaguuuuuaugguagggagucuguggugugugcuuuucugguguccccacaaagugggccaagguuggggauaugauguuuccugaccaugagaugaagcuguaucuguucaugugcacaucaauuggagggaaaguccugaaagaggagcuuccaggugacaccgacuaauccaguugcccuaauuuccccaagugaaacagcuguaacaaacacaucucagugcuaugaaguuugacuuucauagaagaaaagugucuagcuccgaauaaggucucguagagguggguuuucacaaaaccuuacgcugagucacuuuaugucaaggaauagauugaaaaucuuuacuuuaacuauuaaaaaccuaauaaguucucaacccaaccucugacaaugaauaaaauuggccacuguauauaacuagauuguaucucuauuucccuuucuaaaauggaugugagagcguauaccuggacucagcucugcaauaugucuguucuuguggcaacggagccgagacaucuaucagcagcagcucagucuaugauauuguaucauagcaaacauucauugaguccaguuggaucuguuaauaauuuuagagcuucaagaaucuuagaugagaaaaauccuauaucaaucuuaaaauugucuucaguucgaacugauuucccucagcucauaaguaaaauauuauuaauuuuuuuaccaucagcuucagcugacacaagaguugugcaaguggcuuuauguuaucaaguuuuuucuuagcuuuggaacaacucucugucuuucaucuugacagcagaaaaagugcugugaagugagaaacuguaccacaagagucauucaucugaaagugcgcaugcacacacacacacacaccccacacacacaccaguaguuuugcuuuuuuuguuguuguuguuguuugagacggagucucgcucugucgcccgggcuggagugcaguggcgcgaucucagcucacugcaagcuccgccucccggguucacgccauucuccugcacagcaguaguuuuuauuaaaaauuaaguaauagcuaaaauugaauaaaucuauucaaacacuuuacuuuaggggaaaggagaaaauaaggcuucccauagaaauguuugaaaaguagacucauuucaauaaaggcaucuuccugaccugcgcucuucuucaucuugccaagcugaagguuuguuugauuguuuuaauuggucuaggaauguauggcaaugcucaguaugaaguguguuuuuccaaaaaacugcuuaaagugaccuaguaauucacaaggaauucacaaggaagcugcaaccacaccgaacucuuccccgaccuacacucgcaaagcccagugucacagcuuaggaaacccugaucauucugcuuccuuguagccucuuuuaauuuccugaaaagucccuaugcccugucucagugucuaguucugaacguuuaaauucuuuuuucucucuaaggagcuauuacugggcuuucacuuauuaggacacuuugugcgcgugugugugugugcgcgugcacaugcagugucaucaagcgcuaaaugcagccacauauaucugguuugaaaauacagaacacagcauccugggccacauugacucaauaguucuuccuauggaugguguuugggagguucacuuucuaccagugauuugggucauuucucccuugguauuuuuauuucauaaaguaggagagauuuccaucgauauccaaccuccuucccucuccuccuuuacccagguuucucuaggacagucuaaacucaaucccaugguguuauaacaaaaacaagacaaaauaacaacaaccaaaagucacacaaaacaaaaccugucugggaccaagaagaaaaaguaccaauggucaugcaccucaccuucucuaggacauucuagaaauucacuggacaucaguaccucauggagaggcuucucggacaaacuguccaguuagacagggggcuuaugucuggucacuaccaaaaaugaagcaacagagaauccuaauuaaagaaagcaugaaauaacauuuuccuucuuugaagcuuaaaacuucuugauguuuuuaaagguaagcuuuucuuucccacuuuauuccgugauauuuauccaaguaucugaagacagaucagaguggucaguaaaaacuuaaaaaauaaaaaucuagcuucauaauuuccaaauacuuuuggcaauuggauuuagcuuaaugcaguguugcuguauguagauucugccuuagcaaaaaaaagaaaaaacacacaacuugguaauuaauuuuuacacauuguauccagagaugcuucaaaaguuuuagaaaauauuuuuuguucccugaaguaaggaaaacacacacccccucccacccccaugcaaccucuuauucuaauuugcauuauugauguucucaacaaaccucucuuuccuuggguuaacuuuaauacaguccuuguuagaauucucauggaucauaaaucagugggauccaaguaaggcccuauuaguucuacuuauaagacauuuaccaugcugggcgcaguggcucauacauguaaucccggcacuuugggaggcugaggcggguggaucacuuaaggucaggaguuccagaccagccuggccaacauggugaaaccccgucccuauuaaaaauacaaaaauuagcugggugugguggcacacaccuguaaucccagcuaccugggacacugaggcaggagaaucacuugaacccaggaggcggaaguugcagugagccgagauugcaccagugugcaacagccugggugacagagugagacuuggucucaaaaaaaaaaaaaaaaagacauuuaccugaaagguaaaguccugcuucuggaucucuuuagaagcacaaaauaaguuucuggauuugcaggaccuuauuucccuucaugaacucguuaagcaaaaacacagguaccucacuuuggguuggacuuggcauccugauagagcauaauuacgucuuaggaaaagucaaaucagagaacaaggguuagugaauaauggguaaaaggaaugauuaugaaccaagagaaugagcuaaccauugaucuuucuccaucugugcacugagauccuccuaggagcccuuacaguuuauaaaucaaucuuuucaugauuuaaugacaaucuuggagaaagaucaccaucagucugcagaggagaagaucuuucuagcauuaauaaacagugaucugguaaacccaaaucagaugaaauuauugacacucacaaacuaguuguuuuccaagcgucccugggguguggauaaagacuuuggaggagcuauuucaugguaaaaggacuguuuugguccugaagguuccaguggcaaagcccuuaugagaacugggggauucuagacuuuauuccaggauggacuaccauggaccuacucauaugaaggcucaggauuuacucaauauuggaagagaaggaaaggaaaggaggaagaggaagaagaaacaaaauaguucuuagugauucaacaccuaccauguacuaguauagcacacucaucacucauuuuuauuaguuccaaugacaaaccuauaagguagacuuuauucuucuacagaucagaaaacagauucauugacuuuccccaggccauauauuuauucagcuaauauuuauuauguauguguuuuaggugcuggaugaacaaugguggacaaggcaaaaacucuaccuuuggggagcuuacauuuuaauuaaauaauuuuugaacacuuuguugacuauaacucacaauaagaaacauuaaacuaucgcaauauguacaucuuauaaacaaacacacauauauauuugaaacaaaauguuuacauacauagacucguccuuacugcaugugaugcaugcuuuuauauuuucuuuucuauuuuaugucucuuuuaaagccaauuaaauugauuuuguuaucaacuaaugaaucauaaucuaaaauuugaaaacauugucuuaguugacuugaauagaauaggaauaguauugauauuaaucaauaucaagaauuccaaaguuauuuugauaauuccaaagccuggggagguaucuucaucuuuuucagugcacaguuuaauggccuagaaaaggaagaugagaagugggaggagagcugucuguuucuucacagccuggaguuguuugguggaugucauuuaacuucagucuggauuugccaggaugcucaaacuccaucucuucuucauagugugucuucuguuugcucccagcaauaauaauguguuucauuuuccucuaaccuuuguucuuccugcauaggcuaacaacagaauauccaggucacuauggugaggaaauggacaugauuuccuacaauuaugauuacuauauccgaggagcaacaaccacuuucucugcaguggaaaggugagaaagacagccccuucccaaugggcuaggguuaaaggaguugggacuaacucccugcaaggauuuuaccugcaggaauuuauaaacacacacacacacacacacccacacacacacacacacguagaauacaagugaaaauuucuuacaugcacauauauuucugcaggaacuuugaccugagguuuuacuuaucuuaguuuccuaccuggucaaggauuaacugcaguuuuggcuggaaaaugggaggcagugggaagugagcuguucucaugagcucaccucauggagcugcucaccuugcaagugaggguggauuccagccugcucaagagcagagaguccuaaacucgguaucccuugauggucuaagcuuuuccccucacucaauuucaaagagcacuuuuccucaugaaacaccaagaggagaaggcaaauaugcuuagaggagugcccauugucaaaauggacccccuuccaccccgugccucuauaucauccccacuuuggguuuuaggaaagaagagagaagagaaagaaaagggauuggagauaagaaacacacagaaccuacugucuuagucugggcugcuauaccacauuaccuuagacuggguaacuuacgaacaauagaaauuuauuuucacaguucuggaagcuggaaaguccaagaucaaggugccagcagguucagugucuggugagggguugcucgcugcuucagagauguugcuuuauuacuguguccucacgcaugguggaaagggcaagccagcucccuucaacuuauuuuauaugggcacuaaucccauucaugagagcagagcccucauggcuuaaucaccccccuaaaggcuccuccuccuaauacuaucacauugaguauuagguuccaauauauaaauuuuaaggggacaccaacauucagaccauagcaucuaccaaccauauuuagaaaugaaaggaguuaacaaucccucaguaaaccugcaaaaauuaaugaaagaagagaauuuaaauggccuaaagauaaaaacagcacuaacacuuuuuucaucaccuuucucucacaaucaacuccuuaauccuaucucaaauacaucaaaacgguaagaagaaaacaagaauuguacucccuauuaauauagagaaauguguggguaaauucagguguuaaugauugguuuggccuacuuuuagucagccgauaaucacuuuacacagaaaugaauuccugaaaaguuaccaauaaauauuuugcaaaccaaauaacacuuacauuaacucauuagauaguaugcuaugaugaauuugagugugacacaucuuuggugugugucuguguuuucaaacagaauuacaucuuaaauaaagugaacuuauuuaauaugaccuagaauuucuuuuuuuuuuuaaaaaaaaaaaaagacauuaaguagcucuggaaaggcacaauauauguugcaggcugaucagcaaaaaccuuuauguuuacccauaggcaaaccacucaguuugcacacauuacuuauuuuuacuuuagauacacuuuaaacuagcuuaguuaccaauuuucuagaagcagcaaauuagaaagggaaacgaguauauacuacuuagaaugaaacucauuccaccaaugagaauaaauagcuggaugacaugauaacaaauaugcuuaagaaaaauaaagaaaaugaaaggcucaagaacucaaagaacauggguugucauuuagcagggccaugcuccccaaagugcaaaacgaaauaacaggggugcucaaugcuccaaaugaugacuucagcucaacaagaaaauuaguucuauguucccuguuuaagaaagcaggaauuaauacaguaaaggaagagugccauccaagauuaguaugaaauaaauauaucugaguaguuaaaaugcucaauucaguuuucaguaaauucacuuuuuaguaaauuuuucgguuauguggauuacccagaaucaugaaaaacugaaauauuaugucauugcauuaauuuaaaaugaguauccuccccccaaaauaaaauaaaauaaauauacucaugcaacuuugcuacugucaucaaaaauaaguagcuuaaugauccacaacuuggguuucuucuccucugcugaaagaugcugagguccccagcuuggagaacuauugucagggcaggacuccuugugcaagagcuuucccuccacaugcaaaucauagugguuuccucuuagaaugcuguuguuccaucuaugcgcuauugacaucuagggccagauauuucuuuguuucagggucuguccuuugcauucuagauguuuagucuacccacuagaugccauuagcaccccacccuaaccaaaagaaguugcagacauugccaaguauucccuuggggagcaaauuugcccccacuguccuggugugaaaucagagacugaaccugguggaaucauuuggucuucauaagaccaagucuaaguuuugcucagcaucaauuaauagccuucuaaaagaguaguuugaaugccugaucauaagaucuuguuuaucuguguuuguugcuacacagauaaauaagaccuggcugcaguaauuacagacauuugguaaacccacaggccaccaauuuucuaauuuccuucuaaaacaaucuaugaccucuuuugacaauugcaggaaucaaaauaucacccaggcccugguaucacccagacccucaaguugaucacccagauuuguguugagggacucuauacccaauuguucuaaacaaacgacccggagcaacagacucagaauuagaaagccugccuuaggcuguuugagcagagugagcccugcuuccuaggacuaagagcaaucagccccacuuuucaguuuagaagcuggauggaggccuuguuagucauaguguuuaggauaaauuguugaaaagagggcuugcagauugaaaagggagauagauaauucugaguuuguaaaggaccccaccaagcuuuggaaugauuugcauaauuaaauauggaaaaacucuucguuuuugcccuuuaucaggacugugcaaagggcauggcagccacguguucuucugggcuuaagauuaccuaguuaggcagacugugugguuuaagagaaagaccaagauuugaguacaauaaacugcgaaucugaaauugucaccuauuacuuguauuaccuuaaagcaaguuaauuauuucucugagccugguuuuucaccuaaacaaugaaucguugugaggauuaaaagagaaaacacguaaagcaucuggugcaaugccagauauauuagaggcuacaauuaucauuaucacuguucaacaguauuagaccacaggagugucaugcaauguaggcacucaaaacauuucucuuaaauggaugaauaaagaacauaaauucacccugagcaaagaacauuccuugaaauguauccacaccacauuuuucaaaauuuaguaaugcuauguacacucuucccauccccaaccacuuaaacacauaggcaauucauaacaauucuugugaugccagaauggcagccauuuucuuuuuuaauuuaagggacuuuuucauuccucuguagcaguguuuucugaagggaaacacauguauagcacagagcccagugcauggugagcacucagcauauguuaagugcucagaaagagucagugggaaaauggacggacuuuuuaaaacaagauuuuuuucuuuuuuuugagacaggguuucacucugucacccaggcuggagugcaguggcaccaucucgguucacugcagcuucaaccucccggacuccagcaauccucccaccucagccucccaaguagcugggacuacaggcaugcaccaccacacccagcuaauuuuuuguauuuuuuuguggagucaggguuuccacauauuggccagacuggucucaaacuccuagccucaagcaauccaccugccucagccucccaaaaugcuaggauugcagguguuagcuaccaagcccagccuaaaacaagauucuuuacaaugaaauggagaugauguuaaauaaaugcuuuuauuccaagcuguuaacccacagguccuugagguacuuucuggaggcagcaggggugagcugaccaccagugaugaacagaggccuccacacagccagugaccuaauuagucaccuucaagggugaccugaacucacagauuugucgguucuugggaaacugcauaaagaugucuucuaagagcaaagugagauuaagugucccuucaguucccagauccuccaaauguucucugcugcuguuuccccagcagcgauucuuccugccauguccuuucucacugacauucauuuucugacucucccucccacagggaucgccaguggaaguucauaaugugccggaugacugaauacgacugugaauuugcaaauguuuagauuugccacauaccaaaucugggugaaaggaaaggggccggggacaggaggguguccacauauguuaacaucaguuggaucuccuauagaaguuucugcugcucucuuuccuucucccugagcugguaacugcaaugccaacuuccugggccuuucugacuaguaucacacuucuaauaaaauccacaauuaaaccauguuucucacuuuucacauguuucauagcaacugcuuuauaugacugaugauggcuuccuugcacaccacauauacagugcgcaugcuuacagccgggcuucuggagcaccagcugcagccuggcuacugcuuuuuacugcagaaugaacugcaaguucagcauaguggaggggagaggcagaacuggaggagaggugcagugaagguucucuacagcuaagccuguuugaaugauacguagguuccccaccaaaagcaggcuuucugcccugagggacaucuucccacuccccugcuccacaugagccaugcaugcuuagcaauccaagugcagagcucuuugcuccaggagugaggagacugggaggugaaauggggaaauggaaggguuuggaggcagagcugaaaacaggguuggaaggauuuccugaauuagaagacaaacguuagcauacccaguaaggaaaaugagugcaggggccaggggaacccgugaggaucacucucaaaugagauuaaaaacaaggaagcagagaauggucagagaaugggauucagauugggaacuuguggggaugagagugaccagguugaacugggaaguggaaaaaggaguuugagucacuggcaccuagaagccugcccacgauuccuaggaaggcuggcagacacccuggaacccuggggagcuacuggcaaacucuccuggauugggccugauuuuuuuggugggaaaggcugcccuggggaucaacuuuccuucuguguguggcucaggaguucuucugcagagauggcgcuaucuuuccuccuccugugauguccugcucccaaccauuuguacucuucauuacaaaagaaauaaaaauauuaacguucacuaugcugaaaauau

SEQ ID NO: 12935 - RNA, 27230 nt, Homo sapiens
cuauaaugugugcuacacacugagaauucaaauuaaagauacgguuuuuucuuacaguucuacagucuuccuuuggcuuaaagacuccuggaaauacagacaugaguaagagacaacacuagauuuauuaaagaucauaaugcuaucauuuauugaagaaagaaagcaaaaaaaacuaacaauugugaugggggaggagagacagcuuggcaacauuccuuuuaaaguuaaguuagcauaaagaaaacaauauuuaguaaaugaaauagauuuucaagguaggaaaaguaguacucaagaauguauuuuuggauacaaaaauucaguuacacaaucaguagcauucaaaauuaguuaugaguauuuauacaauuacaaaaauggauucauguuuuaacaacguauuuuaaaagcucaaacauuuuaaaacaggcacaauauucuaaaggcauaugcauucaccaugggcuuuugaauguccucacucccaacuucacaaucaaaaucuacagaagcggcaaaagaucagaguucagagggcuauuuuuuuuuucccuuuccuuacuuaagguugcaaacacauugacagaggcaaaauaaacacguuucauagcagaaagaccaaaaaauugaauguaaaccauagcucucccuugggagauuacacaaauacaagguucaucuguacuuagaacaaggcucauaacuucuuguagcauggacauucaacaggcacagagcaacaacauucacccaaauaccagcugcaauuuguccuuuaaggaugccucacaaggauauuauguccagguagcuaguccauuuauaucggggaccaguuguccuuuuguuguuuguggcuguuuauuaaauguaguggcacaacuuuguugugaauauguaccaucauuugcuacaaucuagacagaucauccugucuacaaaaaaucauuuucuacauuucuaagaccauuaucaguuuaucugcuccugcuagaaaaggacauacuuuuugucaauuuacauuaacaaaggcucugcuacuccccauuuacucgcugcaaugaaaacugguaagccaaggguaaagcuuaaguaucagggacuaugaauuuaggguagaagugaaaauaaccaaaguggaacuaaauccccuauucuugagugcaacugagaucaaguaaacuucgcuggacuuucuucuuaacuauaaaacuauuaaccagaagguaaagucacacaauuuuaccucccaacaaacuuuuaaaauaaaaauuuccaaaaaauuuagaugucuagguuuuguuauaucuuaccaagaguuacacagacauaaauuuguauuuaacuucaguuaaacaucuauucacuuuuuaaaaaugcugucugcaaauaaacuacuggacaucuuaagcuuacuaaaaaaaacuuaagauuuuuaaauuaaaaaaaaaaaacuaggacaaaaaucuagcaaaugguuucacguaccuuuaaacacugauucuuaaaaauuuauaugcugaaaaugagguuugagaauacguauuuuaaaccauuuauaauccuaccgucgacucuagucagaaguuaucugagcaaagagaaaauaaagccuggcguagacagucccauagaaaauagaauccauagccacugggcugcccuucaauuucccaauucauuccacuaagucucaugaugcaaaucugucacuuucauagagcuaucaaaaacagaagccaagccagauccuccacacuuuaagauaugguuccuuauuaucuauuuuaacagaaguaucaaaaagugauuuuuuuuuuuauuuauuuuugagacagagucucacucuguugcucaggcuggagugcaggggugcgaucucggcucacugaacuuccaccuccuggguucaagcaauucuugugccucagccucccucccaaguagcugggauuauaggcgcacaccagcuagccuggcugauuuuuuugcuguuguauuuuuuguagagaugggguuuugccauguuggccaggcuggucuugaacuccugaccucaagcgauccacccaccucagccucccaaagugcucagauuacaggugugagccacugcacccagccaaaagguaauuuuauuuggaaugcauuucaugauuuuauuucuugcucccugagccugcagugauuaggguggaagggaaguggcacucaggcagauaauucacaaagucaccacacaagggugauagaugauccaccacugagauaaucaacccagugaaaaugcuacacuggggaccauguuuugcccuucccagacaagacaucuugagcuaggaucugagcuacggcuaugcagaggagcagaacugaaggcuccguuugagcccuuucugcaaaaggggaugcauuucagauaaugagacaagagacgggagugaguuaguacacagcacgcccaauacccaacaagcagccucagagagacugggagaagggggagaggggacuggaagccaucucuucuguucugaagggcagugcuccucccaagacagcacucagagagccaacagcccagggcagaucacgccaggacagugcuuccauauggcuggcugagcaccauauuccaaucugcaaaagagucaccuuauugguucccuuaacuuccaaaaugcagcaagcccuccuucacccagcagugaacggaagggaagggaaugcagggcagcagggagacagagaccaucauuaacuacaggucugaaacccuaauucuuuacucacucaucagguugcuuuuaaucacugcuguugcuugguaacagguuucagcagauuugaaauggauuucuuccucccacagucuaacaaaaacaaguagggaaacaaccaaagaauaaggcaacuuaaggaaaaacgcaggaagacccugggaggcagggucaugcaaaagcugccaaugguguccugaugggagcugucugagcaaacuggccacaggccgugagugaaagcaaagcagaagccuuucuacaagacccaucuccugccaagaaccccucccugacgccuccacucguggggucugggauaggcucuuuaccuucucagaggauggaggcaauaccauucacugggcagucacugugaauauugaaugagauaaaacauggcagugucuacagcgccgggcacauaguacuagauaaguauuuguuaaauaaauuaaugaucggagacauucacucucaucuuccaaaguugucaguuauuucugggauuaaauaacaccuacccuacugagacucuacuuaugccaagcccuauucuaagcacuugacacgucucacugacaucuugcaaugacccagcaggaacuguuauucccacaauuuuuaaacagaugaacaaacugaggagccagagguuagguaaccuguucaaaaugacacaacuaguauaugacuagucacagcucacagccagaugcaucugacuucaaagccuacauucacuacuaguaugcuauacaggugacaucuuaaaagguaccuuggccucaugucccacaaagucaauccaggcauuaaaaaggacauggggcugggcaugguggcucacgccuguaaucccagcacuuugggaggccgaggcaggaggaucacuugaggucaggaguucgagaccagccuggccaacauggugaaacccuguuucuacuaaaaauacaaaaauuagccgggugugguggcacaugccuguagucccaguuucuugggaggcugaggcacaagaaucacuugaacccagaaggcagagguugcagugagcugagaucaugccaccgcacucuagccugggaaacugagcaaaacuccauuucaaaauuaaagcaguguguagagggaaauuuauagcacuaaaugcccacaagagaaagcaggaaagaucuaaaaucaacacccuaacaucacaauuaaaagaccuagagaagcaagagcaaacaaauucaaaagcuagcagaagacaagaaauaacuaagauuagagcaggacugaaggagauagagaccacgaaaaaaacaaugaauccaggagcugguuuuuugaaaagaucaacaaaauagauagacugcuagccagacuaauaaagaagaaaagagagaagaaucaaauaaaugcaauaaaaaaugauacaggggauaucaccaccgauaccacagaaauacaaacuaccauuagagaauacuauaaacaacucuacgcaaauaaaguagaaaaucuagaagaaauggauaaauuccuggacauauacacccucccaagacuaaaccaggaagaagucgaguuccugaauagaccaauaacaaguucugaaauugaggcaguaauuaauagccuaccaaccauaaaaaguccaggaccagauggauucacagccgaauucuaccagagguacaaaagggagcugguaccauuccuucugaaacuauuccaaacaauagaaaaagagggaauccucccuaacucaauagaugcagaaaaggcauucaacaaaauucaacagcccuucaugcuaaaaacucucaauaaaccagguauugauggaacgcaucucaaaauaagaagagcuauuuaugacaaacccacagccaauaucauacugaaugggcaaaaacuagaggcauucccuuggaaaaccagcacaagacaaggaugcccucucucaccauuccuacucaacauaguacuggaaguucuggccagggcaaucaggcaagagaaagaaauaaaggguauucaauuaggaaaagaggaagucuuaaacguaagacccaaaaccauaaaaacccuagaagaaaaccuaggcaauaccauucaggacauaggcauaggcaaagacuucacgacuaaaacaccaaaagcaauggcaacaaaagccaaaauagacaaaaugagaucuaauuaaaccaaagagcuucugcacagcaaaagaaacuaucaucagagugaacaggcaaccuacagaaugggagaaaauuuuugcaaucuauccaucugacaaagggcuaagauccagaaucuacauagaacuuaaacaaauuuauaagagcaaaacaaccccaucgaaaagugggcgaaggauagacacuucucaaaagaagauauuuaugcagccaacaaacauaugaaaaaaugcucaucaucacuggucauuagggaaaugcaaaucaaaaccaccaucagaugccaucucaugccaguuagaauggcaaucauuaaaaaguggcaugguggccacagaugcuggaaaggacagggagaaauaggaauacuuuuacacuguuggugggaguguaaauuaguucaaccauugugaaagacaguguggcgauuccucaaggaucuagaacuagaaauaccauuuaacccagcaaucucauuacuggguauauacccaaaggguuauaaaucauucuacuauaaagacacaugcacauguauguuuacugcagcauuguucacaacagcaaagacuuggaaccaacccaaauguccaucaauuauagacuggauaaagaaaauguggcauauauacacccauggaauaguauucagccauaaaaaaaggaugaguucauguccuuuguagggacauggaugaagcuggaaaccaucauucucagcaaacuaacacaagaacagaaaaccaaacaccacauguucucacucauaagugggaguugaacaaugagaacacauggaaaagggaggggaacaucacauaccggggccuguccgggggugggggcuaggggagggauaacauuacauguauaccuauguaacaaacccgcauguucugcacauguaccccagaacuuaaaguauaauuuaaaaaaagaaguauuuccagaaucucauauaaaaaaagaaaauuaaaaaugcaguuuauuuauguaaaagaucaguggaacuuaaagauaaucacugagugacuuacaguaaaaauuaaaaaaugaaaaagacuaguguacuacaaaagagacuaucugaaaaaaaagaaauaucacagaauaucaaaaacuugaaugggaacaagaacucugcaguuugagauuucugauagucaugaaaaagaagaagaccuguugcauaaaaaccauuugaugcaagaugaaauugccaggcucaggcuggaaauacacacaauaaaaaaucaaauccuggaaaagaaauacuuaaaagacauugaaauuauaaaaagaaagcaugaagaccuucaaaaggcucuaaaacagaauggggaaaaaucaacaaaaacgauagcccauuauaguggacagcuuacugcucugacagaugagaacacaaugcuccguucuaaacuggagaaggaaaaacaaagcaggcaaagacugacgaaauggaaucauaccaucguagacugaauguugcucuacaugaucaugaucaaagucacucaacagaaagagaccaagagcuugauuuccagggcacaguagauaaauugcgucauuuacaggaaaauuugaauucucauguucugauucuuucucagcaacuuucuaaagcugagaguaaguccaggugccucaaaacugagcuccauaacacaagagaggcucugaaagaaaacgcuuugguuuuugaacacauacaaagagagcuaaaccaaacggugucaaaugaaggacauugaaaaaauguacacaaguggccaagauaaaguagaaaaaugcacagaaaagcaaguaagauuaugucaacuacgaagacaaaauauguugcuucaacagcaacuggaugauguucacaacaaagcugacaaucaagaaaaaacaguaauugauagucaagccaaaugugaugcuacagcacaaaaucuucaagcugagugcauaaagcaccgucuuuugcuagaagaacaagaggaugaucaauaaaguuaaucauuugaaagaaaaacaaugucaauaugaaagagagaaagcagaaagagaaguaguugugagacaacuucaacaaaaacagggugacguccuaaacaaucaacaacaaaagcuuugcuggaugcuucauugcgucacugcguccauugagaaagugagauguaggauucaaggaagaaauuaggucagaugagaauucaauuucaagaaaaauggaaucaacuuacagcgacuauaaaauguacuaaggagacgcaaggccacguacaaaaacuugaaauagaaaauucuaguguuaagaaauacaauuaaaaagcaagauggccaaauugagcagcuucagaaaauccugcgaaguucaaguuugaugcagcaguuauugcaagaaaaugaaacuacagaaauagaugaagcuucuucugaauuuaaaucuggauccucuguagcagagguucccaaccuacaggccauggacagguccaugaccuguuaggaaccagcugcacagcaggagaguuacuguggaucuucuagaucaucugcaugccaugugaaucuuaaaaccaguuuuuaauuucuacaaaaaaaaaaaaaaaaaagccugcuuggcuuuggauggggacugcauuauaucuauagauuaauaugggaaagaauuaacaucaacaauguugagucucucaaccuaucaacaagauauuuacuuaggucuuaauuuuucuuagcaaugcuuuuuaguuaucaguguacagauaauccacauaguuugucggguuuauucccaagaauuuuauauuuuaaugcuauuguaaaugguauuauuuuuaaauuuucaauuccuaauucuuuacuucuaacauggagaaacacaauugauuuguguauaucaauuauauauccugcuguguugcgaaacucacuugcugguuucaguaacuuaguaauggauuugauuugguuuucuacauagaugauaauaucugugaauagacaguuuuacucauuucuuuucaaucuaaaggccuuucauuuuucuccuucccucccucuuucccccuacucccaauuaaaacaugauugcaguggcuagaauuuucaguacaacguugaauagaagugguaagaguugacaucucugucuuauucucaaucuuaggggaaaacauucagccuuucaucauuacauaggauguuagcaguagauauuuuaaagaugcccuucgacagguugaggaaauucucuuguaucccuaguuugcugagauuauuuuuuaaacaaagcaugguuguucaaucuaaaaaaaaaaaaaggacauggacauggagggaugagccuucuaggugucuuauuccaggcugcuggagcugcuggagcucacagugacuagccaagccucguaucaguucuaaagaaaaggaaccaugagcccuccugaccuccuccaugucccuucugacaccacagcccuucugagaucugucuccaagaggcaccugggaugugaaagaaucccacaaaagccagagggguagcauaaaauuuccuuuccuggcugaggacagguuagugaccugagcagaugacuggaugucaucaauagccuagaaagaaccugggaagacuagcuccucucucuggccccgucaggcuuguucacaccuccccagccucagaagaaaagaucagcagggcacaguggcucacaccuguaaucccagcacuuugggaggucaaggugggcggauuaccugaggucaggaguuccagaccagcuuggccaacauggugaaacccugucuccacuaaaaacacaaaaauuagcacgggcgugguggcgggcaccuguaaucccagcuacuuggaaggcugaggcaggagaauugcuugaacccgggagguggagguugcagugagcagagaucacgccacugcacuccagccugggcgacggagugagacuccaucucaaaaagaaaaaaaaaaaaaaaccagucagaguucuuagccacaguaggacaaagaaagguucagcaauuagccacaagaaaggggacaaccagcaggccacuuccuuugguuuagcagugacagaggaggagcccuaguggaccaguuggcccugugcaaagaacagaaaggcaauccagauaaacgucauuuguaggaugacucuggagguccuggagggccaggaaugcuggcugacaagacagggcacuaaucguagucaggcaacaaggaggagcugaaagggaacacaagggacagugaacauccugcagauccaggaagaagcuuccaaaagagaugggcagggagggccagggaggagauggcuuggcugaugaaaacgagggaaacagucacaggcaguuacaggaggcacaaccagaaacaggccaggaaacucuggggucaugaaggaggcugaagcuguggcuuuggguggauccaaaaaccagugugggccuugauucccuugacugcacagugguauaacaaucccugcuuccucacaaggcucuccauaagaaccagguaagaucguggacacaaaagcacuuuguagguuaggcaucaggcugacaugagaccaccugcaguuuauccccaguguccccagcacaggcuaagugcaaacacugggacuauuuaaaggucacugggcaggcgugccuacuuccugcuggcugcacagcagggaucugucuucccaccccacucuccccuggcccaacuccaggggagaauggaaaauaaaaucaguuuaaaagcaaacauuuauaaauaauggagaaaaaaauauagcugagagcagcaggauuuuucaacuccuaugggcucucguccaaaaaaaaaacagcagcauuuucugcugcugcucuguucuuuccccaucuagugccaggaggucauaaagaaagauaugcagggagagggagggagggaugggaaauaaaacccaagagaaaaagagucugcaccuaaugucagaaaauacauuccacagucaggcgcagaaucagaacaccaagaaugcuuagauucaaauucagaaacagcauauaccaccaaaaagugcuucuuuucuaccucacuccauggccaggcucuccaggggcuugucuaaagcagagucacuuguucucagaugccagaguagaagcagacucacucuaugcaggaccacggugauggcuuccaugcugagggacaaguggaccccaaaacucugucccuuacuguugcucccgugaucucugauggggcugccuuuugccaccugggaaucacuugcacccaaggcuuaugugcuguugcugaauagguuuguauucaugggaauucagugggacaacauccagagaggaaacagguacaugaggaagauuccacuccacaagauacagaacccacuucucauccugugcuacugacauucagguucgagaauguauuguugcuuccaaaaguaacccucaaauguucgaaucacaagcaacacauugcugcaagauaaaaggcacaugucuguaagacagagguuucgaagauaguuacaaaacuguccaccagcuucuguccauagugccuuccaaagcuucauaaaacuggccaugaauuaugcaagacacacggcaaaacacuucuucacagcaucccuaggaaagaaaagacacaaagaugaguggaacgucaucaccccaaaggcacuccuuuagagggcacccagaguggaagcugcagaguagaaagcaccuagacugaaagaucagaccuucacagcaucaaacugcagcuucaacauuuauuaguaguacuauccugggaaaguuccuuguccuguuugaguuucaaauuccucaucuguaagaggggauguccccacuuacccgacagucugauuaugggauuagccaucauaaucagagaaaaagauaacauagacugucagaaacuaagaaaucagucaggauugcugcacuuuaauaucggucaaaaucacagaaugcacugacagcauuaaaucaaauauuaacugggaccuuucuucauucuaagcaggcagcagaagggagcucacuauggguccugagcacuuauuaauaugcuauaauggccuuaucacagguauuuacugcuuggaauucaguguagagggugcaaggaagaguuggucuucaagaaauuacuauucuacccaagcaagcacuuccauuuccaccaccacaccacacugugcaauguggcacuaggcuucucauaccccagcucuguuccacguucucaacugugcugcacuaaggacauugggagucacauaagggagggagaggugaauggaugcauuuccaugaguaggcacugcauuuuaauaucaagaugguuccagggcagcauuucuugagauauacucugcacuguagucucagaagagucucugcacaagaaggguuuuauggccacauaagucccccucauggcagcucacaauacacauagcauauggaaggaucuagcaagccaggcaaagaggaaccuaccuaauuuugcuuaaccuguuucucaaacuuacuugaucauagaacucuuuucuuccacagaaacacuauuucuguggaacacugugggaaaagcuauuccaggggaacuuacaaauagaaggguggggccaggcauggugguucggaccuguaaacccagcacuuugggaggccgaggugggccaaucacuugaggucaggaguucgagaccagccuggccaacacggugaaaccccaucucuacuaaaaauacaaaaaaugagccuggcaugguggcgugcacauggaggcugaggcaggagaacagcuugaagccaggagguuggagacugaggugagcugacaucgggccacugcacuccagccugggccauagagugagacuccaucucaaaaaaaaaaaaaaaaaaaagaauagaagggugggaucuagcucugugauucccucccuacuagaggaguaauucgucuccucagcacaugaaacucacuaucucaaauaaaauucccucauucuaucaaucacuuguacauaaauuuuauacaugccaauccagaucaagacugaagcucugacaaaugacuccaagcaaguuucacgaaugagaccugugcaacugcauuggccccauacucagaaggguccacauuggguuuaaugccuugauuugauguugccaucuugaaauucuuaaucuuuuuuuuugagacagagucucccucuguugcccaggcuggagggcaauggcgugaucucggcucagugcaaccuccgccucccagguucaagcgauucuacugccucagccuccugaguagcugggauuacaggugcacgccaccacgcucgguuaauuuugguauuuuuaguaaagacaggaguucaccacguuggucaagcuggucuugaacuccugaccucgugauccgcacaccucagccucccaaugugcugggauuauaggcugagcuaccgugcccggccuaugauuuuugaacaagaagcucacauuuuuauuuugcacugggcccugaaaacuaugcagcugguucagggaccaaaaaauauucauauguuggcagguugaucaauaucucauuggauccucaguaaugaugaacuccgguuuacuucacauaaaaaucuagcuucccaggacaucccugcccauauucuucucagacaagccaccaggccccaaaaccagccaggucugcauggaguauuucauaacuguuacccuccuagaaucuaucaacaaagccacucagcugccuuucacuugaaaggcuuaacuucgcauccaaucaaucacuccucaauacuuucaaaucacugucagcaacagucuuggaauuuguuaagacauaagauugcucuuccuccuucccaagucaugcauaauuuuucauuuccucaguacuuuuuuuuuuuuuuuuuuugagacagagucucgcucugucgcccaggcuggagugcaguggcgccaucucgacucacugcaagcuccgccuccuggguucacgccauucuccugccucagccucccaaguagcuucgacuacaggcgccugccaccacgcccagcuaauauuuuguauuuucaguagagacgggguuucacuguguuagccaggauggucucgaucuccugacagcaggauccacccgccucggccucccaaagugcugggauuacaggcgugagccacugcaccuggcccaguacaguuuuuuuaaaaagcuuguuuuuaauuaacagguaaugauaaaaaaaaaaaaaaaagaacagaaguuaaauaguugcauuagaacaaagucagaggcaaagaucaugcggcuaauuuugagagguccgucacugaaagugcuuaaagagguauggaguauuagaauuucagagcuaaaagaggccucuggagaugaucuagaccaacucagucuacuuaucgaugcuuugaggccagaggggucaagagagcugcucgaggucacacugcuaauuaggaagcccugguacugcuuacucucccuuuauaaacucuugugaaaccuucccagcagugggauacugcaagaagcacgaauugagaucccuccauaucuuacucagugauaugaaaugacauucaccuuuauaaaaaaaaaaaaaaaaaaaacccuacucaaagcuacggguuaaaagaguaauaaugugcauauaugcaccauauauaagaguagaauguucacagcauuggaaaucaguguaccuggguaaauauccaucauuaguuguauaauuagagugggugguggggugaccuuuaacuuacuuaucuauaaaugagauguauaguauuugucuacuugacucaaaagacuucaguaaagauaaauaaaauaggcuauacucucugaaagcagacucugaauuaaaaugacagaaaucauuauuuccaaauacacagucuuaccuugcaaaugguaugaaggaaaggcuguaccuauaaugaaaaacaaaacaaagggucaaaugagaugaagggaguagcagauuauccagcagaaugggcuucugagcuguaagaauaccugcagugaucuauccagacccucucccauacucagccugggggaugagcaugugcacacaaaggcccacgcaugugcaugcacguguacccaaacacacacacuauggccauguacagauaggcagccacagaagaagggcaaaagguucauguggagauaacccguaugaccucggccucaaugcaguacugcuauaaccuugaacuagcaacaaucaccuuaaacagucagauuucaaauacccagauggcacagaaacucuauucugaaaaaauaucaaauaaaacccagaacaguugaaccgcaccccccuccuuuauuuauuuauuuauuuuuuuuuuugagacagggucgugcucgucaccuaggcugcuggaauauaguggcucaaucauagcucacugcagccuugaauuucuaggcucaagucuaggaagcucaagcaaucccccugccucagccuccagaauugcugggacuacaaguaugugccaccaugcccggcuaauuuuuuaauguuuuuuuuuguuuguuuguuuguuuuuuugcagagacccggucuugcuacacuguccaggcuagucucaaacuccuggcuucaagcaauccucccaccucagccucccaaagucuuggcauuacagugugagccacccauaccuggcacaguugaacuccuaacauuuuauaaauucuaaacagaauuuaacuucuaccuaauugggauaaauuuucugcucugcuccuauuaauuuuaaaagaagagaaaagagaauaaaaaagaagaagaaaaaaaugcuaccaacuacucuaugagugaaaauguaguacguccaaagguaucuugguaaauuccaguuagcucagcccugucacuuagaaggaaaccauauacaaggaacaggcuccauaaugcuaaagaaccaggcacugugugucaggcagacuguaaguuagcccuuagaaaagcaaacacagucagaacacaugaguguugaagggaauaucaccauucagcuggacccauaugaaugcugaaccucugaaacuggauucaaaaucagucuauaagcaaagcaagguguguguauauagguaccaauuucugcccuggaagaaaaaucaaaauauaaacagucuaccacucaaaugugcaugucauuuaaaaaaaaaaaaaacauacacacacacacacacauaaacacaaacaccagcauccuucuccauaucuuauacuuaacauguacagaagcucaauuacuugucaacacaguaaauuccaaaaggcaauuuguaacuauauuuauucaaaaguccaaaauugcuaaagggagggaugggaguuaagcuuacagucucaagauucauuucuaccaaauaggaguuaaccaauucuucagaacuuuaaaauguccacaauccuccuuucuuuacacuguagcaaacauuuuuuucaaaaauaggugagucacaucuauacugaaacuguucuggcagauaccaucccuugauaaacuuugaaagaacuacagaaaugucuuggaaccuacagauuccaacuaugccaccaccccucucacucugaggucguauaggcuugaaaggaccaugaaccuacagccccacucaugguuucccaaaaugucuccagcggcccuuuuacuauacuuggcucuggaguuacaauuuccuacucuucagcugaauuaccaaaagccaacaagccucugagcacauacgcugauccuacagcccacagacacacguuuuuccauuucgucagugacuguuccucaucuccugcugacaguucacucuuuguccuucuguuaaaugauucauucuaucacaaauguaacauucauuauuuuucuuaccacuuuccuuuuuuguuaaccucuauuggacucacaagccuuuuuaacaucccuuauaauacuuuuguuguccuugcacuuaccggacaugaguggcuuaauaauauuuguaacaucucaaaaaucaaccauuaguucagcaaaaaugccacagcaggcaaacaaggagccuccugugaccacucaagaccacuaaugccaucuauuggcagugggcuggguugauaggcauuugcucuggagccugacuucacuuucaucauuacgaauccuuaaauuaaacagcuucuguguuuucuuaauucucccacccacaauaugugaguuuuaucuccuuuggcuacauuauucagugggcuaugugggaggggauuguuuaaaagguuacuuaccacgucaaugccaaagacugcaaaaugcagaagauaagugcaagucccuuguuaugccacuggaaaaauaauaauaugguuauaggagagugugagacaaggggcaaaagccaaaaugguuaagaaaaauuaaaauauacauuuacccaaaaggcagaacacaggguaagugcaaaacacaacuaaaggaagaaaggaaacauuaauuaaugacaauaacauggcaggaaaaaaaaaacucaaaacuuguuauucuucacaaaugcacaaaacuuaugcauccuucaucucaaagcaguuaacccaccugagcacccauauuuggcagaauaguuaaaaaucuccaugaaaucaaacuagccaauaaagauucacauagauaagauguucuuuuacuuucaaguuuucccagaaccucugcccagcaaacaaaucacauuucaggcccacccauucauccguccauccaucuuuucauucaaaugcacuaaaguaagcuuaacacaaaucuuucuauuuuaacuccuaccaaaugcuagucucugcagcagaaagcacaugugaggacaaagguuaaccugagauaucaaucucacagucagcaugccaguuacuuguguaccuaucaccuaacacuuucccuaaggccauucuuagaaagcucuuucugcaagagacuuguccaggccgugggcaucugaggcuggccaaggacaacuggugcuagagcagucagccaugccuuucuucgccauccuucuauaacaauaacuacucaaauauguccuaaauauucucuguguccagcauugugcccaauacucuaaaaggacacaaaauaaacaggaaauguggucacagcuuuugauaacucaccuauuugaacaaaugagauuauauaaaugaaacuaaaaauaaaaguauguucuucaaguuccaaauguugcaauagcuauaaaaguccagagaauguaggucuggaaugauuuugacaaccacagggaagaaaauaggccaaaaaugagaggcauuuagggucaauggaacaggaagauacaacaaagcuaaagacaauguugucagagcaggguacaaggaugacaggccauaaggaggccacucccacuuuggggagacugaugaaaaacaguaauaaguccccaagucagauaaugaggaauaaagaggccauucuauaagacaggacacccacccuagagaaugaguccuguguuucugaguuauucccucuaagcccugccuguguguggcuuccacagucaccaggaaggugucugagcucccuuacuaccaccacaccacuguggcucaucugacaagcaaugcccucuagaggugcuuuucagaacugguagcaccuugacacccacugaaacacaaaguaggggaggaggggaucguaguauuacuuagaguguucccuucugccacaugguuauaggaauaggguaauaagucaagcugaacggaaaaagagaagaggucuuuagauuuaaaaagaaaaacauccuauacaauagaaauaaaaacucccaucugagaaguccagcuaaaaagcagaccuuaccagcaccaugauaguugcaaucaaacgaguaggcucaaacauucgcuucagcuguuucacuggucccaugaggaagaugguacuaaaaggcaaacacacgcacacaagccguucagaacagaacugcacuaggcacacugagucgccuccccaagauuuccuguggcaauaguagcuaacauuugaaaagcucucauucugacugugcugaagggccuuucgugcauuuuucucauuuaauccaucaacaaccaaccuauaaaguaggaacaauuaccacaccaaagcccacagaguuacuuuauccaaggccacccaacuagggaaugauagacccaggcuguaaaugcauguggguguuacuguagaaucauaucauaccacuagguuggauaagccuucuccuugagagguguuaccuugccucccugacaauaacuacucauggaaacaaacaaggcucaggaaguuuaaagaaaaaccauaccuuacaggcuuagguagcuuauguuaaaaaguagagcauuucauuuucuuucauaaucuucagggaauaauucuaaugaugaugauaucaucauggguuauuuguugaauguuugcuaaaugccagauauuacauauauuaccucauuucuucuccucaacaacuuugugaguuauguauuacacuuauuuuagagacgagaaaaucacacagcuaccauuugacucuauagcuauuggauuccaaagcucuaaaaagacagacccagcaugcuggguuuuuuuuguuuguuuuuuuuuuuuugacauggagucucacucugucgccaggcuggagugcagugaugcaaucucggcucauugcaaccuccaccuccuggguucaagugauucuccugccucagccucccaaguagcugggacuacaggcacacgccaccacacccagcuaauuuuuguauuuuuaguagagacaguuucaccauguuggccaggauggucucgaucucuugaccucgugauccgcccaacucggccucccaaagugcuggaauuauaggcgugagccacugcgccuggcccccagcaugcuuucuguaugaaugaacuugagagauggcuagcaagaguaaucacaaaugaagcagacugucaugucuaacacaucaacuuggcaugagccaccacacccggccaauaagucuuccucucuuugaagugccauuaaguugcaaggcuucacucucaagugucccaacuaagagaacacuucuuuaaccuacaccgaauaagaagcaacagucaaggcugguccuaaaaauuaaacauagcauauacacaaaaccauaacagacuacaggcaaagacacaaacucccaaauacccugaaaauaacaauuugcucccuuuauuauuucccuacacagucuaugaagaauccagcccauagggauuugcuaaagagcucuucuagacuaagcaacacacccauauauuuaugcucagucuagacuauacaauguaacuuacacugucugcccaaaacacccccccacccaaaguuaguauuggagaaagcuuuacaggcaacaagagacaucucuaagggucagcauuuuacugucauaagcacuaauaaauuaagcuuuacacagguagccagaaucaugcaaucaaucauuuaauuaacaucccccauuuccagccagacacagagcuaaguuuggguacaacuggggacaagauacacgugcagcccuuaucaaguggcuuacagaucuaacaagucaguguaauaaaaugcuaccugcacuggcacauaaauauagaugugauacugagaguccaaaggaagaggucaucaauucuggagaggaggagguaaucaggaaaagcuucauagaagagguagcuuuugagccaggucuuaacaaaugagcaaguaucuaccaaaccaggggagguacagauagggcagcauuccaggcacagaaaacaaccaaacaagggcacaacggcauuuugggaaaugcaagaaguucagccuggcugggaagcacacuggauagggaaugggacaacggugaagccagaucucaaagacgcuugacuguaugcgugcugaggaauuuggacuucauuuguacagacaaaacagggggccacuugagggggcuaagcagggcuauaaacgaauggcucuacagcucaguggaaaauggccuugagaggggcaauggaggagacagagagaccaagcagaugcaucuugcucagguaagggugauaacaggccaaagcuaaggccagcucagauaucaccuucucuaggaagcccucccugacucaggucgugucggcugccccuccuugagaauuucuuuccauaucuuguuauaucaugaguuauaugucugucugccuggcagggaccaaacuggacuugucuuuguauccucugagcccagcacagagugugaucaaugcuuacccauugagcaugcaagucagucagugaagcacaaacagccauggggacaaagaggaaggagccaguaagacaggguuacaucaagcccuggugaggaaucauggaggggagacuuggacccccaggacucugaagccauuuacagagacacaagggaagggaaaagggggaaacaagaugacugagcucagguuccugcaggucauucagguagaggccaggccagugcucccaguuggagaggguggaguuguuggcaccagugugacugaagcaucagugugaaugagcuugaccuggaaaaugugugcauccacaacaugcagaaugggcugcccaccuccaggaagcgcucagaugcccugcccacaugagcugcuacucaggucugggaaggucugacacuaaauaaaaaccaguuucccuuauggccacuggagugaugagcccuuugaaaaccaucaacucaaucucugacagcaguaagaauacagcaagcaggaggacuggguuguaaacccuggagaaaucacugaacugcuuugugucgcaguuucuguacauguaaaaucacgauggcaaaacauuugcugcuuucucccagguguuucaaacuaagauauaaaauguuuucaaauaauaagauaugaaugugagauauucuaacuacuucucuccaaauuccuuacaacuacuggagccuccucuuucaccucccucaagggcaaccaacauccauuuucccaucuaaugauuggcuaaaauuggauuuuuaaaaaacaguuaccucccaauugaugcgauauuaccaaagguauaaaacacugcgaagagguguagucccuuccugggcacccacagcagaacaguacccuggaauuuaaaguacaguguuugcacaugagcaacccucccacccggccacacaagcagagcucccagaggaagcccugaggaguccguuucccuccccaccucccuuauuccccucuccucucauccaugcauuuuagugaagggcaaaaggggaaaggagguggacaaaagggggaauauauagcaaagacagguagaaggaaaagacagaggaggaagggaaaucuuaccagcagugagcagagaauuccuauagcaaaacacgcaaugaagccuuuuauccugguacuccagcuuaaugaagaugccucaacaaccuaaaauugaaaaaaaaaaaauacauauacacacacauuuacuaaaaacaaagcaagcacauaacuaaaucuagaaaguguuaaguuguauuagggaaggcaaggagcacagaauccuacacacucaggcgauguaagucaucaaauccagacuuuaucagagcuguaaaguuauuaugcagacaugaaucuccucucuagcagcugacagcugugccuccagcugaacaucuucagagguagaaacuccuugccucaagcacaacccauuucaagaacaggaaggcaagacagccaauccuagaguagcccagagccuuccuacaacccaggcaggaugaagaccacaccuggaaaggcaugcguccaccagggacucacaaguccaccugggauccuccaccaggcagggucccaggaaauaaggaaaagaugaggggacggcacucaagcagcugcuccacuggucaucgucuccuacaucaacucucacccacauuauucacucuugguucagauauuguacuuacaggaugcuggcaucagccaacucauccaagugggagacagauccugguuaauuaauuacuguccuguuacauccugagucuuugccaucaugauuaaucccucccuggagcaaaguucaggggaagccaggaguuccaaaaacacuacugaaacaggagagccugugaguagcucccagugguucuuuucccaugucaaaaaugacaacagccaggcacaguggcucaugccuguaaucccagcaccuugggagaccaaggugggcgcaucaccugaggucaggaguucgagaccagccugaccaacauggcgaaaccuugucucuacuaaaaauacaaaaaauuagccaggugugguggugcaugccuguaaucccugcuacuuggaaggcugaggcaggagaauugcuugaaccugggagguggagguugcagugagccgagaucauacauuguacuccagccugggcaacaagaguguaacucugucucggaaaaaaaugacaucaaaguuuuugcacuggugacccuaccagucuguccaccugaugcaagugggaacaguuguuccaagcuggacaaagacagcugccguaagagaccaacaccacacagggcagcuaggccauguauauucacacagggcucaccuuguauggccagcauagucuccaucuagcaauguggucaaaguuuccuacuauauuuccacccagcugauggaagaagguagguaguggcagaaagucaagagucauuagacuggcaacuccgucagccuugacuacccccagcucagggaucuguuuucaacccugucuccagaguucccgucaaaccagaagcuugaaaagaaggaugagaggcuccccucagguguggcacguauugccaaagacuaccuuacucuccacucaggagaaagguauuuaggucagguuauacauucauauauauggaacugggcucaugacccugcacagaaggcacaaauuagggaugauaacagacagcaggggcccaguguuaagaucugacagaugagccaccugguuuuacgcugagguaaaccucuccuggaggagucugguuucccaaacccccuuggacuccaaaaugagccaugugaugaugcucugguagcaggcuuuacaaggccccagacaaucuagucaggcuacuucggacuaaagcauuuaagcucucgccaaggacagaauaaaaugagaagcuaccacucuuccuagucaugcaaaaaccaaagaacuuaccuugccaaggugcgaaaagaacuagcugcaggugggaagaaaagagcgguaguaggauuggccuggcuuguucguaggaagaagagugguagugggauuggcauggcuugucuguaggaagaagaacgguaguaggauuggccuggcuuguucacaggaagaagcaugguaguaggauuggacuggcuugucagcagcaagaaaaaagugguaguaagauuggacuggaugguucccugagcaccacauggcaucaacacggauaauuuuaaaagauucaaccuuucuauuugaagaggauaaaccauaagguuaagaaugaaauuugaauuggcuuugacaucuagauugcuaaauaaccucaacagaacagugagauuccagagaauggccugaacccgggaggcggagccugcagugagccgagaucgagccacugcacuccagccugggcgacagagcgagacuccgcucagucucagugagauuccagcccucacacaaaucaaaauaaccacaauaggaagcaguucagccaagaauguguuucugguuucuaccuucagaaaggaaagugacacuccauauccaagucucucaagcugaauccauccaaauguuacucuguuugccaaaauggaagggguggggggcauauuucaccacuguauuuuuccauuacaugugguugcaaguucuuuuacauucacacuuggucagggaaggaggaagcuguuguuccacuucucauaacuggacucagugaaagcaaaacacuucuuuuugccaaauuaugaaaacaaacucauaaaaugucuguaaauucaugacugcuggaagcugugcuagcauauuguuuuuggaaauuagaguagcuaaaaugguaccuggauggaauuuguaggcaaugcgcucacaggcagucugacuggcaguuauucacaaaggucccuuucacucugugauguggagagaagaggggcucuugccaagaauaauacuaagaauuguucagaaaaacaggauugguaaccagaagaagguaagaaagaaauacugcuucauuuccacacuuuaaaauuagauacuauucauaccuuucuuguccccagaauccuuuauaaaaaacauaaaaccuauacuuucagaaagaaguccauugaaacuaaagacuuaagguguauuuaugaagaugagguaucaaucacaaaauucaacgugaggcuauaauuagauacugccaugcaaauuuuauaacuaccuaggagagguaggagaaauagaacuagucacaccuuuaugguuugcauuaaaggaauaaagguuuuaaaaagcacucucuucuagugaccucuuaaagagauuuuaagagcgccuaauucaacuuaccacacaaaauagcaauuuccccacagaauccuccaguucuaccagcccccaaaccaugaaaaauaugagacaaucaaaucaguaccaauauuuuaaaggaggcucugaccuaaucaguaaacacuaagcugaaacagccugcaagaugaaguuagucggcaacaaaacauuuccuaggaauucaagacucuggaagugccauacaaugauguuauaaacagaaaucucacucagaaagaggaaacugaccaacugaccaaaguauuuuaaaacaagaacgaagcaccuauucuuuuuaaauuagauccaacagaugccucagcauaacacauuaaagcccuucucacaguauccaacacagacguucaccauuuuagguuaaaaacaagcucagcauuuauguuugcaaacuuuacuagucguccacuguugagggucagcccacugcuucgugaugauuuucgagacaauaauaucugcaucaucccacugucaacacuccaccccucaagagucugcagggagagaaagugucugccucuuaagcaccaauuguucauaaaggcuuguugacagucuauggaaauaaagcuuuaaauaacgagggucagcuaccuaugagucagaccuuucuuaggcccggucugagguuccacuugagauucauaauagaggcuagaaaucaagaaaaaaaaacccgugaaauuacucugagccuugaccaauuaauaaaggcaacaaauuaaaaagaacccaccaacuuguuuugaaauaucaaaaaguuaaauuucagugacuccaacauucgaucccauagaauuacucccucaaggugaagauucagagagcaaucuuacauucggagaugucaugcuaagucccaguaucacacaaaacaaaaccgaauaaaaucagcaaccacaaacgugggugaaagcagcuugcugagaaagaagaacuugcugagaaaccagaagaaacacugauuaguuuccaguuggccauaucaucuuaacauccucauuucacagauggggaacggaggcuaaagaauacaccaaaaagcgaagagaaacguuauuuugucauccaaaaaggaaaacaaaagcuaaaagcacccuaaauagaaaugcagcauucugugugguucuacaacauaggacauuaguggccagguuucagcacgaucaaaacuuuucuaauaggccgggcgcgguggcucaugccuguaaucccagcacuuugggaggcagaggugggcggaucacuugaggucaggaguucgagaccagcccggccaagauggugaaaccucgucucuaguaaaaauacaaaaauuagccggguuugauggcgggugucuguaaucccagcuacuugggaggcugaggugggagaaucgcuugaacccaggaggcagaggcugcagugagccaagaucgcgccacugcacuccagccugggcgacagagugagacucugucucagaaaaaaagaaaaaaaagcuuuucuaauaaaacaaaccaacacgcaggcagucuccugaggcgcugggugucuagagacuaguugugggcaguguggacagagacacaagauguggucccuguccucaugggaugggggcaguuucucacccccaaucacaaggcaauguguacaggggcgggugggagugucacacccuacaaccuaaaccggacagaaaaccaaggcagagcucggggcgcggccaccagccccgucgcgagguagggaccgccaccccaacaccccaguccgggucuggggccccgacccacccagcaaaggcuccuuccgccuggaccucggggcccccagcccuacccggcccuaaagcgcauuccccggccgguggggccggggccgacagcccagucgcccacccucccacucgcagcucaguccggggauuuccuccugcgccgcccccuugucagggaggaugggcugaaggggcgcggggcagaaaaggacgccgcggccacugccccguguagugccagaccucuucgcggagcccugcagaagaagaggaggagaaggggcagagcuaccguccagaaacuccagggaguccccgcaggcuucccaggcccgggcaggggacgcagggcgggagcgcggcgagagggggccgacggccccgggcucacucaccucggacaggccgcuccgguccuccguguccugcccgcucagcaccuucuucagcuuguccauugcggcccaguccccaccagcuccagcuccucagcggcagccuguugcgcucgcuaaguugacggcucuuccgggugcuaggcagccgcccagccgcccaggcgccaaccgcggcgcgccccgcccaggcaccugcccaccggggggcucccggcaugccc

SEQ ID NO: 12936 - RNA, 12795 nt, Homo sapiens
cgcgccgagcuccggcugggucccugcaggucuuggggcccgggacucuuccuggagacaccgccauggccgggcuaucccgcggguccgcgcgcgcacugcucgccgcccugcuggcgucgacgcuguuggcgcugcucgugucgcccgcgcggggucgcggcggccgggaccacggggacugggacgaggccucccggcugccgccgcuaccaccccgcgaggacgcggcgcgcguggcccgcuucgugacgcacgucuccgacuggggcgcucuggccaccaucuccacgcuggaggcggugcgcggccggcccuucgccgacguccucucgcucagcgacgggcccccgggcgcgggcagcggcgugcccuauuucuaccugagcccgcugcagcucuccgugagcaaccugcaggugagcuggggcccgcggcuuccccaggcgggcugugggcggggcggccacagagcgagccuucacucuccccagaauucuucccgggaaguggagcguggcucgaacggcuguugcuucucugccgcgcaggcagguaggugggcguugcagcgucccagauguugggcagcuggguaccaggaauuucccacaagccuccgccacugggccacgcaccugggguaaauucucugccagcagcccgaggacuucucauccgugagugguucucagucgucuuggggcccagugucucuauuaacugugcuccuauucucuuuuuuuuuuuuuuucccuuugagacagaaucucacuuuguggcccaggcuggagugcaguggcgcuaucucagcuuacugcaaccucugccucccagguucaagcgauucucgugccucagccuaccgaguagcugggauuacaggugcgugccaccacacccggcuaauuuuuguauuuuuaguagaggcgggguuucaccauguuggccaggcuggucucaaacuccugaccucacgugauccacccaucucagccucccaaagugcugggauuacaggcgugaaccaccgcgcccugccugggcuccuauucuuaaagguuuuacagggcauagagauuguuagguacuuaagcacuuuaauaugugacuucaggguuucucacucucuuacccuuccugaauuaagcuuuucccuccugcagcaagacgcuaacguacaauaucauggacgauuacaaugauuacugcagucuuuaggccuccacaggcauaguggcuccucaguaagaugcagagcugauugaagguguaucucuuccucgcccuuugcccaccuucuggugcagggccacacuuacaacucugauggaucucugcugucucagggauggggucacagacacccagcuugggaggccggagacacacagaguccaggaauggagccugauuugauggagggucuuuuugacaaagcucucacauuugaguucaacucugaaaguacaacauuguugauaaagacaggaugcaagaaacugaugcuugauuaaucacuuuuccauuugccuuccauucguugucucuucuauuaauucuuugaaguagguauuauauaccccauucugcagaugaagaacuugaggccuaccuagguuaaguaacuuguuuaaagccagcgggcaaaccccuaguuucaucucagguucaucuuucuucaaaccaccuaucacaggcugguggcccaucagcugaauaugucccacagaccgguuuggccuacacaaaguucuguuuuguuuuuaauaaauuugaauuuguuaccaacauuuuaaaauuuagauuuuacuuuaaaauguaaaucucuaacuuuucuugaaaaaugggaagauccagugacacugugggccugcacucuuugagcaaaaacagaagcagugcccucuuuuagcuaaggcagauacaccccaguucaccauuuucuuauucccagcccauuccacaccuuuaggcguuugcucaaaacaaacucacuccacuccaucaguggugcucaacuuugacugcaaaucauagucaccuaagaaggcuuuaaaaaugggaugccaagguauuuuauugaaagcacauuuuauuuuaagacaacaccccuucccgccuccccacaaaccacucccugaugauucuaaugggggaggagggagauugaccaauacauaaucauauuuaaauuugugaggugacuagggaguugcugguauuauuguccccauuuaggaagugaggaaacacagacucagaggugcagggacuuacccugugaccagucagcuaauggcugucagguaggacauuagcccaggucuuucauguuucuagaaauagacagggcaguggcaaggaaccuacccagggcuuuagguuuccaugauggcagugaaaagaaguggccacauuagaauuugucugacuugauuccaucaauuagcaggucaaaguuucugcuuuuuucuuuuccuccuccugaccuccagggugcucugcauuucuucucauugacagggggugaaaucguucagaaggaacaaaaagaccuagguuugggaccauuucucauguguaaaauaccuguccucuguaacuuagagauauguugugagcuucaaacguacuuaccacugggcuguuucuuuuguaugucucuuucuuuguggcauuuuuguauaguaaaugucuguaggacaguguugcugauguuagcuuauagugggaccguguuuggcugcagagccagugagucugaagggaaaucuugggguuugauuauuugcaccaagaccucuuacuauuagccucccuuccauuuuggcauucuuuucuugugaugugccccuuucuguucuggucacucuugguuuuuuuucucugacccacuaaaauaaguaucccucaaagucaguuuccuacucuuuuguucccugcagcgauccucagaagauuguauacacucucguuguauacauucucuucuaguccuuacuaggacucacuuccagauguguguccauuucugaccucuucaaaguucucuauauuucugcuugcuguucauuuuugcuucguuacuuugccaccacuucaaauucaacauguuuaaauccaguccuucuuccuccugaaacaagcugcuuuugaucuucugcauuucuguuaguggaauuauuguuuucucaguaaacccaguugguucucacugccuccccaaaucccucaguucccaaguccugacaguuuuuuguugccuucuuuaccucuguccuugccccuuccucuucauuccugccaccucauccuuaagcuuaucaucucaugccuaaaaguacuagaacagcucuuacauagucuuccugucugccccauccaccuugccuacccaaauagauuaacaaaaauaccugucacagcauugcccucuggccagaaaccuuuaacaauacccagcugccuauagcugcguaagagcuaccugggauguuuguuuaaaaugcauauagaggcgggugcggaggcuccagccuguaaucccagcacuuugggaggucgaggugagcggaucaccugaggucaggaguuugagaccagccuggccaauauggugaaacccaccucuacuaaaaauacaaaaauuaacuggguauggugguguacgaccguagucccagcuauuugggaggcugaguugagagcaucaguugagccugggaggcagagguugcagugagcugagaucacgccauugcacuccagccugggugacagagcuugauucuguuucuaaauaauaaaaugcagauagaggacagcuugguggcucaugccuguaaucccaacacuuuggaaggccgaggugggaggaucacuugagucuaggauuuugagaccagccagggcaacacagugaaacuccaugucuacaaaaaauaaaaaaauauuagccggguguggugaugcacaucuauaguuccagcuacucaggaggaugagaugggaggaucacaugagcccuggagguugaggccacaaugagccaugauugugccacugcacuggguggcugccugggugacagagugagacacugucuuaaaaaaaauauugcaggccaggugcggugucucacgccuguaaucccagcacuuugggaggccgagguggguggaucacaaggucaggaguucaagaccagcuuggccaacaugaugaaacccagucucuacuaaaaauacaaaaaucagcugggcgugguggcacacaccaguaaucccagcuacucgggaggcugaggcaagagaaucgcuugaacuugggaguuggagguugcagugagcugagaucgcaccacugcacuccagccugggugacagagcaagacuccgucucaaaaaaaaaaaacaaaaaaaaauugcaguuauuuggguugggagugaagccuguuucaacauuuuaacccaaaucagcauuuuaucaagcucuccaggcaggugguucuuagaaaacagugccuaagguuggcccacaaauuacaaucuagacuccuuaacuuagguuggagcccucuccacucccaaccccaggcuccucccguaggaaagcccuucuuuccagcaaaucagguuucuugguacuguucaucaagucuuaggcucacccaguucuguguuuuuugcagucagugucuccucucccuuuaauauguccucccaccuucuauccugguuuugaauauauuauaaagcuccuuacaguuccucuaucacucuggucuaugcuggacauacacauuuguuuaugucugccuuuucaaccagauuauaaacucacggagggagagaguuuaccugagugucccccuccccuucuuuggucuccuguggugccuugccuaauaguuucuagacagugacuauuuggcuaaaugauuucaaagaaaucucuuuaugacucuuuguuuugaugggucagugugaaauggcaaaauucuccacacaaggcacuuagagcuuaaagagcuaaauagucuaaaaugcgaugugugaauuuugcuauaaucugucaacagugccuuuuaugaaguugauuucugaauaagaaagcauuaagaauuuuacuuguguuacuuuuugaaugugggauaaaacucauuguuacuaaagcaggaaugaacaacuucuccaguuuugaaaucacaugacaguuucugcuaauguaagauaaccaaguagcaugauucagcuacuuucuugcuuaaaucgcguaguuagccaauugagcaacugugguguuuuuagcaaugguuuuguauagaguuuaacccuuuaaaucuuucagugaagccuauagaacagccuugaauuugggugucacuauaauuauaauucuucugaugaauauggaauaaauucaggguuucagaaaaagaauauugaaauaauuuuuaccaagucaguucauuuuaaauaugaacccccgcacccccuuuggggaguggucaggauacuuuccaaguauuauuuuccccugaguggaaggugauguuuuaugauucauuguuucguggaagaccagucaagcucuagggacaucauguaugcaacuuuugaaauuuauuaccucuccagaaaccauauuucacaugagaggaucuucauuuucucucuauaggagaauccauaugcuacacugaccaugacuuuggcacagaccaacuucugcaagaaacauggauuugauccacaaaguccccuuuguguucacauaaugcugucaggaacugugaccaagguaaguaguuauccuacaggaagggagaugguuucagaacaccaucguauucacaaugaaagaauagaucauuuuucuuuugagacagagucucacucugucucccaggcuggagugcaguggugugaucucggcuuacugcaaccucugccuccuggguucaagcgagucuugugccucagccucccuaguagcugggauuacaggcacgcaccaccacacccagcuaauuuuuguauuuuuaguagagaugggguuucaccauguuggccaggcuggucuugaacuccugaccucaagugauccacccaccucgaccucccaaagugcugagauuacaggcgugagccacuaugccuggcagaauagaucuuuucagaaugaaaugcaguugauuugugauugccaugcccagucagaacauguucuauucuaauaggugaaguaauuccaugaaaaccaaacguuuuaauaaguugcuuucauauagguguuaaauaagauaugacaaaaaugaaugauuuucugaagccaagcagauguaacaacuaugaagcuccuguauauaaaguuauucuuacuaaagagcaucugguugaccaaagcccucuacucuccauuacauuuuacauugguauaauguuuuuccaugucugggcuccuugucuccauauuuuaacaguggcuuaaagcagagaaaacauauuaaguaggccaaccagaggacuauccauuacugaaaacuggaagugaauuuaguuuggaucaccugcugaagggaagaggucaaauacaaucucaggaagagcagugggcauggugucaggagugcugaucugauuacccagccagcagauuugcuuuuugaccgugucaaucauuaaugccucagacaaguguuauuuauggucuguaaauucuuuguggaugcaucucuguaguugaguguccuucacuggcaggaaaaagauggaggagcagcacaugcuuuugaguucuguuaugugguuucuaaacauuuuuauccuucaguacauucaucuguauguuuaacauguccauguuaugggauaaauaugcuaaacauuacaugucuuaggcaccaguaauguuacaguacuuagugcuaguuauucuaauagcucaaaaugccuuuuuaccaaugaaaguugguauuauacuuacagugguuucccacuucgugguaucuguuauuaccaacaauugaaaucuuuauucucugcauucuuuacauuuccuuuauuuucucuugauuccuuaagguuaagaucaagauuuacaaguaaguaaacucuuaggauuuauagaaugcuagagucacacauucuuuuuuuuuuuugagauggagucuugcucugucaugcaggcuggagugcaguggcacgaucucggcucaccgcaagcuccgccucccggguucaugccauuuuccugccucagccuccugaguagcugggacuacaggugcccaccaccacaucuggcuaauuuuuuuuuuuuuaguagagaugggguuucaccguguuagccaagauggucugagucuccugaccucgugauccgcccgccuuggccuuccaaagugcugggauuacaggcgugaaccacugcacccggccuaaucacacauucuuaacaaaugagaagauaaaguguuacugccauaagaauguuuauuucauauauguccuuuaggugaaugaaacagaaauggauauugcaaagcauucguuauucauucgacacccugagaugaaaaccuggccuuccagccauaauugguucuuugcuaaguugaauauaaccaauaucuggguccuggacuacuuugguggaccaaaaaucgugacaccagaagaauauuauaaugucacaguucaguaaguacuuacacaucuuucaccuaagauugccgcccuuacagccauccucagccuucuaaggcaagggggguuuaaccguuucaugugcccuggacacccugggcagucugguaaagccgcugaccccuucucagaauaauguuuuaaacacauaaaauacagaggauuaagaagaaaaucaacuauaaugaaauacauuuaugaaaauauuuguaaaugugugguauaaucguuuuauuaauauauuaaauauaagaucuaguaauaagucuauuacuuuuucuuuuuuuuucaagacagagucuuacucugucacccaggcugagugcaguggcaccaucucagcucauugcagccuccaccuacuggguucaaacgauucuuaugccucaagccucccaagcagcugggaauacaggcauagaccaccacacccagcugauuuuuuguauuuucauaaagaggguggugucgaacuccugagcucaggcagucugccugccucagccucccaaagugcuaggauuacaggcaugagcgaccaugccuggccuuuucugugcuuuuaaaguagugaggauugaagacaauauuuuaagacaucugcaacaccugugacaugauaugaacguaucugugauuucucuauuucuguuggagacagucacagauaggcugucacccugugguuuauucccuacauucauuauugaaggaaaugauacauucaguuagagccuaaugaaaaugaaaaaaaaauuuuuuugagccaaguucgcagaccccugaacucugucuacaggccuggacaccagguugagacuccauuuuaaggcugugcuuauugggcccugaacagagcccaguuaugacccacgauggcauuuucucaugaggcuuagacucaggugcuccuggacugugaaugcccuucaucugagucugagcaaguaaccccaucccaucagccccaguacuacaaaugccuauggggaugugugguuuaucccacuaagaagugcauggaagggaggaggcugagauaaaagaggccaugggagaaaauaaagcccaggaccugaagacagaaagggaaaggaaagaagaguguaacuggagucuuuggaguuagcuaaggguucaaaugagggaauacaagggacuggugcuucucccaggugacacagggaauucuggcauaucuggggaggugauaagaacaguaacaauaacagcuaguguccauuguuuauuacuggcugggugcuauacuggcuacuuuucauguauuaacucauucaguucucaccacaucccuuucuugcgcaaccuuccaccgcaacagguaggugcuguuuuuccacaugugugaaauggaaagcugaugcacagagaacaaacuggccuaaacuguuuguucuugcagccaggaagugguggugcugggacucaaacccaggcauucuugcuccagagccaucaccugacuucuauccaugaugcuguacuucuccucuggcugccucacugguagcuggccaggcuccuagcucaguguaauuuauaaugcacuuucugcuuguaaugauugacugcuguuucaggagauuacggugaugauaacuaagguagacuuguagguuguaggucauuugagggcuuaaauucuuagcauuuauuuaaucucugucuuuuucaauuguagaacaauuccguguugaacuauugacucccuaccaugauuggaaaucucaguuuuguuuuguuucuaauuuuuuuuaauuccaagcagggccuaggacagugugugucauagagcagguguuuaggaaugauugucuggcucauuacuugagacaaacacucucacacucuguuggaauaaagaaucccacaguccuggcgcuuguuuugcugcugugcaugcaggagaggcacgggccacuggucgucuucugggcuggcaaagccaucugacuucauaggaauauagagguagcaauuacaacuuuauucccuggcaacaaauuaucaggaugacuguuaagaagggccugcucuucgaaguuaaaguuuacuuucacaggacauaaucucuaaagcgcaguuaucuuuauauaaauaacaugcccaaaggcagugccugguuuaauaacaaaauaaaacuguuuucccauaagucuccacacugaauaagugaguaaaacagauacuuuugagguucccacuuuauuaugcugacaaaggagcacuucucugcagcacagagauagaacauuuuucccuuguccugagaggcggcccaaaggcuagagcagaugugacucuucugaggcagugcaccagaacccgagggaugggcagggccugaaagcugcccgcucugaccgggugccucuggcuaggaauuguccaucuccgagucuaggagugcccccacuaaucccacccgccagguuugccaccagagcuguuuaauaguccggggaguguacagugauaucugugaggaccagggcccccaucuucuuggagaaccacccacaggggccucacaggcguucuggagcuuccccacauuggcagccaccuugcuuggcuugcccagaucgguuuuggaagguauuauuccuccaaauaccacgaagcccucugcaucugaaaucuguuucacacagauggagacugccacuugugagagcugauacggagcuuaacugaaugugguuugccucauuggacuguugggugaagcccccaugagcauguuugcaugaucaguggaaggcuuaaaugucuacacgaagcauuugcuggcacccuggaauaagcaguucuuuuuuuuuuuuuugagauggagucucacucuguugcucaggcuggagugugguggugcgaucucagcucacuguaagcucugccuccuggguucaugccauucuccugccucagccuccugagcagcugggaccacaggcaccugccaccacgccuggcuaauuuuuuguauuuuuaguagaggcaggguuucaucaugucagccaggauggucucaaucuccugaccucgugaucugcccgccucggccucccaaaaugcugggauuauaggugugagccaccgcgcccgcccaacaagcaguucuuauaagcauaagcauugcuuuugaccacuguuaagucugggcagcagcauguuugugcuaagccucauuuuaucuccucuggcgcacauccggauauuuccuagcaaacacacagguaacaaaaggucauggauuacagacuugcccagucuugauaccuagagauggauucccugguugguggcagcagaaagggggaaaguucaccucccagcuguggucacuaucacugggcaauggcuaaucacugcucuucugcccugauguucaggaccccuucuguucucaacuauuuuugucuuuuaagccuucagauacucuuaaaugagauaacaacagcagccacggcaguggccugcuucuugcuacauccuaguagcguuuaucagugugucagaaucauacuuggagaggaggguuauugcuaaaaugaggauuccuaggccccacccucaaccuauugaaaccgaaacucaggagucugcauuuuaacaaacccaagugguuauuuaguauauucuagugguugaaaugaacugaaaaucuuaauuuagaucagaaauuuuaucuaguccuucccuagaaugaauuaauuuuuaagauuuguuaacccaguuuaacaaaauaauucuucucuguuccccuuucuaggugaagcagacuguggugaauuuagcaacacuuaugaaguuucuuaaaguggcucauacacacuuaaaaggcuuaauguuucucuggaaagcgucccagaauauuagccaguuuucugucacaugcugguuuguuugcuugcuuguuuacuugcuuguuuaccaauagaguugaccuguuauuggauuuccuggaagaugugguagcuacuuuuuuccuauuuugaagccauuuucguagagaaauauccuucacuauaaucaaauaaguuuugucccaucaauuccaaagauguuuccaguggugcucuugaagaggaaugaguaccaguuuuaaauugcccauuggcauuugaagguaguugaguauguguucuuuauuccuagaagccacugugcuugguagagugcaucacucaccacagcugccuccugagcugccugagccuggugcaaaaggauuggcccccauuauggugcuucugaauaaaucuugccaagauagacaaacaaugaugaaacucagauggagcuuccuacucacguugauuuaugucucacaauccuggguauuguuaauucaacauagggugaaacuauuucugauaaagaacuuuugaaaaacuuuuuauacucuaaagugauacucagaacaaaagaaagucauaaaacuccugaauuuaauuuccccaccuaagucgaaacaguauuaucaaaacacaugugcacacagauuauuuuuuggcuccaaaacuggauugcaaaagaaagaggagaagaauauuuuguguguuccugguauucuuuuauaaguaaaguuuacccaggcauggaccagcuucagccagggacaaaauccccucccaaaccacucuccacagcuuuuuaaaaauacuucuacucuuaacaauuaccuaaggcuuccucaacugccccaaaucucuuaauagcuucuagugcugcuacaaucuaagucaggucaccagagggaagagaacauggcauuaaaagaaucacaucuucagaagagaagacacuaauauuauuacccauauacaugauuucagaagaugacauaagauuccucuuaaagaggaaaugucaggaaucaagccacugaauccuuaaagagaaaaguugaauaugagucauugugucugaaaacugcaaagugaacuuaacugagauccagcaaacagguucuguuuaagaaaaauaauuuauacuaaauuuaguaaaauggacuucuuauucaaagcaucaauaauuaaaagaauuauuuuaaugaaau

SEQ ID NO: 12937 - RNA, 195266 nt, Homo sapiens
gggagccagagcgagggaggguuuaucgaccgggcgauuuugguuaaaauauucaaaauggcggacggaggagcagcgagucaagaugagaguucagccgcggcggcagcagcagcagguaaucauuacagcauuuuacauauucauauucauacucaaccccggcucccgcugcccccccccgcgacuuagcauaauuuauuaguacucaggauuauuauaauuaacggcggggagauggggggccggggagcauugagcccccgccgggcgcugagcggagggggaaagaggcucggagcggccaggcggagggggaagacaaggggcaaagggggcugcgauccacugcccuccuccugcacccggcccaccccgccgccgcucgccgucugcccgucggcaccggcccuccuccucugccggccgccgcugccgccuccucgccgccgugcccgaacccgagcggguccgcggcggggcggcggggccggggcagagggagaggacaauaaagacauuuuacauauucauagcugcugggccggcggggcgcaguagggcgcgggcgggcggccggggccgggcgggcgcgggguggggggcgugaagggggauggaggcggcggcgagcacaaugccggggaggcggcggggccggagcggaccccggcggccggacacccgcacgcgucuucccccgggagcgggcccgggcgggggggcgcugcccgccuuggggggcggcccucagggcaaccgggggugcgcgcggggagagcucccugcccgcgccccgcgcggggcugagcccgggggucacggccccaggcacuucggccucgccccacugguccccaaugugguggccugacccaagccaggccugcucucuagguggguaggggugagcggucgugggcgcugcgagguggccuggggcggcggggguggggaacccgcgcaggggucugcgugcccccccugggggguggacuggauuggaaggaguccuuggggcaaguuccuuccgaggggauguccucuggggcggcccgcgcgcccccggccggcggucggcagccccuuugcguugucggccggggcuucgcgggcgaguugggcuggaggugccuggcguggucugaccuccgucucccuuugccccuccccgcugcccccccuccguuccccccacccccugcgccugaccgggacgcacggggcggguggcccuccggggccucucgcuccgaggccccagaagcgcccagaggccucccgagaacuuggauguaaagggcugcccuccugccccagaaugggcuggccugacaaguugaucguauucucgauuuccucucuccuguugggagucgguggggagggacggggaucccccucccuucuucuguggcgguguuuucucgcugugugcugggucgucuuuacucucugcuuagcugaaccucuucucauuugaauaaugucuaauucggggagguuuauauuauugaaauggccgccuggcuuuccccgccucucauguuuaguaauucagaccuuuaauaacagccacucacagcccaacgccguguuuauauuuuacauucgccccaugugcuuuugugguucgauaugauuuuuuuuuuccuuggcaauccgcagggcucugagaucaaacccaggccgugcugggaagagaggggggaagcugggccuuggcuucucuagcaguugccuaggccucauguucucugcugcuugauuuauuuacuaauaaccaaaaugacuaccuccaccaacuuccacacacuuuccccuccucugcgggcaaaacaaacucucuuggggcuuuacuagcauuaaaacagguccuagcuaaguaucaacucugugaugguuuguuuucucuuaaaaagacuuucuuauacuuugcaguaguauugggccuagggggaaaaaucuguccuguauuuuauuuucagagccuaugaaaucuauuuugguuuaauccaaaucacuuuguuuuggggauggguaccccgguugcuccccacccccauguuaaauacuuuaaggcuuuguaaaggucuguaguauuuguaaaacugacacuuuuuuuuuccucuaggaguuguggaguagcuaaauauuagaaauuccaauuaacaacaguuucauaauuucuugguguggugcuaccuuucugacaucuucauucuaauuuaaaauggagcugacguuaauuuugugcuaucauugucauagacuugcuuauuuuaauuguagcacuacugaaaacaaaaaaaugggguuauguuuucuuugaguauuugugucaugauuaaaugagugaaaagagaagaauaaacauaggcauugcguuuacccugaucuuggaacuuauucuccucccagcacacccgccccuccucuuuaaguugucagaauugauguuauguuuuaucuagacuuaggacaguuggcuugugagaggcagauuaacuuuuacuguuuagaggaaacaguaauuuugauuuuuggucuuuccugugguaaaauuuucuuuuaacauuuuuauuuuguguaggggugugugugagugugagugugacuaguguugccugucacugguggauguuuaccgcugcguagucgagggaaguauuagaggagugggguuuaacacuaauguguuaaaccuuugaaauuauguuaagacauuuuggugaguggcuagcuauguauuuugugggacuuuggucuucaguuuaauuuguaacaaaauucuagguuugauggauuaaacgcaagcuaauuucagauaaccaguucucaccauuuuucuucuuucacucacaguaggcaggcccugaaugcagcaggaaaaaaaaaaaucuguagcuuuuaagagaaccuucaggugaaugacugcuucagagaccugaaguaugaggucagauggacaaaaagcagcaauauaauuucaugccuuaaauagcauauguuuuugcacccgauucccaagauguggucaaacugaugaugucauuggacagaggacaaggugcaguuaauuugauuuauuguccugaggugaaguguagcagugaagccuucucauagggaaaccauuuauuucgggucaauuuccuuuauagcugcaauuuaaucacuacugaggccguagauauuuuauacaaaaugauaaaauguacauuggauuuuacaagcaaaauuucgcuguuacaguuuuuguaauacagaaaaggauggauguuguuaacuggccuuauauuuugguucacuuuuaaugcuauuguaaaaauucauuuccucaaaauucucaaauggaguauuuggguuuuagauagauagucauagaagugacccauauaaauguuuguugugaucccccagacuuuuauaagaaacuguguuucuuaaucagagcauggcuuaggcuaauggagagaccauuugccuuagaauccauuucagugaauaaagcagaguugagaaugagggcuguguauucuuuaagguggaaaugauaauguugaaaauaagguagaauacucacaggaaagcaugugcuuuuaaaacagauuuuuuaaaaaaaauucagaauucuuuuuggauuuaucuuagucuggacaaguuuguucauuuuguuuugauuagugauuuuaaaauuguuccauugcaacagugauugcacuuagaauuuuugacauauuaauagauuuucuuguaagacauuucucauauuuuuaauuauuaguuuauuuuaaggugaugauuaaaauucccugagaaugugauaaaauugcuuuauuucuaaccugaauuugugauccaauuuugauagaguauuuuagguuacuuuugaacccacaugaguuuauaaccugccugucuccuuuugcaucugucaaguaguuuccugcguauuucuaggaaauccauugucacugucuucuuuuuuuuuuuuuuuuuuuuccagacagagucuugcucugucucccaggcuggagugcguuggugcgaucucggcucacugcaaccucugccucguggguuccagugauucuccugccucagccuccuuaguagcugggacuacaggcaugcgccaugacgcccggcuaauuuuuguauuuuuuguagaggcgggguuucaccguguuggccaggcuggucucgaacuccugaccucaagggauccacccgccucggcuuuccaaagugcuggauuacaggcgugagccaccaugcccagcccguugucacuuucuuaacucucccaccuauuaauuacaaugauacuuuugaaucaaggucuugaaaauucaugugacagcugaccaacuguuuuugauuucuaaaggacuguucugcuuccaaaccauuaccguaaaagcaauuuuuaaccucuucccucaaauuaguuuguaauuccuuucauuuugucauugucaaaaaucccaguagacaaggaaaaaacaaaccguagcuauuauucagguucaaaugaauucagguguaguguucugccauauuuuaaauuuacuauucucuacaucaauagguaguauaaagcaguguaaauaaaauauguuucauugcugccuaguuugaaguaauugucaaucugccauucaucugguuaguggauuuugcaauaaguucagggcucaaaauguuacguugcucuucucaagccaccaaagauguuuaauagacccuugaauaucuuaggcaggugguucugaaauaacagaaguggaaauuugaauguuaucuuuaaguauuuucuauuaaaaauugaaauauuugaccugcuucuugaaucuguauugcuucaucuugaauuuauuuguguuuuuuaaguuggucacucauuuucaugaauguuuccuuuguacuuggaagacuguaauauuauguaguagugauugccuuguuguuaucgguuauuuuuguuuuguuuuuuaauuuugaaaccccauaguuguaaucuuugcauauuagucuuucaagcaccauuaaaaauaauguugugugacucauuaauuugccuuuauauaauuguguuaauuacacaguuuuugugauuaguaaagacuugcuaugaagccugauuuuaagcaggaauguguuuuuccuaaugaaagugauugcauuugaauuuagaacuauucagguaauuugcguuuagggaacagaccaagucacaaacaaaacaugcccccuuuugguuauccauguucuuguuucugaucccuccuuaaaugcuaaaugccugagcaaauguacuuacuauuucuugggcguuagaguugaaaguuguugauuugauucagugacauaucugcuuugaauuucuguacccuuucugcaugaauuuuuuccuuuuccuuuuuuugggguaacuuugagucaccauuuugcuuacuucuuacuguguugcuuaaaggauguaaauauccuuuugagugguugaaagggauaauaauuaagguucacagagaauagcaguuuccuuaugcaucuuucgcuggacauuuuugugcauuauugacauuucauaaguaaagagaauugaauaacuguagauuuuaauucuucuuaggaauaaauugguuuguuuuguaccgaaguauuucuguguucuaaacaggugaugagcucuuauaaacuguuucagcaguaauaacaauggaaacaaaaauagccugaguagagcuauugccugacuuacuugauccguuuacaguauguuuagaauuuggaauaugagaauugucuugaguuucagaaguucugauuugaagaugcuccuugcauacagugcaugugguuaugggguucuguguguuuuuacuauggggugugaauuuuuugagcauugguaucuuuguauacucagugacuaauagagcucuuuuguuuuuggguuuuauuuauuuauuuauuuauuuccaauuaagcaagcacucaagauuucaguguugccuacauuugcugacaggacuaguaauugagcaaaagaagaaucagcaaaccucuagauuuaucagauuaucuuuuauucauuuauuuucucuuauuuuuaauuuuuuuuaagagauggggucuugcuauguugccuaggcuagucuaaaacuccugggcuuaagcaguccuacuguggccuccccaagugcugggacuacaggcaugagcuaccacaccuggcccagauuucuuuuaaacugcuggaacuccuggacauuuauccggagaggauacauuauacuaacuuuuuuuuaacagccaauguucacauuccacaaagcuaaguguuuguaguagcuuuacuaagucuucaauauugaaagucauagcaagugcaguuuaucacauuauuuauuucauaauucuuuguaacuuuaugcuuuuuauguuggaauauagaaaugguauaugaaauuaaaucaauaauaauaauuauuauggcagguuucccccccucuguugaacuuucucuuugcaauagaagauauaaacaggaauggcuggaaaaugaacaauaugcuguguguuaaacgacucauuugugcuuaaacauaugauuaccuuaauggaguugcacugauaccuuaaagggaauauauuuuuauauggaaaagugacuuagguguuuucuuguuuuaguacacuuauuuuaguggucugcuuaaugaaaaauacagccuuuuuuggcugauucauacugcagcaagcaauauuauaauuaauguuuuaaaguaguuaccauccuagucuauaaaagguaucugcuauguaccugguccuaugccuguagucuuugggaauaacaaggaaauaugacugcugcggaggaguugguauguuuacuuaagcaggaaaaauugaaaaacaguguauauaauuacauauuaaaauauguaacagauaaugaagauuggagaauagaucagaguguguccaaguuugaaagagccagagcauccuagaauauauuauagcuggaagguaauuuagauauaaucuuugcuaaagguuuugcuucacagaugaggaaauauuuucacaaugguuuagugacuugcucacagucacuuaacuauucaguaacagauaagaacacaagacuucuaacuuucucccaccucccagucucuccuccugccccauugcugucagucagagaaggcuuuauguagaaggcgagacuuuuaaaccgagcuuuaaagggcaaaaagaauuuagaggaaugggaauacagagaaggccauugaaggggagauuguguucaacauugugauguauagguaaagaaugaggaagcauuuguucuaucugcaggaaagcuguuggaggauuuugaaauagggacugaugugauaaaaaugguguguuaggaguaauguggugugcaggaugguuugaaauaggaagggagagauuagauccauagaaaccaguguauagagguauuugguuuauuaacuaauuacuguaggugcuacuagagauacaaacauaauuuaaaaauuacuugaccucaagagacuuccagucuaauuuaugaaauagauaagucgugauaaagguguugaggauauuguccaauuacauuacauggaauaaggacguuugggagaaauucuuaccuggccuuuacaguagaaacuauuuguuuuuagucuuauggacacugaauugucuaauugacuuaguuuccuuuucaaaucaaacuacaguuugauuuggucaaauuuaggucagauuauuaaccugagaagcacaugcauaggcaauuacguuugcauuucuuagccugauuaguagaucaauuuuuuguccaugcauuuguuuuguauuucuuguauugcuuccaucuuuaaacucuuuuuaucuuguuuuaugugggccaccuuacauccuuucuggagcaaggcagguauaaauaauauuaccauaaccauggcacagugauaaugucuguauuuuuauaguacuuuaaaauuuauagccacauucucauuuucauuaccucaguuaguccuuucaggcaagcguuacuauacccauuuuauagucgaguaaaauaaaacuuagauuaagugacuuucucaagguccuguguuuuuauaagcauuaaguguggguaauagcaagacuuccagcuuaguuguuauuuaggcuguguauuaaggcacuuuggggcucuauuguggagagcucugaauccuuuguguugguguaagaguuuggauuuuauuugcuaggcaguaggaagucacugaauuuuuuuuuuuuaauuuuuuuuuguuauggacagugccaugaucagagcccuuaaaguuuagcagcuaauuagaugcaaagagauuaucaagguuuugaguuuagguuauccagaaaagagcauuaccauaagcagauguagggauguugggaaaaggagccauuuggggaguaagucagugaauucacuuugacaugucauuugagacauguuugggugggucuuauuggguuguagauuccuugugaaaauugaaaauuuuuuagugaauuaaauguuugauaaacauuaauacuaggguugaaauuuaugcucaugccacugugcguguggacugaguauugaaucugaacguuguaaauucuagauaucucauuuuggcuuuggcacugucuucuaagguuauuuccuucaacaauacgauggugauaauaccaguguuagagggaugcuguggggaguaucaaauugauagcagaagcauuuuuaaaguaacucuguaauaguuuuucuuacaugagcacaggaguaaaaucaggaauuuuauuacuugugcugcuguagagaagcagaagcuuuagcagccgauggauucuguggggcaccugacuguagguuguucauuuuuuggugcagccagcaucuuaggaggaauggacacuccuaauacucuucugaaaacuuuauacaguggagguguugcauuguagcaaauacaacuuaccuugauuucagggcauucuguuaucuagccccuacccuugccuaugcauuauuaucuuuacuacuuccuuaaauagcaugacucaacaauuccaucaaggaaguucccuuauuguccauuucuaccacaaauacagcauauuaucagauuuuaauuuuuaaagaaauuucccuaaaauuugaagaucuaucuugggaggauggcuauaauuuauccugagacuuaccugagccuuucucccauuaccauccuugcaacaccaaucccaguuugagacacaugaccugaauguguacccaguguuuuggucaagccaguguguuugggacguugugugagaaccuuuacucacacuuuuuccuccauuggaaggccaugguguaugguaugguagagugaaaaaagguacugggggguucagagaccuggcuucucugucacuaauuagcuuaguaacuuuaggacaaguuacuucaccauggauuuuuuuuuuaauugcauuuguaaaauaagggauuucaaacuuuuaaaagccuuugguguucuuuuuuaaaggcaaaaguggagcuguucugauuaaaauuggauauuggagcaagaaaagcauuuuccuccuccuuuccacaguagcuuuugaggcacuuucacaggguccuuaggacuucugcuggucaugacuugaaaacuuuuguccuuauuuaucuuaagggaccugucuguccauuucuuuaucuccacaaauagccaucugucaaaucugagcuccugucauacuuucucugaaauuagcacuuaauuuguguucaguuacccaauucagcacuucauuauacacaguccuauuuucuucucuaauugauuauguaaguaaaucuuguccuaagagccuugagugcaggaacauacugguagggacagaguaggccuagacauuuaacaaauaaugaaugcuugguugauggacuuagugguucucaaucuuugucaccauggggugacccauggaacuuuuucaacauaagaaggcccaacuucuaauacaguagaggucugaaaauccauacuuuaaaaaagcucuacaggugauuugauaacauuaaaugauuacuuguugcacuucaagauuauuuauugcuuagcauaccuugaauaaugguuuucaguuaaugcaccagaaaggcccuauacuggaaagacagacugagaauuaggagacuuggauccuuauucugcuuuuagcauuaacgauaauagcuuucugauccugaauaaaucacuaaauuuuuccaacccauaggauucuuauugauaaaauuaugggcugagcuaggugaauaguuuucauacuuuuuuuuuccuuuuuaaacuggaauuauucagaaacaucuuuugggugaagaccaguaaauauaacauauauuuuuaucaguucggcuuucaucuggguaccugaauauuuauuaaaaauauagaacaugguaagcuugguccuguccuaguaggagagcuaaauuguaugcaguagguaguacugaagaugggauuuagacuuuaaacuugaaacauccuauuagaaugcgaaugaacaaagguaguaagcuuaucaauaauugugguacucagugugaauaaaaacuagauuaugaugaaccaauauggccagucuuucugcauucauuuaauucaacaaauauuuauagagcuucugcuccuuguaauguacugagcacuggugguagaguaaugaauaagauaacaucucugcccucucaaaauguauauuggucaguuggggaaaucauauguuaaauaauacugguuguaguuuaaugaguagaauacgagagauuugaaguaccccaggagcauaagguggggacugcuaaucuggacaagaggauuugggaaggggcucucugaggauaucauguuuacaaugagaugugaaagaugaauaggaauuaaucaguucaagaacugggagugagaaguggaauugaaaauguucugagcaaagggaacacuaugcagacaucucagacaucccucauuauacacaggggcauaccacaaggggauugguuccaggauucccuacucgugugcccuccucccccaacacacacacaccaauaucaaaaucugcacaugccucaguccugcagcaggcccuguggaacccgaguaugugaaaagugugccuggccccugggccucagagccccugugacuaugagcuguuugcaucccgugaauucuguauuuuuaauuugcaugugauugaaaaaaccugauuuaaguggacccacacaguucauacccauuuuguucgagggucagcuguacaaucacguaccgcauaaugacuucucagucuauggaccaguauacaauggcagucccauaagauuauaacagaacugaaacauuccuaucuccuagugacauuguaaugauccugacccugugugggccuaggcugaugucuguguuugugucuuaguuguuaacaaaaacauuuaaaagguaaaaauuuaaaaaauuuaaauagauaagagcuuauagaauaaggauauaaagaaaaauuuuuuguauagcuguacaguguguuugaaacuguuauuacaagagucaaaaaguuuuuaacauuuuaaagcuuauaaaguuacaguaggcccagcgugauggcucaugccuguaaucccagcacuuugggaagccgaggugggcagaucaccugaggucaggaguucgagaccagccuggccaauagggugaaaccccaucucuacuaaagauacaaaaauuagcugggugugguggcacacgcccauaaucccagcuacucgggaggcugaggcaggagaaucacuugaacccgugaaguggagguugcagugagcugagauugcgccacugcacuccagccugggugacagagugugagacuccaucucaaaaaaaaaaaaaaaaguuacaguaagcuaguuaauuuauuauugaacacagacuuuuucucuuauaaauuuaguguagccuaaguauaugguguuuuuaaaguguauaguaguguacaguaaugcuguaggccuucauauucgcucacucgucauucauugacucacccaaagcaacuuccagucuugcaagcccauucagguaagugcccucuacagguauaccauuuuuaaaucuuuuauaccauguuuuuaacuauacuuuuucuguguuuaaauauuuuuauuuuuuaauuuuuuuuuuuuuuuuaaguagggucuagcucugucacccagacuggagugcaguggugcagucacagcugacugcagcuucuaccuuccagggcucagaugagccuccuaccucagccuccugaggagcugguaccacaggcgcacgcacccaugcccagcuaauuuuuuuuuuuuuuuguagagacggggcuucgccuuguugccccggcuggucuucaacuccuggacucaagcaguccucuuggcuuggccucccaaagugcugggauuacagaugugagcuccugugccuggccuagguauuuuuaaauacacaaauacuuaccauuguguuaggaugccugcaguacaacaguagaauaacaugcuguacagguuuguagucuaggagcaacaggcuauaccauauagcuuagguauguaguaggcuauaccauuuggguuuguguaaauaugcucugugaucacacaaugacaaaaucaucuaaugacauagcaucguuaagugaugcauaacugcacauacaauucuugaaacuaaugaaaacacagcacuuucaaggaacaaaaguucagcauagcugguucaggaagcaugagauuuagcugaagagccaaagaugauuuucauguuaugaggcuauuugcaugaucuuuguacuuuuuagugacaaguccacaguuggaaauuguggacgagauuccauacuuuucaauaaauacauugauuccuaguaacaacagcaauaacauuuaucaagucuuugugccaguuguuguacuaaaugcuuuacaugcauuuauguuaauuacagugacccccaugggguguguauuguuauccuaucuuucagguuaggaaaccgaggcuuaaagaggcuaaguggcacaccuaggucucuguuuugauuauagcaguaagcaguuaagaucauuaucaggcucuuacccguuaauuucugcuucaggccaguggaaugaugaagcauauaucaaauggaauugggggauugcagaauuuccacuguuaagaucuauagauuuaacagcuguuauucugaguuuaaccucaguguuuguacaguucccagguccagauugugugcucuagaaucaauugugcauucuuaucucuguauugcauuuuggagacacagacaauugauuaucagaucuaauguuaacuuagcuuucaggauuucuagaugcugacuauaaacguuuuugaaguugguuguaugcaaacugcugauccugguaacccauacauucucaacauuuuggguuuuuguuaagaauuguauuuuaggguagguuugguggcuuaugcuuguaaucccagcacuuugggaggcugaggugggaggauugcuugagaccaugaguuugaaacuggccugggcaacauagcgagaccuucucucugcaaaaaaauuuaaaauaauagccaagcauguugguacuugccuauaguccuaacuauucuggaugccgaagcaggaggaccucuugagcccagcaguuccaggcugugauggacugugauugugccacuguucuccagccaggaugacagagcaauaccaugucuguuaaaacaaauauauaugaaacugaagcuaauuacacauguuaaccuugggauaauuuucaucuggagcagcauuuauauuuuuuugugacccaguuggugaaauagaaaauuaggauuuacccuguuuacauguuauuuugauaaaaacauaauuuaaacuauuucaguguugucaaaugaguugugacuuaaaauuaauaugcaagcaaauuaugcaaaaagguggauuuguuuaccacuuuuuaccaaccacuuccuuucucccauaccaagcuguuacuaaacuagggcuguagcuuucaguugaggaaacaugacgguugauuauuguuucuaauaauagcuauuauuagaagucagcuauuucauggcauugguuuccagucauucacaccucauuuaaucaugcccugcaucaccuuguugaguuguuaaugcuguuuauuucucaauuuuucuuuuacacuacauugcuaaguccccccaucuuccucuucauagugcuuucccuacccucugaguacuugcuucuucaugcucuggccaaggagagugguguuuuggcagacuguuuuauacauguacacuuauaugccaaucaucauuaguuagaaaggaauuggugaaaaugcucuuauguuaugagagacauguucaacaucacaauagucugagaagaugaauuaacaauuuaugaguguugcuggaaaguaugauuucaggcgauuagacuauaggggcaaagccauugccggcuuaugcuguuggaaucacaucuuaguaguuacauaaugccaucaggaccaguacgagacugguuuggugauugagcccauuuccugggauuuguuccuauguauugcagacagauguccacgcuuaggugugcaugcuccugucaugcauguacacauaauuuuuaaaaaaggagucauagugcauauccuauuauauacuugcuguuuuucccccauugcucucuauucuuuaguucacucauuuaaauaagauaaacauuuuaaugaaaucauauucuuugcaguaacuuggauggagccagaagccauaauccuaagugaauuaaugcaggaacagaaaaccaaagacugguuuggucuguucugcugagaccuaguggaggaggcuaguccaaaauaguagucucccauaaacuuucuuuaacagaauauacacacuuaaaaauuuuguacaugucgucagguugcuuuuaguaccacucuauauuuuuuaucuacaguauuuaauagugucaguuucuccugcacuguuaacuauuagucuuuuaaauuuuuccuagguugaugaaaaacacuucauugcuuuaauuuuaauguuuuuacucuaauuuggacaucuuuuuuuuuuuagacagacgauugcucugucucccaggcuggagugcaguggugugaucucggcucccugcagccuccaccucccagguucaagcaauucucugccucagccuccugaggagcugggauuacaggcgccugccaccaugccuggccaauuuuuguauuuuuaguagagauggaguuucaccaucuuggccaggcagguguugaacuccugaccucaugauccaccugccuuggccucccaaagugcugggauuacagacaugagccaccgcgcccggccgacaucuucuuauuaaauuuuuauuaaauuaaaucuuacuaaauuuuauuaaauauaaaaucuuuuaucauuaguuuucaaauguacaacaaugauuuauuuuuccuguuuuggccguuucagaauacuuguaguuuuccugaaaauuuaugacuucuuaaauauucucuuucgacgugugccugccccaccuccuuccccgcagcuaauuccuauaccucuuuggagaaguagcuuagggaugcagguggagcuuggaucagucuaccuguuagucacaugcuuuacuugcaucccacuauuagcuguucauuuauagaaaggggaugguugcagagucugggcagggaugggucagcuguggcacugugguccuggagagucauacccuacucuuggacaaaaauguuucucuuagcagagaacuggagugagcauauuuuuuuuacucugcuuucucuaaaggcaauuuuaauuuuuaagucaaauauaugggagguagggauaaaggagaaauggaaagauaauagaguuuuagcagucuaggggucuauuuccuacacaagggcuuggaaaugauaagacuaauccugaaauauuuucagugcuggauuucaccuaaccuccuagcaagcuuggaguucucugggacuuggggagcaagaaauuuaaggaagcugacaauaaggaggaagguaucuaacuucugaguagagauggcuugauggugaugauacuugugaacuaggguuaacauacagcagugacagcauuguaaagucugucaguggugagaaaagaugacagugaccuugaaggagagaggcuaucuaacgagaacauacuuaugcguguuggggaguguaaacgccuaccuagacuuucugcuggguuauuuagaauguugagaaguuaauagauucauauuguugcaugcauaaguuuuuguccuacuauuugggauggaugaggaaagagcucagaaaagaaacagguuacaguaacagcccuguuggucuuguuuguuguuuuuccgguacccuuuggccauuuuuaucaaguaauuuuuguauuuucuuuuucaucugccgguauguuauuuuuaccauuuugagugaugucuguggaauaagaaauguuuguaaauauuuugugacuuacaugguaagcuugacuagguuuacacaaagucauuuuguacuaccauuugucugauuucuacaaauacauuauuuggggguauucuuuaauuuuucuuuccccuuuuguccuuaauuccucuuccccuguuccuccaguuaauugaguuacugguuuuauuuuuuaaauccauauauguguguguguauauauauauauauauauauauauauuuuuuuuuuuuuuuuuuuuuuuuuuuggcagaguguugcucugucgcccaggcaggagugcaguggcgugaucucggcucacuucagcuuccaccuccaggguucaagcgauucuccugcuucagccucccgaguagcugggauuacaagugcgugccaccgcacccggcuaauuuuuuuguauucuuaguacagaugggguuucacuguguuggccaggcuggucucuaacuccugaccugaagugaucugcccgccuuggucucccaaagugccgggauuacaggugugagccaccaugcccagcccauauauucuuaauuucuugaguaagcccuugauuucucaugugaccuuuuuucugaucccuuaaauuaaaaaauuuuuuugagaugcauuaauguaaauuuuauccauuuauuuauuuguuucauuuugucucucaaguugguuuauagagauuuaucaacuguauggcaagaaaugcaaaauaaaaauauaaaagaccuaauauaaaaaucuaauauuuauuuccgguggggcccaaauacucuguaaacuucuuaguagaugaugcaaacaaggaaaacuuggucaauuuaugcccauaaaauuugaaaacaaacaaacuuuuaagaaaagcacaacaauuccugguacuaagaucagaaggaaacuucucuucagaggccuuauaaacaggacccuauguaauguaauaaacagugcccucaacagucuuccuacuguggacacaccaacaaauuucagaaugccccuguauaggccaaaugcaucauaccagagcaccuucauuaaggcaguuaauuggugggagaugaggauauugagugaggacuauucaaaauggucugacuuaaaaagggaaaagauuuuggaauaauuagaagaauggagauacugcauauucuuuaggcaaucuuccauaaauaccuguuuuguucacaguuaguacaagguuacuggcauaggguagguuaucaagaaauguuuucagaguaaauacuggguugcauuggguuugaaauuacauuuguuggugcacaucauugaagguagagugauaagauuuucauguuguucagggagacuaguuggcuacucagauggguggcuagaguguacuuugcccuaaacagugcagggcacauccugaaaaguuuuguucucuaggcuccccuuuccuauucugaauccaggcacacacucuaaaaaucuuuaaccuuuaaucuuuucuccaccauucuuuuuuguguaugguguaagguguaacccugacaaacuuuuuuucccccccaaauggacagccaacuguccuaacacuaccuaucccuucuaccaaaaaugucaguuucagucauucagucauuuaaccuaguguucuuuuucugacauacguaguguucuuuuugugacauaccauuugucaacugacagaaaaagaacacuagauuaaauagucuacuuuaaaaguauuuuuaaauaaggagauauaguuuaaauuucgaauaucugugaaucuucacuccccauaucuuuuuugccaugcuaucaagacauaguuaacuccuaguuauaauaaauacagugcuuaucugguauagaugccacugcuuuacaagaguaaaagaacauauguaaaagugcuguccaugggcagcaguucaagggguaauuuuaauucguaccacagguauacauacacauuguaaacugcuuuaguggcuuaaugguuguauuuugacauuguagucaaauuugauacucccaccccaacccucacuuuuaugcucauucuagcaagugcugggaaugcuaaaagcagaauacauagccccuugaagaacaauauacuuaaaaagugaucaccuuaauacagacaugaaaguuuccucucagcauuaagcuagaguuuaggugcuuggaaugauugaaauugauuuuuuagguagaagggccagaugguguugggacaguuggccggccauccauuugaaaaacacaaaaaauguaugucgucaggguuauacuuuacaccguacacaaaaaagaaugguggagagauuaaagauuagacuguucaaagaaaaacucagaaaaauacuaagacaaaaauacaaauaauuuuuauuuaguuuuggggauggaaaggcuuuuuuuuuuuucuuuaagcuaugaauaggacuuuauggaaaggcuuuuuugacaugacacacaacucaaaugccauaaaaggaaaagauggauagauuuaacuauauaaaauauuuaugguucugccuucugaaagacucuacaaauaaaauuaacauaauauaugguagaaaaguauuagccuguauggaacauagagggauaauuuuucuuacuauaucaaguucucuuagacauuaguaguacauaacaaauaccccaguagucgaaguguaugaauagucaauucauguagaauaagggcugugaagauaugaacccugacuagaagccucugcuguaaagacagaaccuucuuuaaguccgauauaaaacaaaaggaugaagaauuacaaaauguaugcuuugguagggcagugaagaaauuaaaauauuagaaaaaagaguaagaguugaauacuggccauuguuuuagagguaauugaggaagcguauuuuauauacucguggguaauuuuacuacuuuaaagguggaaaaaauauuuaaaauaaugaaauaaauagagaagggauuccugcuguuccugauuuaacacacaggacaacagauaaaugauuaugagcuuauacuuagccuaaguuuguguggaaacuguuaguuucuuccaagauaaguguuuccuagauaacugaaaaucuacuauuguuuuaauucacuuuuucuugugcuucugcauaaacauauuuaauauaugccuuuggugucccaaugaaguucaccuuuuacaguugguuugaagcccuucccuagagguuugccaacguuauuucuauguggaaauccauucagaacccagcuucugaaaccuuugcuuuggggacaccuuguucuguaaugaaauuaucugaaaaggccgggcgcgguggcucaugccuguaaucccagcacauugggaggccuaggugggcggauuaccugagguugggaguucgagacuagccugaccaacauggagagaccccgucucugcuaaaaauacaaaauuagccugaugugguggugcgugccuguaaucccagcuacucgggaggcugaggcgggagaaucacuugaacccgggaggcggagguugccgugagccaagaucgcaccauugcacuccagccugggcaacaagagugaaacgccaucuaaaaauaaauaaauaaauaaauaaauagucugaaaaaguucucacccaggagauaacucuccucuccuauuuuacacaucucccuuugauuugccaguguaaagcaauaaccuuagcagaaugaugucuucugucauaaucuauuugucuucauaagggcaugacucaaagaggucuguagaaucuguuuuuuagugccgggugaaauaacuaaauauuucguuuuaaaaggaaggaauuaaucaggaaccuuuuaugauucuagcuacuacugggcuguaaacagugaugccagcaaaauguuacuucagcugaugaagugaugcuguuucgagaauuugaaagcaauuuuucaguggauaaagaaguugacagcacgauuuguuggaugugaugaaggauuaaugagcauacaccuucacuuguauuagcuuaagauggaaugguucugggcaauauaaaauaacagguuuuccaguuuauuuuuauuacuguacuugcuuguuuauaauauuaggcauauuaauuaacaccuaugaagcccauuugguaugcuaagcacuguucuaauguuuuacaugaauugucucguuuaaucuucaugucaacacuuauguaggcaucauuguuauguguuuuauagguguagaaaacugagguacaacgaaguuagguaauuucaaaaaguuaacauaacuggaaagugguaguguuaaaaauaauuugaggguuuugauuccaguuuucaugcuaacuuuaguugacuaaaggaaggauacauugucuaauuuaaucacaaacgcagcuaugugaggaaggauuuuuagaguucucagagccuaaguuuucuuaagugccuaaaaaaaugccuugguuaaggaagauauuuaugguagaaaugcuuuguuauugccaauugcuuuuaucaggauuuuggaccuaaguuaccuguuaggugcuaaaauauuuuuaaagaugaugaagcauccaagugcugcuuguucauuuacacuuuuauuaaguaauugugaacauuaauuaugguuuaacuaagaagcaccaauauuaauacuuuugguuuucagaguuucaaagccgcaauuuugaguuguucggccuguuuagugacagucaaaaaauaaaugccaugcacgagaauuucagcacuaugagcagugauagaagagaaccaagaagaaguguauaccuuuggaaaauguguuuccuguuauagacacauagaaggaccuguugcccuugaugauucugcaaagcuauaaaagcugguacuugaaaaacaugguguaagaaacccaaaucacagaaagacucuaagaccagcuuucuuaccauggugacgcauugaagcacuaaguguuugagcacaucucacaggaugaucuagcuauagaauugacaagauuuugcccuaagauaguugagagaagcaaauguaugcuuucuuccauggcauaauuuuaccuauuuaccuuuuaugugaaauuagcccgaaucaggagucacagcuuaaccuguuuauaugggugaaacuuuccauauugugagauguuguuuuuacuagcaaaguaacaagaaaugaagaaccuuccagaguuuguaacuuacugccuugcuaugaaaaugauacuucagauacagugauguguuuauaaugucuccuuuugcguaggauaaaugcuguaucuguauauguaugggcaaaauucagaaaacuauuaaucauacacaauguauacagacauacguauauucucauucucccucucucccucccccuccuuccaccugccucucucccccgcuuucuuucuuauuuccuuuguuucccaaaaugaauucuaccuuuauuaacucaguugaauuuucagcaagugucuacuaauugagacagaaucuacuguucuucagugccgcuacuuaacuauaugcucaucucuuucuacucauaucucuguuuuauauuuuuacuugggacguuauugcaugguaauuaagaauacuggccuaggaaucugaccgguuaauguuucaauaacugaccaguagcuugauuccuucaacaaauauuucagugcuuauuguauuaggcauuguuuuaggcacuuaagaaaaucuaggcucugagaaguuaacuguaaaagcccuuccucauguagcuguguuuaggauuaagugagauaauguauauaauugcugagcacguuggaaucugucgauuuauguaaacuauuucuuauuaucuucaaaccuuuuaaugacuuggaacucucaaagugaaaaaguaaguaugaacagguauaaauuuauuuuuuuaauuuuuauuuuuuuuugagacggagucucgcucuugucgcccagucuggagugcaguggcgugaucuuggcucacugcaaccucugccucccagguucaagagauucuucugccucagccucccgaguagcugggauuacaggcuugcgccaccaugccuggcuaauuuuuguauuuuuauuagagaugggguuuugccauguuggcuaggcuggucucgaacucccaaccccagaugauccacccgccucggccucccaaagugcugggauuacaggcuugagccaucacacccggccuaaacucuuuucuugaauuaaguuucaggauugacagccuucauuauaacaugucccauguaauuagcaucaugaccacuaucacaaacauacugauaaauauaguacaggacccagauuucagcaccuguuacauagagccauuuguuuuuuuccccucuuauccguagcugcccuccacaaauauggauaauggaccgagaguagacugugcugugucugcccauacucugaaucauauugccaaucuccuacucauccugccucuugagaauccugagcacaggacaccugagauagcaaaagguccuuccuguaguaaaaggcuuacagagucaaauggcuggagcggugugagaauauggacucaggaacuuuggaauugggaguacauuuuagauuagaagauagcauguaaaggaagaaggagagaauuuuugugggucaggcaucugggcauggcucagguggguccucacaagguugcaauuaagauauuggucagagcuacagccucaucugaagguucaacuggggaagcauaugcugccaagcucacucacacaguuguugacuggacucaguuccuuacugguggucgaaccgaggacccugguuucuuccuggcaguuggccagaggcuguucuccauuccuugccauguggacuucucuggcuugcuucagagcaagcacaugagaagagccagauaguguuccagcuggaaaggaguauuagcaagacagagucacagcuuuuguaaccuaauugcagaagugacaucucaucccuuuuucaguauucuguuuauuagaagcaagucacuugguccaccccacacucaaggggaaggggcuacacaaggguacaaauagcaggaguucaugaaucauuggauggccaucuuacaaauccaccuaucaccuaccuacugaaagccuucaguaagcuuuaagagcauacaggagcccugacacccaaaaauuagagaacugcugaucuaaauguauguuacauugguggaacauguaugggagauauaauaccuuccuuaaaaaguucuucucuaggauaagaucuugggccuuggaagccuguauauggggagugcagguaaaaucaggaaagccuccccuuuuugucaacuucaguuucuggagagagggaucuuaauacuacauagcugucuucuaacaucuuuuaggaaguaacacaacuaugacaggaacaguagugaauguuagaaaaaauaaaaggucugagagaggagaauaggagcauauucuugcaaagcagaaauaaaacuuuuuaaaaaaauccgugcccuucagugaaacuuuuuuuuaaaggaucuuuguauguuaccuuaugggaaacucuagaaaucaacucuaaaaaugaaauuuugaguaacaauuuuuagaaugguuguuaaaauggcuaaaagcuauuaugugacucaaauuucuuuuuuuuuuuuuguuugagacagggucucauucugucacccagcuggaaugcaaguggcaugaucguggcucagugcagccuuuaccuccuugggcucaagugauccucccaacucaaccucccgaguagcugggaccacaggugcaccaccaccaugccuggcuaauuuuuuuuuuuuuuuuuuugagauggaguuuugcucuuguuccccaggcuggagugcaauggugugaucucagcucacugcaaccuccaccuacccgguucaagugauucuccugccucaggcucccgaguagcugggauuauaggcaugcgccaccacacccagcuaguuuuguguuuuuaguagagacgggguuucuccacauuggucaggcuggucucgaacuccugaccucaggugauccgcccaccucagccucccaaagugcuggaauuacaggcaugagccaccacaccuggcccagcuaauuaaaaaaaaaacuuuuuuuguagagaugguuucacuguauugcccaggcuagucucaaacuccugggcuuaagcaguccucuugcuuuggccucccaaaguguuggaauuacaggcgugagccacuguccguggcucaacucaaauaauuucugaaaauugugauaggauuuuauuguuuaugguagucauucagucugaacaagaagcuauguuuuucauacucaguccuuacuaaauggacagacaaaaaaauacuuucugaaaaucuaaguuuauuucugcuuacaaaucuaaaaauaagcaagguuauugagaagaauuugaugucaguuaaacuguauuguaauaucuaagauucauguacaaaaauagaaguaaugauaauaaugauagaacauuaaacaacaaaugagcccuucuaucagauuuauuguuguugagaagguuguccuuaagucacuuugaauuuuuuuuucaugaagacccaccuaggagauuucuuucaaauccuaaauaccugaaaaaaguuuugcuuuucuugagaaaucaaaugcugcuguucccccuuuccuccuaaagcaaaguuuagaacauuuucuucuuugcuuuagccaccaggagucuuagugccaaguuuaugccucaguugaauaacuuuacauauuuacauucgaaauauaugcucauuuaaucuucuauauuguuccuuguuucugauuucuguguguuuuacuuuucucuuuaggucuuugcuuaaaaaauauugaaugaaauuauuauuauaaaauuuuuuagugaacuuagaaaauuguuagcuucacaaauaaucuaagaaguauaaauuaacacugagaaacauuuaaaaucagauuguaagaaaugaaaauaaugaugauuuucagugcugacugacaaaugcaguaaauuggacacucauaucuguuaauggaaguguaaaccugugcagucuuuuuguagugacuuaaaacauauaccuuaaggaaauuccuuaaguuuggaaaaagcuaugaacaaaggugcuuaucuguccuucauuuuaaaaaggugaaauuuggaaauaaccuaaauggaacuguuaaaugagcuauuauauaccuauguacuuuauggaaggaguaauacuguauuuuuaaaaaucaucaaaaugaaacugacccaguaaucccauagacaguaaaucgauuaguuuauacuuuuagaugcuuuaggauauaaauaaauugguaacuaugaaccacgugcuauagaguuuaaugcuaaauguaauuuuacaaguaaaucagguuauauauauaugugugugugugugugugugugugugugugauugaauuuuuuuuuuuuccuuaaagaaacagggucucacucugucgcccaggaugaagugcagaggugagaucagggcucacugcacucucaaccuucugggcuuaagugauguaacugccucagcuucucaaguaacugagaccauaggcgugugccaccaugccuggauaauuuuguuuuauuuuuuguagagacgguugcccaggcuagucucaaacuccuggccuugagugauccuucugccucgaccucccaaaguucugugggauuacaagugugaccugccacacccagccugugauacaauuuuuauaucuccgaauuuuaaaauguuuggauuuguaaaggauucuucuaaaauggcauauauucuaaucuuuaccuaaauuuccucguuacccaacuuuuuccucauccaaagcuucuuuuuguuguuguuucaaaccugaaaauauccauccccacuugaguuucaguuuugagcuauauaguacuuacuaggcuucuaucaauuggaacauugaccuguuuauaguuuuuuuuuaaaauucugucuauaauacaaugauccaguauacauacuauuccauacuguuaacuuugguguaggaauucuguuguuggucaguaagguaaguggaauaugucuuuaugacuuauuggaaaagacaaaccuagcuuggcuuuucuacguguuuuacauauguaccuuugaaaagguaugcuuaaauauuaaacaaaaaguacaaguagaauauuuauaccaugcaaucaaacugugcagauuuugaauguuuaaauuuugccauguuuaacuuuuuuaagguugcaugcagagagauaaaacaacaauggacacuagucagauucucauaaccagugagggggaaguaucuuuuucuaauaauagaaugaucuuugguuugugaaaagagguguguaguuggaaguuaauguauuuuucuuuacagaguauacagcaguuuacuccuuuuaaccuguuaucagauuuauuuuggaaagaauugugugaguaauguucugaauuuaaaaaagcauugcaggaaauugaugugugauuauucuuuugaguacagugcccuuuaagaacucaguggguaguuauguuuacuuguuuaacugcaucacauuuauucaugauagacaagacagcaaguuaguagaugaacuuaauggaugaauuuguuuugcuuuguuauaccuugcaagaaagcacaaaacaaucaucuaaggcuuuaucgucuaauuuccaucagguacuguguuacacugauuugcauacauugcuggacuuauuuuuaacagcccccugaacuuuaaauagaaaagguagcuccuauccuggaagaacucacaguucgguagggaaagggaggcaaggagcaggaacagaugagucaacugaaauuauaauacccugugauaaaugcugugaaggauauaaauccuguaugcuauggaaguaauggaauagguucacuuaacccaguaguuuguggggaggagggagaggaagagucaagaaagacuucucaaagaagauccccagagcugagggauaauaggaauuagguugggauaaggcgguugaggggaguauguuccuuguaguacugaacaaacacaagagcaucuaagagcauuucagucuuuuaacuacaauaauagguaacauuuaauauacagugcuuauuaugugccaauugcuauuccaagugcuuuguauuuuccauguauuaacuccuuuaauuuucauaacaacuuuauuauguagguauuauaauuauccccauuuuacagaugaggaaacugagguacagaaagagaaaauaacuugucuaggaucacaugaugagaaaguagaagaacuaggauuuaaacccauguugucucauuucggaguuuuggcuuuuauuaugagaaaaguuaaacucuggauugcaccggagauaaguaccuggggugagaaaaccuuuucaauuaauucuucuuacugaaacacauauauuauuuucuuaaaaucugaagcaguggauccuauccauuuuuuucugccucuguaagaauguuuggcauccuuuaucuucucaucuccaagcuuucccuaguaaccagcccucuuaaacuucagcauucucgaacuucucccuucuguuuucucuagauaccagccuuuugcuuccccuuaucuccagacuucuuuguaaacuccucuaaacucccugccucugcuauauaacuuucauucccuccucaucccauugaaaucuggguucuaaagagagauuuaugaggaaacuugcuaggcaguguaggguuaugccuucuuuuuguuuuucuaauagugcuugacaggucaagguguagaaguaggaguggagauggcagcccuccaggauuggggucuuuguuaggauguggaacagaaggacaggggagcaagggaguggaaagucuugacaggaaugucauucauggacccuguggucucaguagaauuuagaaggaagugaagacgggagugaauugauggucuaggggaaaauggaagagcaggaggucaggugaauugcagaaaagcucuuuaaugggaguaaaagagccagaggucugggaguauugagguaguauugggagaguuuaaaguuuuagaggaggaacuguccugagugauacauuucaagaucugguggucauuggugugaaugacugaagugacagucgugagaguucaugcugacucaccuacagugaggaugggccuugugugugcaguggagcacugugaugagcaaugaaauaaugaaagcaucauuugcaagaugguguuaccuuugcccacuucuugcugucagaugguagauacuuauuucauuaacaggaguuauguuuauuuuuguaauugacauuuuauucuuguuugcauagaauaaugcaaaaucuucauugaaaaggagcaguaucuguaguaucaaauucuuuugugugucauuuuuuuuuucaguauauuuucuaacauaacacuuaacauuagcaguauuuugaccuuuucugucauucuggacaaucuguucuggcauuuuccuuccggaaaauagagaagagaaaaaaauaugagaugaagaacaaaugguugggcacucaucuuuaauuuugauuguuagaauuguuuagguuguuagaauucugguuguuagaauuguuguagauguuuggggaacauccaucauggaucagauagaaaagaaaacaguguuuuuggcuuauuauuacuuugcuuuuuguuuuaauuuuauauaguuauaauguuacaaauauuucucaauuuaaauuauaguguuuaaauuuuagguaagaauggaaaaugaugccuguuaacauuuuuauucuugagaauguugccacaggaacauuagagaaaaaaaguaaucuuguguuuugagagaauucauuuguuguugacauuccccucagaggauacuacuuugauauguacaaauaacaaagguagcaauaugguuuguugguuuucuuuaaacuuuggcauagccaaaccuuuaguggacccuggaggcauuuucuuaucaacaaaguggaucaaacugacucuaaaagugguuucuaguaaucugguaaacagaagaaacauauaagggcccagcauauccuaaacauuucaauuuucugauauacuagagcacuguuuuuaaaaauggauuuuaauaacauugucuucuuaguuauaaguuauuuuauuucuccaaauuuuguuaccuucccuaauuaugcucaguuuaggagcauaaaugaacacauauacacagacuuuauuuugcuggaauucuaaaagcaaauuaagacauuauuuuaguaguuucagaauuguguuccucaagagaacaguaaagauuuaaguaacaacaguuuugguuaauaacagugaaauuuucuuuuugugagguguauuauaagaacaucucauaugaguagaacaugagguauuuuagcuuuaaagcuaaucuugggccaagugugguggcucaugccuguaaucccagcacuuugggagacagaagcaggugaaucacuugagcccaggagugugagaccagccugcccaacaugugaaacccccaucucuacaaaaaaauccagaaauuagccggugugguagcaagcgccuguggucccagcuauucaggaggcugaggugggaggauugauugagcccaguaagucaaggcugcagugagcugagaucaugccacugcacuccagccugggugacagagggagaccuugucauaaacaaacaaacaaauaaauaaauaaauagaauuaagcuaaucuugaauucauuuguacuuaacuaauuaggccuaguauuugucaaauucauauauuauuugguagaguauggagggaaauauacuuaaguguuaguuuggagagguaguuuuaguauguuauuggggaauuuuuacuuuugacuuucccucauggucucuguauaucaaguacuaggaaaacagcauuuuuccauuaaagggcucauacuucuuggaacuucuggucugacaggcugaucuuguuugugugacuacauaggcuauguuuagguuucuuuacguauuaggcuuuacaaagaagaugaaaacaccauaucacuuuugucaucacggaacauauuacagguuucauaauggauaacguaaaauaauucagcucacuguauuuuuuguuucuucguuauaucuuuuuuuuuuuuuuuaaacagagccucacugugucgcccaggcuggagugcaguggcacuaucuuggcucacugcaaccucugccucccagguucaagcaauucuccugccucagccucccgaguagcugggauuacaggugcaugccaccaugcuuggcuaauuuuguauauauauauauauauauaguuuuaguagagaccggguuucaccauuuuggccaggcuggucuggaaugccugaccucaaguaauccaccugccucggccucccaaagugcuaggauuacaggugugagccaccgcugcaagucucuucuucauauccugauuauuuaaaucaaauguauuucuuuucugaggucuuggaguuuuccccauguuuuaaaauguguuuccuuaccuuuuaacuuauaacagaaucccuuuaagacgcuuuuacaaaugaaggccaugcuauuugcuauuaggauuaucugaacagaccaacagagaguauauuugaccaacaguccagguuucaugugaagaaggagaagcacguauguuuguaguucuuuguaguuugugccuacaaaacagcagucaccacuaaaauacuuauuugaaauauuuuaaagugcugagauuacaugcgugagccaccgcgcccggccugaaucuguuuuuaauguuaauuuuuuauuuuucucacugaaggggaaccagcgcccuauuaaacuccauuguugguaauuugagaacacaaaccaauuaauaucuauauucugaauaauuauauaguuaaggugcagcuuuuauuauaucuggcuuuuuacuuuguugcaaacuccaaaccaaagaauguucauaacuguccuacagcagugaaaugaauuaaaguaauucuggucauuagaaaaucuuuaaauuauuuuaagaauacguaacugacugugauaacuucuuguuuauaacagguuaacauggaugacuaguuuauagcuuuugaucuuauguguaaugacacugggaagaaaacauguaucccucuaagguagcauuucuguuauuucuaugcccaaagacugugcugaccgccauuuugccagaagcuuugaacacuguugacugauugauguguacaucuaauucagauuuacauaaucuaauuggacccuuggguucuuaaaaaauggccuucuuuuaucaccauauguguucauuacaaugcauauuuuaaaaugagauggcccaaagagcaugcuaugaugaauuuacuguugaaauacuugugaaacuuggauaaaccuaauuaucaagggacaguuucacuuaagagggcaaaaguuucacuucaaagaaaagccuacugcucuugcuuuuaaugguuugaauuauguuuuuaucuuucaucagcccaagaguuuguacuucagggucagaaacaaaacuuggagccucugugaauccuguaaucauuuacuaacucucuuguagaacaagaugucauuuuuuccuacuauucuguuucauucuuuauuuuucugcccccccccccccaaacacacaggagaguggaacuugggauuauaauugguuaauggguuuuuuggguuuuuuuggucuuacucugucacccgggcuggagugcaguggugcuaucuuggcucacugcaaccugugccucucaggcucaggcgaucuucccaccucagccuccugaauagcugggaccacaggugccugccaccacgccugguuaauuuuuuguauuuuugguagagacaggguuucaccauguugcccaggcuggucucaaauucuugagcucaagugauccgccggccuugaccucccaaagugcugggauuauaagccugagccaccacguccagccagaauuuuuuauuuuuuaagaaagaaaguuuaucuuagguccuccuucccccauaccccauuuuaauuuggugccagguuugccugucucuguggagaaaagaauagaaauguuggcugagggaaaguuuuuaugucuccucuaauacguauuucauuuuuuucuauuugcuccuugcuuuucuaauacagguaggauaaagaggcaacuucaggaauacccagacuuuagcuccaucuaggaauuuuuauugguuuguuuuuugacuagaguguagaauggaagcucuuuuggcuggguuggguccuugggcaaaauauuucagacuccuguauuauauggugaauuaaauugcuucacuggcacuuuuucuuuuuuaaagccuguucacacuuuauacaguuuuugaagaggaaaacuuuggauagugcucuuucaaaccaggcaaaugccucgguuucuuuuaaaaaaucuuuguaaaauaauaauauuagucugacuuaaagguuaugauggaauacauauaaaacauuugggagucucaauucuauuuaauguagguucgaucaauguuacuaaugugcuuuagcugcaauauauuaauauuuguuucuuagcauccugaggcuagccacuugccucuuguucaccuuacuaguacaacuaaacuagugucuggcccugaaggugggcagaaaauauucauuaaauugaauuuugauguagggauaauucuguuucuuugugucuugccuaaguuuaauucaugucauagucauguuucacauguaucuuaauucuuacugcauaaaauguucaugcaaaaggcaguauuaauuuuacucauuguuaacaaucagcaaguacuauucagagucugacucauaaccauagaguaucuugaugcuauaaucagaaacauuuauuaucccuggcuuuagcaguugaacuuacaggauaauguuuaguucucauuaucagagaaaaaggugauucagguaauuucuucauuuguucguuucucuaucccucuaccccagugucuugaaaaaauauuuagcuagaaugcucaaaaaugguguguuagcauucauuuucuuccauuaggugauuuuuguugacuaucauuaauagcaauauguaagacuuacuauucauuugccuauuuauucauucuacaacauuuauuguuuuucuacugccaggaacaauuugaagugcuggauauauuuagugggaauugguuuucuuaggcagauuaucaucuguuugugaagcuuuuucacaguguacgugccuggccccaaaucuaggagauucuuguuugguauauuuggugugguguaaguucaggcaucuguauuuuuacagagcuuuucaaaugacucuaaugcacguuugcuuuugaguaccauaggaauaaaacaagucucauucaauagguacucaaaauagguaaaugcaguaaaguuucauagaugcuguaagagaaacuguugguauagugugggcacaaagcaagaaguccuacuagguaccucaggaaagguuuccuaagaauagaaaugccuagcugaaucuuguucuccuaaguguuuuagaguagguggaacccaugaaucuauagauuagccuaaguaaauuccaguaugcagggcaaugugaacaaaaagagagaggugugaaacagcuuacagcauuuuggaaauugcaaguaguuggcaugauugaauuacuagaugaggaugguuaaaaauaagauaguuuuuauggugcugaaaacaagcauacauuaaagaauaugaagaaaggagaauaagaguagacuugaacuuuagaaagaugacagugaugguaugaagcauagauuggagugguaugagaauggagguagggaaauggguugacauagccacaagaauccauacaagagcaauucagaggccucaacuaaaggagucgcaguuggagaggaagaggauuggaaaaaagaaccauaaggagguggaaucuuugagaaucggugacugacuggauuuaggagacaagaaagacgaaguaauuucucaccuauaugaagaauaugguugaugugccaaacaucaaggugaggguuuuaaggggaugauuagguuuuaaaagaagauaaugcagaugggaggaggaaaugggaacagggaggcauuuaccuuggauaagagaagguguagagaacaucuguguuuuugcuuggagggacucacuccuuuccuacuuuuaguccgugcuuacggggugguguuuacuuugcuucaggauucaggauuguguuccccuaguuacaugguugguucaaggugggcacauuacucuagugaagccagucacagcuuuugcuuuuguuugagcuguaggagaaagauucuuugugcuuaaaccuaggggcugaugaaggaugagagugguucuacaacuuaucuggccaucaacgggaagccugagaauaagaaaauacaaagagaggcaagcugaguguguuggggguagaagagaagagagagggaaaagggagaaguaucagguugugaaggcauugccugagugucagaaaugaacucuacuucuggcuauucuaguuccuugagacaauaaauuucuucuuuuuuuuuuuuuuuugcugaguuuguguuggguuuucuguucuuugagauugauaggguccuaacugguauagaaaugauaauaauuguuguugaagcaggagacuagaugauggagauaacauaacuuuuuagaugaagaauuguugaggauauucacaccaaauaacuuugaauuucaacuugagaauaacugagguuaagugaguaacugaaagucaugcagcugagaguagaauucagaucucagaaucuucagcuuagugaguuuauaccauaucaucucacuuacgccacccgaaaaguuacgaaaugauagucuuuggauguguugccuuugaauaagggagaguaauuuauuuauuuauuuuuuccccuuggugguuguauuuggaaaacuuugggauguagcaguacaaugacuuuccugcucugaagagccugagugaaugccuauugauauauuagagucugggugcacugguuauaacuacacaaaucuuuauuuugaggcagucauaauuuugaguugcuucagggagagagauacuuauaaagcaguaaaaaccuguccgaaugugacuguaccuuuucacugucuggaugugcuuguggaaaaugucucccuaggaccuuuaauuuuguuccuaaauuuacaacagagccacuucuugaugcuaucuauugcucaagguacuguuggcgauaagauuguuauuaaguuggguaggugagcuguagacuguguccugcagggaaccauuuauuguuuuguacaagaauagguaguggugaggaaucaggucucauuuugggcaucaaauggucucucacuuuaaaaucugacauuggcacuacuuuuucuuugauuuaaacagaaagaccagcagauguucaugugagcaugaggauaacuuaaaaacaaccauuuuuuuuuaaggcauuggcucuauuuuauuugcucuaugaaaaguaaaaacaaggaagagcacuacaguaacacauacaccuauguccaaaugaugagagguggauggcauuuuggccugaugucaguuacuauaauucuuuccccagaaaugucuuucuuuugagcccugacgucgauuuucaguugaaaauguuggaaccguauagggcugaacauacauaguagcuucaaaucuaaagaaauuugcugagaagugaaauaaacuuuuauuaaaacuauuugaggcaaaaggguauugaagaaaaugggaaauguaaacuguaagugauugcauuguaggaaauauuaagggaucuauuuagacaagacuuuggcaacuagagguaauaauaauggccaacauuuaaugaacacugaugaugugccugacacugcuaaacuguguuaucuuauuuaauacucaagucuuggaagcagguuuuuuuuuuuuuuuuuaaaggcaaggucuugcucugucucccaggcuggagugcagugguguaauuauggcucaguucacccucaaccuccugaggucaagugauucuuccuccucagccuccugaguagcugggacuacaggugcgugccaucaugccuggauaauuuuuuuuuuuuaauuuauuuucuguagagacagggucucacuauguuuccaggcuagagguagauguuuuuaacuuccauuuuacaaaagaggagucuugagauuuagguaaaauaauuugcccaagguuccaaagcuaagcugugauugucaugugugucaccgcugagauguaaacauaggcaagcugauucucaugcccccacuuuaaacaauauguuauagcuccagaugaaugaauaugcucuuaccucuaguuauauugugacuccagaagugacugcggguaacauuuugcuucauuuucuacuguuucuuauagcuugugagcaucuccauauuuuggagggagugacugaaagacacaagaauuagcaacuuucuucauauuucuuccccuucugaaugugccacacuguaugcgauccuuagcaauuguuugacaaccaguuauuaucaaacuugauccuuuauuuccuucauagcacuuacaaauugcaaaaaaauuauaauugcauuaauuuguuuugcuuucuucuuuacuaauaauauccagcacauaccuaauggccaggucuauuugucuaucagucagugagauuauauagauauaugugugugucuguauacacauguguacacaggaggaccuguguaagcuguuaaucagagguuggcaaaucuuuucuuugaagggucagauaguaaauauuucaggcuuuguaggccaagaggcaaaaucauggauacuauguagauacuuauauaacaagagagagaacaaauuaccauguacuuuaaauucagaaaauucaaaauauaaacgaauagaauaguaauugaguuaaaaacucuugcaauacaggucuacuaaugagaagaauagaauuauuuggggaggacaacauuuugccuaauugggguccaaguuuaguguuucuuaucaaaacuuuugcaaauguucuucugcaaaaacuauucuuggcuuguggaccauauaaaaagaggcaucauaccagauuuugcguacaggcuguaguuugcuaaccccuguuuuuauugcucaugugacuguugggucagcuaggugauucugcugaucuuaaccaggcuuacucguguaucuaugaccagcugcuguguuggccgaaguuuguguaggcuaagaugcuucagcagagacagcuuguuucugcuucacaugguuuuaucccgaaggaggcuggccuuaucuuguucaccuggcagcugagcaguguuauaaacgagggaguggaaguauauaaggccuuuugagacuuaggcuaguaacaucauuuuuauugcauucuauugggagaccaucccagauuugagggaugcagcucuugaugggaggagcagcaaaggcacacugcaaaauggcauggauacagggaagggaguaacugcaaccaguuuaguaaaccaucuaccgcaauucaguuucaugaccgugugguauuuuguugaauaaauaugccacaguugauuuagucguuuuucuuuugauggacauuuugacuguuuccaguucuuggcacuuauaagcaaugcugcucagaauaauccaguauauaucucccugugcguacauguuaagaguuuuauuaaggggggguguguuuguguguguaagauagagugcauggacaaaauguacaguacauauguaagccuagaaguggaauuguauguagggugugcacaucuuuagcuuuaucagauacugcgagagugacuauaucaauuuauauucuuacuacuaguguaguucuuauugcaccacaucuuugccaagauaguguaauuuugccagccucauugcacaugaaauggcaucucauaaaggguauaauuuguauuuucuuuauuguuaaugauauuaaguaucuuuucauaugcuuauugaucauugcguuucuuuuuuuuuuuugagacagagucucgcucugucgcccaggcuggagugcaguggcgcgaucucagcucacugcaagcuucgccuucuggguucacgcgauucuccugccucagccucccgaguagcugggacuacaggcacccgccaccacgcccggcaaauuuuuuguauuuuugauagagaugggguuucacuguguuagccaggauggucucgaucuccugaccucgugauccgcccgccucagcuucccaaagugcugggguuacaggcguaagccacugcacccggcuaauuguguuucuucuaugaauugccaguuaauauauuuugcuuguuaaaaaaaucguuacaucuuucauugauuuuuaggaauuuuuaaauucuaauucuuuuuugcucgguuauguauguucuaauaucuuucccagucugugauucaucuuuguauuuuuuaauggacuccuaaugaaaacaaguuuuuaauuuuaauacuauuguauuuaucagccuuuuccuuuaugguuuguacuuuuuauguguuauuaaagaaagcugucucuuccagaucuucagauucucguauguuuucuuaacguuugcuuuuuuaccuuuugauccuuagucuaccuggaguugauuuuuguguaugguaugagaugaggaucuaauuguuuaaguauauggauuucuaauucucucaacaugauuuguugaauuuuucccucuuuccucagcuuuccugcauugccaaagcucugucauacagaguuuccacauauacacauguucuacauuucuuuugacgcuaauuuccuguauaggaaaguuguucgguuuucacuuuugaagcuggcacuuuuuguuuacuacuauguuauugccugaguagucuugacugaacugugcccuuaauuacuuuggauaagaguagguagcaguuuuuggguugcucacuauaugcuagauuaguauacuuaaaauuuuagugcauuuaaugcacuaaaauuuuaaugcauuagcucuucaugacaguaguaugaauuaacuauauuuuuuuguuccuuuuagaaauuaguaaacugaagcccagaggaaacuuaauacuuagcuaggauuaugaacccaugccagcuagcuucagggucucaacuuuaaaccacuauuuuauaguauuucucauuugauuuauaaaugucuugucugauuugaaacauuugaauaggagagugguucccagucaaccauaacauaucuaaaauuugucugauuacugauguuuaaagagguaauuguuaaaaugagucaagcaagcgcuauaaggacuaguuacaguuuauuuuuagaauuuuauuagguuuuuuuaaauggucaccuuugagaucugccccucuccccugccacucaugaaaggaaagaugcagaaaaugauucuuuauuuuggaaaacuauuuuuguguuuuuagaugucuggauuuuucaugugugcacuagcagaggauucuugcauaagauaauggggccagugagcaugaacgguuguagguuggagaugugguccucugcauggguuauuuuucuuuuuaagagcaagauauagggauagauauagcuguuggcacagucuaggggaacacauuguuuuagauaaucuugccucuuccugcccucuagccaagcuucugauaagcauuuugcauugaggaugaccaacuuugaucucuccacucaauuucccauggcacuuguuaucuguaccagcucuuuggaaauucauauucaauuuaggauuugauuuuguuuuuuguuuuuuaagacagagucuugcucuguugcccaggcuggagugcaguggcacaaucuuggcuuggcucacuguaaccuucgcuucccagguucaaacgauucucauaccucagccucuugaguagcugggauuacaggcacgugccaucaugccuggcuaauuuuuguauuuucaguagagaugagguuucaccauguugcccaggccagucuggaacuccugacuucaagugauccgccugccucagccucccaaagugcugggauuacaggcaugagccacugugcccagccuugauuauguuugauaacacuuuuguauuuuucugauugcuuugaaaauauguuucguguaccuaagaauagaaccuuaggaaccuucuugggacagggaugguguuuuauacuuauuuuuaaucaucucuacagucuuagcacagcagcuaauuacagugcagguguucaauaaauguugcuuuuuuugagauggggucucacuauauuguccaggcugaggugccauggcuacucacaggugcagucauggcauauugcagccucaggcuccuaagcuuaagugauccucccaccucagccucccaaguagcuggacuaggggugcccaccacugugucuggugcuucuuucuuuuaguguggcuuaacuaaugagaccccagagauaagggcaaauuuuauauuugauuuaaaauuguugaguguuuuauucaacacuaauuuauucaguguacuuuguucagcgaauugcgggaaacacaagaugaaucagaaaccguaucugcccucaaagggacuaaguucuuaaacaguuuaaguuauaaauauaguugcuugcuucuguguacauacguacccucuuaguuucacagagggagcuagaaguuguuuauaauuuaauugaggagaucaaacauaugaagaaaaaucauucaauguagaauguggugagucacaaagccccuggggauggauuuuguacuugagguggguugaagaaagaugcuuagaguggcaguaacaagggagcugggcccucaauaaagaagguaggauuuugacagguggguuaaggauggagggugggguugcauuuaagaaagaaaaaaacagugugaagcaaggucugguagaggcagaaaaagcuggccauguuuggagcaaaaguaguucaauuuggcuagaauauaggagagaaaaguacauaaauuggggccaguuuauguagagucuuaaauaucaggcuaagguguuuggacuuaauucaguagacaguggggagccacugaaguguuuugaguaauaugaucugagccauacuuuuggaagauuaaucugguugcauugucaguaaugaaugagaaaaugaaaguguuuuccauuguuggaacacuuuuuuguuuucuuuauaaacauaacuaaaacaaauguaagcuuaguguagcuaucaaauaacacuaaaaaccuuuauuaaugaaaauguaagaaaagauauguuuuuguauauccagcuauuuuaaaaaacaugucggccgagugugguggcucaugccuguaaucccagcacuuugggaggccgaggcgaguggaucaccugaggucaggaguuugagaucagccugaccaauaugaugaaacccuguuucuacuaaaaaugcaaaaauuagccgggcgugguagcauaugccuguaaucccagcuacucaggggguugagacagaauugcuugaacccgggaggcagagguugcagugcgccaagaucgggccauugcacuccagccugggcaacaagagcgaaacuccgacucaaaaaaaaaaaaggcccuauucaccuguuggcuucuaauucagauuuuugcauuuagccucuucagugaguuauguaccacagauagauauaaacuuccaaaaacacaguuccgauugguauauuuuacuacucaaagccuucaguaucucuccauuuggcugcugaauaaaguccagauuucauaccccaacagucaaggcccucccucauucaucucuccuacuacucuacucucuggcuguuucagacaaacuauucuuaagacuccuugugauuuccuacuucuuugucucauuuacucuaguucuugugaccuucauagagucuuaagaauaaaagggagggaagauauguugaaaucuugagaacaccugugaguaggucauauguggcagagcugggaugaaagcucuucuauuacuuguuauuuuuuguaauugcuaugugccagguauuguggccaauccuggguuaugaugguaagugaaacaaaagugaucucugcucuuuauaccuuauggucuauagagacaaauauuaaccacuauauauaguaaaccaauguugcaauuacaaacuuggauggguccuaucaaggaaaaguacuuugagguacuuuaagagaagauaaugggcaaagggaguacagcuaauuuauagugguaugucaggaaaggucucuuuaaggaaguguuuuuuuuuuucuuuuuucaugcugccccaugugauuaagaggaaaugaauuuuaagcugagaacugacauaugagagcauguagguagggcaaagaguggagaagggcauucuaagcagagugagcaguaugcaccaaggcccccaaguggaaaggaauuugggguauuagaugaccucaaaggucaguguggccagaacauauuuugauuacugaggaguaagaugaaccuggagaguuaaggaggaaccagaucauauagagccuuuuagaccauauuggauuuuguauuuuauauaaaguacauugaaaagaaaauggcaauugaagggcuuuugaagagugacacaguccaguuuguguuuuuaaaauaucacugugauuaauaauauauccaaaauucagccacuucuuaucuccacagucuccacccugguauaaaucucauuugaauuagcuagucucagcuuccacccuuccagcccuacagcuauucuuuuuuuaucuuuuuucuuaagaaauuuuuuuaaaaaaauuuaucauggcccaggcacucacaccaacagccuauucuagacaguuaccaguuuuuuuccuuuaaaauguuagagcaugucucuccugcuccagaucuucccacgguuucccauuuuacucggaguaaaucuccgagacaugcucccaccucagggccuuuacacuugcugucucguuugccuaggaugcuuuucucacagauacccauguaguucacuuccuaaccuccuucaggucuuuauacaacuggugaauccauaccagaccccaucccugccaguccuucccuacuuuauuuuucucugacuuucauacuagaauguaaauuucacuggauaaagaauuuuguaagagaguccuguacugaucuauucucaggauguguaaugcuguauauaacaggcauucaguaaguauuaguugaaugaguagcuugguggagucuagaguagcagcugagagaacaguuuaaagggucugagucuagaugagagaugguggcugagacaaagauuguggaagaugcagagaagcaggggauucaagauacauuuuagagauagaauuaacaggacaguucacaaugauaagauaacuuaaguuuuugccucacaaguuuagcguuucuucuauuaaaccauuaugaaaugucauuguuagcuaguaauuuaaguuaguaauuagguuauucagagucauugauuuagccugugucuaaaaccaagcaauguagauggcugccaaauucacuaauggcagcagcauguggugaagguuaaagaagauuugauaacucuuuuagguauuuaaaauauuuguauauuuuuaaaaaucaaacuuaugagacagugcaugcaguagugaaauguauauauauagcucauuugaggaguacucuuaggguugugguucucaaauagggacagucucuugccguacccucccccaccccccaacauuuggcaaugacuggagacauuuuugauugucacaaccugaagaauggugcucauggcaucuagugauuagaggccaguuaugcugcuaaacauccugcaaugcacaaagucagucuccuccccucucugcaaagaauuaucugguccaaaaugucaguaguacuuagguugagaaacccuaccuuagguauuaaaacucaagcuucaauuuaugucaaugcuaagccugcagcuacacuguuaaauccacagaccuguauacuucuacaacuuguuguguauacaaggugugauuagaaugguugcacuuuuaaacaaauauaacugacacacuugcaugcuuaugcacagaaauccaguugaaagcuccaccuucacaauaguucucuugggaagaguuugcauuuauaugauucugccauuuuuuuaaauuuauuuuaaguuucaggauacaugugcaggaccugcagguuuguuacauagaugaacacaugccauagguucugccuuuuuuauaguugccuuugaaaccuggagcauacccuuuaaaucuccuuaaugguaccaaauuaucuuccgaagguggauuuggaaauauccagugcuuucugaaugcauugugauggguguaaucagguuggguaguaauucuauuguaaggugaaauugagauauggcuauaaaauaauaauuggugguuuaaaaguagugcuuuuacaaaaucuuuucaucgguaauuaagugugucauaaucucaauuugaagagguaugugcagauguucuagaauuauuaaaacaaaaucaguaucagaaugucaaauauuuaaaagauuguugucugggaucaagggaaacagccacugucacauaauauugggaagguacuuuggcacaauuugguaauacuauuaauuuuuuuuuuuuuuuuuuuugagauggagucucgcucuguugccaggcuggggugcaguagcaugaucuuggcucacugcaaucuccaccugcuggguucaagcgguucuucugccucagccucccaaguagcugggauuacaggcacgugccaccacacccagcuaauguuuguauuuuuaguagagaugggguuauaucguguuggccaggauggucuugaucuccugaccucaugaucugccugucuuggucucccaaaguacugggauuaccggcgugagacaccgcaaaauguucauauuauuucacuuaggaauucugucucuagccauuuguuuacagacauuuuuacaccaguaaggaaagauaugaaaagugcuguuucuuggagguuuguuuguaaaguggaaaaauuagaaacaacccaauaccuguauuaauaguauuaguauugugaucaguauuauugaucacaaaucauuaguauauccuugaaguaaaauacuauacaccaccaaaaaaugaagguauaauguguacugauauaaaaagagcuaucaaauauauuaaaugggguggggggaaggaagcuguaaaaaggaaaaaaaaaacccacaaaaguaguagguauggcaugugauaccaaacuauauaugcaagacaugcauagaagagagaccuggaggaauaaauacuaaauguaaugggaauaggauaguuuccuauauuucagacuuguuugauuguauuguaauguuuuacaaucaggaaaaaaaaacuaaaaccgugagacagugaucuuacuuauaacuagcucuuuuaagauuuugaagcaguccuuuguauuaguacauagcuaccgaucuuucugcaguucuguuuuuauauuaauaaauaccuaaaauuggccagagauuccuagggcauuguucuucaucugaaguuauuuacugcuuuaaaacauuuuaaaauucuucauugugaaaguaucacaguuacugugucuuuuuuuuuuuuuuuuuuuuuuuuugagauggaguguuuguugcucuguugcccaggcuggagugcaguggugcgaucuugacucacugcaagcuccgccucccagguucaugccauucuccugcuucagccucccuaguagcugggacuacaggugccugccaccaggccuggcuaauuuuugguauuuuuaguagagauggguuuuacuguguuagccaggauggucuugaucuccugaccucaugaucugccugccucgagccucccaaagugcugggauuacaggugugagccaccgugcccggccuacugugucuuuuuuaaaaucuugggcuuugaaauaccagugugguaaacugcuaaucuguguuuacccugcagguggcgcuggugguuuugugguguucuucagcgugacucaaguaaaauucccuucagcugggaaaucacuuagauauugguucugcuuguagaauguuaucuuucauguaaucuguugaauaucagacauuuucuuacuauuauuucaagaaauacauguagcaggaaaaaaucuacuaacaaauuauuaggauauaauuauauuuuauaccuuauuuaucuacuuuauuauucauuacaauuucugggaaaauuaaauuuauuucagcaguucauuacuuuccaacucccuuaaaauuccaaaacuucaucaaaaaacuggcaguagaacuaauuuuuucaaauuaauucucuuugaagucuuucauuuuccuuucuguuugugugucugacucccccuuucuuucucucagucugucaaguucaagagcagcucagaugccaugaauuaaguggagcacaaaagggggaaaggagacccuuuugaagaacaaaggccucccauuaggcugccauguucuuuuuugaccaaaagugcacccuacaugguuucuauuguuguccacaugcccugcacauaagguaaauacagcagauccucauuaccucacguuuuccuccucuuccuccuaugccacacacaaccagugaagcuuugggucuuugaugucuuuaggcauucuuauacaguugcuuuaucuccuuuuaaaaaccuacagggguagaaguggaaguggagagcaaugcacaccgaguaguaaaaccucacaagaagggaaaaugagcuguuagagaagcugcaacccaggaauccagggcaaguggaaagauccagagauuuuacuguuguuguucucuauucucugucuuuuaauccuauagcuuaaaaauccuguauuuuuaaaguaauaacuuugauuuacauucacuauaguuuuuccucccuuuguccguguaacaagacaggcaggugggaauaaauuuaauugcugagagcaguucauguaaugaucagaaauucuugcuaaucugcuccuacuuauuggauguuggcucuuuggugucauggagauggcuuuacuguagguuuguuguguugcauuacuuuucauugggauugaacugagaaauaacaaacaagcuuuaagugggaaauuaaaaaaaagaaguaaccuauguagauccaaacuuaaaaugugagaaauuauugaaauuucauuuucuacaaacuugaaauuagccugcuaauuguaaaguuguuuuaauaaugcugacaaaugucaguuacguuugcaaaggaguguaugguucuagguauuugccuacuguuaaccguugagaaaaacauugucagguuagcaagucuauugaaauagagaccuccuuaguuuacagcaaagaauaaauagcugaugacuggagauugggacuaagguuuuauuuauuuauauucuuugaaagaaaucggacaguuaauaagugguuugugguagaguugaaggaugucugagagauggaaagagagugacaaaggaggagaaggaauaguauuucuuuuuuaguauuguuuugaaauuaaaacucuguuauuuuaauaugguaaagagcaagaguuggguugggcgcggugacucacgccuauaaucccagcacuuugggaggccguggugggcagaucaccugagauuaggaguuugagaccagccuggccaacauggcgaaaccuugucucuacuaaaaauacaaaaauuagccaggugugguggcacaugccuauaaaucccagcuauuugggaggcugagacaggagaagcacuugaaccugggugacagagguugcagugagccgagaucccgccacugcacuccaaccuggacaacagugugagucucugucucaaaaaaaaaaaaaaaagaguaagagucgaacuuaggacaacguauguuuucuuuuuuuucugacguugagcuaauggugggcaauuugugacuuaacauuuagugaccaccuugaacucucccugaguuugugggucugcccuuuuaggauuauagaggugauucagugguguuaaaaacaacauuaaagggauuaaagaaguaauuccuuuguaggaacaguaguaacauuuuauuuugaaaauuucaugaggaaauuuuuaguauuccuauuuuuuuccccauauguucuucaaauaaauauacauagcacauucaacauuuuugguccuaagaauuucuuauauuaaaaucugacuagcauagcugaaguuaaaaaaaaaaggccuguuaacuacuugaggaaauguuuugacucuuuauggacccugaauauugcuuuucaggaaguauuccuuguuuuguuuuuuuggguacagcagucugcaagaagccuuugguuuauguacuuggcagcaaaauaaaaggcaaagagcuucuugcuguguguuauguaggaaauuaccauuccuguugucuguguaggauguucuaaagauguagccaggaaucucagaggagagagagaagagacagagagagagagacagacagagagucagacuuguaguucuaauauuuucuugcuuuugccucugccucuggucauacauuggauuguuuuucugcuuuuguuccuugggguggcaucugucuucaggagaaaucacuccauagucaaacacagauugcugaacuguggcauuuuugcuguuacuguuauccugaauuuacugggaacaguuuuaauaugggugcauuuaaacacuuguuuguggauagggagagauggagagugaaauuucauucucuguugaaugcuccgucuccugcccagcacauuucugccccuuccacaugguuuuucacuaacuccugaauguuucucuaugcuaaucugaaagcucuacagcagagacuacacauuuauacaguuccccacauacagggucacuuuaugaaaugaauuauuucuugacauuuuucagguuugugauuguaccuuuccaagccaguguuaacacauuucaaauauugugaaaaguugaauuuaugcuagcauuguuuuaauuauuuaaauaacuuaacauuuuagaaccuuguggcuuuagauuuaaagagguaucaaguccuuaaaacauuuucgguuauuauccuaauauuaauacaauaauagucauuagacaaauaguaaauuuuaaaaagaauaaaaauuaaaaagaacaccuaacugggaaagugggagagaagccauuuaaaacaauaaacugaaacucuuuuccugaguuuccuuagaagccauuuggacaauuaauggagagauuuuaaacauuaaauguauuugugacuaaaacuugccuuuucaacaagacacccgaacugccaagacuucacaggggucucauuguagagaauuaaaauucaaugaugguugaaagagaaaaggcauaauaagauuggucagacuucuauauuuauucaaagauugagcaugaaaagauuuggagcuuuacaguauuucaaggaaguaggauguguaaaaaguugagauggguggcuuauuuucugacaugaguagauuuugauuuaaaacauucaagcugugcccuggggagagggauguguaaggagggaaggaaucugaugaaaugaggaccucagagaguuucuguggaaggcuuagaacuggaaguggugaauuagugaaccaucaagaaagagaauauuuuuauagacauuuauaaauuuuuauuuccacaaacauuggaaauaauguaggaauaggcaaacaaugguccucaggucaaauucguguuuucuguuuuuguauggcccuugagcuaagaaugauuucuacauuuuuuugugggggaaaauaaaaagcauaauauuucaugacauuauaauuauaugaaauugaaacaucaauauucauaaacuuuuauugggauauaaccauacccauuuguuuaugcauugucucuguaauaucuauagcugcuuuuaugcugcaacagcagaguugaauaguuguggcagagaccaugugucccauaaacacuaaaauguuuacuuucugacuuuuuacacgacagguuugcuguccacagaaauaaaagaauguccgcaguauguuagaaugaacaguauacaguuuuuuguaagacuaggaauacuugccauuaauaaauucauuuucuguauucuuauauuugcuuaucaggaauaaaugcuuuuuuuggugaaugguuuucauucugaaaaaugucaaaauaguaaauauuaccuuuuuuuuuuuuuuuugacaaugcccccuuuuuuggcugggaauguucuuacucugguuuuguaaguauguucccacacauuaggauuucaaaaaaaaaaaaaaaccauauucagaacuguauuagucaguucuugcauugcuguaaagaacuuccugagacuggguaauuuauaaagaaaagagguuuaauuggcucacaguuccacaggcuguacaagcguggugggggaaggccucaagaaacuuagaaucauggcagaaacugaaggggaagcaagcaggucuuuuaugaccagagcaggaggaagagagagaaguaggaggggcuacacacuuuuaaacaaccagaucuugugagaacucacuauuacaagaacagcaagggggaagacuacccccaugaucuagucaccuccuuccaggccccucauccaacaucgaggauuacaauuugacaugagauuuggguggggacacaaauccaaaccguaucauucugcccuggccccuccccaaucucucauguccuucucacauugcaaaauacagucaucccuucucaguagucccccagaaucuuauuucagcauuaacucaaaaguccacaauccaaagucuuaucugagacaaggcaagucucuuccacuuaugagccugugaaaucaaaaacaaguuaguuacuuccaagauaacaacacggguacaggcauugaguaaacacacccauuccaaaagggagaaaucaaccaaaagacaggggcuacaggcccugugcaaguccgaaacccagcagggcagucauuaaaucuuaaagcuccaaaauaaucuuugacucuaugucucauauccgggcagcacugaugcaagggguggucucccagguccugaggcaucucugccccuguggcucuacaggguacagccccucggcugucuuuacaggcugucguugagugcauguggcuuuuccagguacacagaacaagccgucaguagaucuaccauucuggggucuggaggacgguggcccucuugucacagcuccaguaggcacugccucuguggcgacugugugugggggcuccaaccccacuccccucuacacugcccucguagagguuuugcaugaggccucugcuccugcagcagaguccugccuggaguuuccauacauccucugaaaucuaggcaggagcucccaagccucaacucuugcccucugugcacccgcaggcuuaccaccacguggaagcugccaaggcuuacaacuugccccaucuggagcagcagccugagacguaucugggccccuuuuagccacaaagaauuuucuuucucuuggccucaggccaguaccuuuuaugccuugccuauuaugucuggcagaaguguggcaguuguugggaaaguaacugggagcucucauaggcuucuguaugaaaagcuaggauaaccacguuaugaguaguguauggacaagaacuugaacuuguggucuuuccccucucaucagcuucauauugcuuaagauagaaaaauaagggauuucaaaauguaagagugaaagaaauuagaguuugacaaagauauaaaagccauaguuuaaaauaaauguguuuuauuuucuuccugaauaauugagccugaaccaggagcauacuguucauguuuaaucucuaugugaaaaaacaaggguaguaauuguagagcaaacucuugauuuauucugaaugaccaccaguuacuaacuaaaaauacgauuuuccccaacuagguuuucuuauuccuuauaauaguugaagaguaauaagguugagauuuucuuuuuguguguuucuuugcucacauuaagaagguuacucuaugcagaacuuuuugacuacuuuuauuaguuacguaccccuccuuucccuuaauuauuaaagcucuaaucucuagcauguaauguuuugcuuuuaaucuguugcuucucacccuguugcuuuagguaaaguuuaagggguuuuauuuuaauaggccugaguagagaaugaaacuaugaagaaucugacuauaaaacuaguaacagaaauucacuugguuauuucagauaauuccuuuaucuaauaucuuccuuuccucuucuuuccuucuaggucuuuugaguauugccuggaauuuacuauuucugacaaauuucuauagaacaugugggucuaugaggaagguuucauuuuaaauagguaguuaccuauuucuguuauuuuauuguccuuguuuuuagaugaauuuugcuauguauugggucuauauuuugcccuaguaaauauagaccaaaauuacucugaauuuuaacacaguuaaaauucagucuuugcugauuaguagacuuacuucuuuguagacucacuguguuuccgaaaggguugggaguuaaaauaguuugguugucauuuguucauauauucaguuuucuggacaaaccaugaauuauaguaaaguuacgcuuucuuguaaauccaguucuugcgaaaaugcuuguugccuuucauuaaugacagcauuuccaucuaaaaauaaugacaacccucucauuuuccuuuacagcuccuucuuguuuuccaccuuuuuuguugucuuuuagaaagauacucuucugaaacauacuacuuuuaguccugagauuugcagugaaugaauugcaacugaugaacucuggggcugcuaaucuuacuuagucaaauaaauguauuuuuuuuuuuuuuuuuuuuugagacaggcucucacuccagguuggagugcacgaucacagcucacggcaccuuugagcucccaggcucaagcaguccuuccaccucagccuucccccaguagcugagacuacaggcuugcaccaucaugccuggauuugguuuuuguuuucuuuguagugauggagucccaguauguugcccagagugaucuugaacuccugggucaagugauccccccaccuugcccucccaaaguguugggauuacaggugugagccacugugcccggcuguaauaauuauugauaauagaacuaugaugagaacaauaguguuuucuuacagaagacuuuuuuuuuuuggcuuauuuaaaaacuguauuaaaacuuuaaauguacaucauucuucaguaugacuacagaaggccgcaauggcccugauaucucuacuuguucuuucugaaauugaagauggggccaaauacugugucuaauucaacaguucagauuuuucauucccacuuuuuaaaguguuaguguucgcuugagcacacaggcgagauuaugggaucuuaacauuugaaucaccuggcagaacucugaagguuuagggcaaggaaaaaaaagacaucccaaaauucuaugcuuacuaucacccugucuuaguaaugguaaauuuuaaauucuaccacccccugcccaaaaagaugggguaagaauaaugauugguuaagugauacauggaagacugcuacauccuaaaaaagacugauggaugguucugugaaacacugcuuaugucuuagcuauuuuccauucugagguuucuguauaagaauaucuugugcccuggaaauauucaagaaaaaguacuuuagaugagucuuauuuaauaacuuaagauuuuauaacagagauggugguuugugccacauuauauccagcaguuagcgaucuaagaacaaaauauuuagcuuauacuagaagacaacaguagucccccuuuaucugcuguuucuuuuucugugguuucagcuucccacagucaacugcuguccaaaaauauuaaacggaaaauccaagacauaauuuauaaguuuuaaguugcaugcuguucugaguagugagaugaaaucucacggcaucccacucuguucugccgaggacgugaaucuuuccuuuguucaguauaucccaugcuguauacacuaccugccugucagucauucaguagcggccuauguuaucagauuggcugaucauuguauugcagugcuauguucagguaacacuuauuuuacuuauaguggucccaaggugcaagaguagugaugcugacauauuauuauaacuucuauuuuauuauucuuauuguuaaucuuacuaugccuaauuuauaaauuaaacuuaaucauagguauauauauauaggaaaaacauaguguuauauaggguucaauacuagccccaguuucaguugggggucuuggaaugugccccccacagauaagaggggacuauauucuuauagaagaagaguuugauuuuuuaggacguuauuuccuguucaaaccauugacccacucuuugagauaaguuauucugaagcuuucauauaaguaaaagcaauuaaauuuugccaccagcaccauccucaaccauucugaauuauaaaguguuaaaauuaagaacaggaagaauggaaguauucaauaaaaaaugaaguauuuucaguuccauauugucaucaaauaagggugggaaaggcaaaggagaaaaucaauaaguauggagaagaaagaaaugaguagauagaacaaaaaagaugagaaaggaagccauauugaagucaggagagagugcagagcaagaaaggaugggcagaaaaaaagaaaacaagaaaggaguuuaaugagugaguagaaugugcucuuguugcauucuacugccagucuaagccauggaauaguucacuauucugggaaguauucuuaagaucaucagugaccuucaggucaugaaaucuaauaagcauucuuucagaccuguucuuauuugaccucucagugguguuugacacucucaaccaccaacucuuugugaaaccuuuuuuucccugaaagcugugaggucgugcuuucucgguucucuucucaugucucugguaacuccugcuuugucuacuuuggguuuuuuguuuuguuuuguuuuuuguuuuuuaagaguugggaucuugcucugcugccuaggcuggagugcaguggcgcaaucauagcucacugcaaccucacacuccugggcuuaagugaucuaccugccuuggccuccuaaguaacuguguucauuugacacaguuuaggaacuaaagaucagguaaaaccagccaguuccugagcuggaauugaaucuguucagaaugucugggaacuaacuccauuuuuacgugucaaccauaccuggcuaauuaaaaaaaaaaaaaaaaaauugccuaggccagucuugaacuccugaccucaaacgauccuaccucagccuuccaaagccucggauuacaggcaugagccaccucaccccagccaccuuuguuguccagagaugucagauuuugugaaagcucaguccuaggcuuccauuucuuuucauucuacgacccagcaauuauaucuaucccaauggccucaguuacuacucgcugaugccgcaugccauccucuggugucccacaugucagugaauagcaucaccuuuuuuauuccaguuuuccaaguuaaagacuuaggaguaauuccuaauacccccucucccucacuucccaaauucuuacuguacuaaggccugucuauuugacauccuuuaauaauuuucaaauccauauucucugcugucuuagucugaguaggauuaucucccccuugcagcacaauaguagcccuccauauccuuguuaaauuuguucuguacacugaagcuaggguacuguauccuaugaaaacacaaauccagucaugucauucuccuccauagcauuauuuccugcuacucuuaggauaaagacuaacauuccccaggccuacuucuccaccuccccucuuauuuuucaaacccucugcacuugagccacugagacuuuuguucagauucucacagguaccaugcucugaccuuuuacuucucugcuuagucaauuuccauuucauucuucacgucucaacacaaagacuguuucuauagaaaaagugauuauugauauauggucuuguaagauucuguucuuuugcuuauagcauuuaucauaauuuguuauuauguaucucugagacugaaaacucccaagagggaugggaccuugucugcuuuacucacugcuguaucuccagcaccuggcacaugguagggauuucauagauaaugguuaaaugacuugaguuuguccuuucucuagaucuaggguauuugucauuuguccauaaauuuugcuucaggaaauuuuagggcucagcauaaucugauuaggcuucaacgaugaagauaauguuacauuuaucauucgacacaguuuaggaacuaaaggucagguaaaaucagcuaauuccugagcuguggaauugaaucuguucagauugucugggaacuuuauuuuuaccuguccugacaagucuucuaaaaaaagauacguugacuuagcucacuuuucagcaagcguuucagugcuuacaauacgccagacauuuugcaaacuuuaauuggcuauccccuucauuuguuuuucuauuuuaauagaauuuaauaaaauucuauuuuaauagaauuuauuuuaaauuugguuuucaagaccuauuucacauggguacauauuugugucuuugaguaugauucuuuaaguaaaacacuuugcaaauaaaaugaucaucugaaagauauuuuuucauuugauuguaauuaguuagguaaauuaaggggaauacauaauuacacagcuuaaagauauucaaaugcuauuggaacaggauuggugucuccauguucuuccauuuccuucuauuccccccugauuauaaugguacacagugcuuacagcauacgccugauaauguuaaaugaacacacauuauguguagaauaugcagaaucauggguagugguauguaacaaauguuguuaacugaugagauauagcaaacgugaauaaaaaagguuuaauuaacauggauaaagaaauucagucuuuuguuuuauaauguaaugcaacugaccucugcccugugaugcagacaagagcuguuacaaguuaucaaaaguaaguuuaugaaaaagaucauuuuucuuauugauguuguguccccccaugacagaacauguaacagaguuaagagaauaaugugugaccuacccucgcaauccagauaaauauagaaauucuugauaauuuaguuauaugagcuugaguaauauuuuaaaggugagaagaguuaugacuuagaacagaggaaaaaugugauucuugguagagggaacugcagcuuaaauguuccagagggggccgugcaugguggcucacaccuguaaucccaacuacuugggaggcugagguaggagaauugcuugaacccuggaggcggagauugcggugagcugagauugcaccacugcacuccagccugggccucagagcgagacuccaucucaaaaaaaaccauauguuccagagggaauaaauauugaugggaguuggguggggacagaugauggauggaacuuaaguucuggaaggguuagcaagcagguuuacuugucuagauugagaaaaaagugauucauggaaacuauguuuggaaacauaggauaagcacucugacuugacaaaaugauuuguauuuaaaaccauauuguuggcagggcauaguggcucacuccuguaaucucagcacuuugggaggucgaggugggcagaucaccugaggucgggaguuugagaccagccugaccaacauggugaaaccccguuuuuacugaaaauacaaaaauuagccaggcgccuguaaucucagcuagucuggagguugaggcaggagaaucgcucgaacccagcagguggagguugcagugagcugagauugugcacuccagccugggcgacagagugauacucugucucggggaaaaaaaaaaaaaacuuauuguaaaugugugauaucagaaauaauaaagcuuuccucuccagaucuuaugaaaauaaaaguggacaugauauguagcaaauaugcuugguguuugagcuugauuuuuuuuuuuaaagagagauuuuauugccauuacuguuauguaggguuuuuuuuuuuuucagacuuuuaguuuuuauagcuagucuauucauuuggagaauguggaaaaauaacucugaacacuucccacuagugaacauguuaggcucucaauaaaacaguuucuauagucagucauccuguaucagugucagccagaauuaccuaaagguaugaacaguauuaugacaguuaccuuuaaaacgauaggcaacacugggcuuuuacauggcccuuugugucaagauguguuacagaucaguuuugcuuccuuuguuuugaaaugauuuugauuuagccuuuugugaaccuuugacuuuucuucccauuucacuaagauaacuucuuuugcauggucuuugaauagucucauuuuuuaaaaaguccuaagcauaaaaaguaagauuuuccuucuuuccaacccuuucugugaaauuauaauugugcuaaaguaucagcuuagauuucaagcaguccucaugccaaaggcguuuauuaaguguuuauauguuuguuacuaugcuguauuguaucaauaaaguaggaacacacaggagucacaucuauuaagugcuuuuaaagugccugguaacacuaauguaaaucauauuuucaaugucauucauauaaauagugucaaguccugccugcccccucuccaccaaagcuaaguaucuuaaaugcuaaguaucuuacaagauuacauccccauaggaagaggguggaguguuuagucuucauuugugacugguuuaaaugaauagauacaguucuccaaagguccauuuauagaccggucuuaacuuaaaauguacauaauguauuuggguauugacgaaagagucaaacucuguaaaauauuuaaagcgucuuauucugagccaaauaugaguaaccaagaccugugauacagcucuaggugugauagaguuaacugggugacaacugaaaagugaaaugaggguugccugacaucugagaaucauucuggagugagacagucuguuaaggaguauuugaucaggaagaagguagugauaaaagaaaaaccucggcugaauuaaauuuaaaagaauuuaauucagcaacugacgguuugccaaucgggcaggccucccagccauaguaggcucagagacuccagugcagccacaugauggaagaagauuuauggacaaaaaaaggaaagugauguauagaaaaugggagugagguacagaaacagcuggauugguuacagcucagcauuugccucauuugaacaugguucaaacaguugacuacauuugauuggccaaaacucggugauuggcguagguguaggcuacggucugguuacaccuccacuuguuauaguucaccauguacagaaaaaccuuuagccaaacuuaaaauacguaaugaggcagcuuuaggcuaaacuugguuuaacaguagagacuuuuccuuuuuguuccagacuuguaaauucugcugucuguugaacuucucucaacggugcaucacauuaaacauauccaaacucauucuucucccuuucaggccacacuuuuuccucuacucauauuuuccugcucaucuccuucacucaguugcacauguuacuuaguaccaaggcuuccuucuuuauauuguucauaccuaguucuuuuccauucucauggcuacuacuuuaauucuagcuccuacucuugccuaggguucauggacuggcucccucacuauuuucauacuuacucccucaaaucuauauucauacuguuacuuaaguaaacaaaagaauuuuuuuucuuauuuuuuuuuuuucugagacgagucucgcucugucgcccaggcuggaaugcaguggcgcgaucccggcucacugcaagcuccaccuccccagguucacgccauucuccugccucagccucccgaauagcugggauuacaggcgcccgccaccacgcccagcuaauuuuuuguauuuuuuaguagagaugggguuucaccguguuagccaggauggucucgauuuccugaccucguaauccgcccgccucggccucccgaagugcugggauuacaggcgugaccuaccgcgccuggccaaaaauuuuuaaauuucuauuacaucccucuugcuuaaaacuccuaaaaccacucagcuuuaaggacuaacuuuaagaaguugaaacuuaaauaugaggaccuucauaaugugguccuugucuaucuuuccagccucuucuccugucacuuuuuugccucuucuuuucacucugucuuacugguguuuccugaauuuaucaucccugucacaccucauuuucuucccauguucuacuuuuucuguacuuuuccacccucauaauacugcuuucccuuguuucuacuucucagggaagccugcucuaacuuuccuauaggguuuagauauugcaccucuucucugccccauuagcuuccuagcaaaugggguuaaaugcagagcuugcuccagaggccuacuguccagguuaaaacuuuagcuucacucugcugauuaugucuucuugggcaauuuacuaaauaucucugucucuguuuucucauauguaaaaugggaguuacaaaagaacuucauaggguuguucuugugggaguaaauugauguauguuaaacacuuagaauaauugugcuuggcacauguuaacacuuacugaacauuaaccuauuacuaucuuguguauaccucauucauaggacagauuauuugauauugaacuucuguuuuacuuguuucuuccucuaguacauugugacccuuuuuugagggcaggaacuaaaucuuaucaacuuaaaguuuauuuaaaaauauuugagcauccauuaaaucauugauacuuggcuaaguccaaauuacggccuguuuugugagaccccuuuuuacauuuuuguaaaauguaaaaagccauuaccaacaaaaaggaggaaaaaaaaaagaggaagaagaguauggacagagaacaugggccaacaaagccugaaauauuuacuaccuauaauuuucuuaacagaaaacauuugcugaucucugagcuagaccucuugauguugauguuacacauaacaugauuagaauccaguaaauguuugcuggaaugaauggaugguuggguagauagauaaaugacuaggauaagaagaucagaauuguguguauuggugauuauuucuuaagacgugacagcaauaugaaagucagugaagagucugaaauaguugcuuucucauuuggugacaugagacuagacuauuugcacuuuguggguaggaauguuuuaggguccugugucuuucuguuguguuugagaaguuggacacaagaaugguguucaaauuccugguauuaacaugugaagaagacaagaauuugcuauuuucuauaguuuguacagauggaaagugucaagcggucuucuguguuuuccauuaagcauuccuugcuguuauugcuaggaauaucauaaaggagaggauccucacugucauuuaauaaauaauaauaacagccuaagugguuaauuuuguuccuuaucccuacaguaaacaaauaauaaauacuuugaauuuaacuagcuuaauauucuguugguguagaauuguggagauagauaaggcugaguaaauucaggccagauucuuuaauauuuauuuuugaccgcucuuagggauuuugaccaaagcaauuuacccucuaacuguccuauuuuguauuugugguaucagaacaauuuuucuuccuucauuuuuauuuccuuaaugauucaacuuucugucugcucuaaacaguauauguguuaaagcuaauguccaaaugguaauaaauuuuuuuuguuauuaauugauaauuguuuggauguugcuauucugaaaaggaccauaaagaguauuuacaccaagucuuuaguuuuacagauaggucaguuauuuaaaaaucacaaagguucuugauaguagaaugacagcgaaaagcuggugcucugauagaccaugcugcaucuccuacuguccugguuuuuuauauaauaagagcuuaccaucuucaguuacauuguuuugcugaacuuaagcuguguauugcacucuuuccauugcuaccugacagaauaauaaugaucaagacuuaaaaucuauuucuaguuuauuuuuuagguauucgaaaauauucuacuguauucacuuugccuuucccauugugaaugguccaagaaacuuuaaaaaauauagauacugguauaacuaugauuugauacauuuuaauauaggcagugucaacauuuugugaauuuuaugucaauauuagauuauauuuuuccucuucaaaggggcuuuuuaaugaaaauuggggaauaacuuguuucuagucuuguaaaaucuuccuucauggcaccaugaacucucauacauacagugguagacuuucuacuuuuauauuauccuuagcuguuuuaguuuagaauucuguuagugccuuucacaauaaauguuuguugaauugaauugaaccuugugaguagaacuguuuugcuuugcuguuuuguugcaaguauaacagaauaacuugucauuauuugcuaucuauacucgauucauuuguguucauaguauuuucaacauauuuuucuuuguuuacuuaaauguggaaauuauauucuaaaucacuuggcagcugugauaugcaagagcaauaggcuuauuaaguuaaaagaugaaguuuaugccuucauucugccacuuguauagcauuuguauuaggacaaucagccugaaucuucuuuccucaucuguaaaauaaugacugcuuuauagaguuuuguuaggauuaaaagggaaucacauuuaagccuaccuagcaugguaucugguacauggaggguguugaguaaauguuuacccgguaaaaaauggcgauauguacuuuagauguaucuuaagacuauuuuuggccgggugcgguggcucacgccuguaaucccagcauuuugggaggccaaggcgaguggaucacgaggucaggagaucgagaccauggugaaacccagucucuacugaaaauacaaaaaauuagccaggcgcagcagcaggcgccuguagucccagcuacuugggaggcugaagcaggagaauggcgugaaccccgggaggcaaagcuugcggugagcugagaucgcgccacugcacuccagccugggugacagacagagacuccgucucaaaaaaaaaaaaaaguauuuuuaauaaagguuuuauagaaucacaaaaccuuagauuuuaaagggauaucagaguucaagcccaguuucccuuuuaagaauuaaauuucuucucugccguauccugggcuagugcucauuuaucaguugcuauuuaauuucuuugugcaaggcgcugugguagguuuuugggaagcugcagaguugauuuaggacagauacucuucucaagaagguuguuccgaguaagcuucauggaagaaguggcaguugagcuagaacuugaaggauaggguagaaucugaaucuuuauagggguugccaacugcaagaacacaaggaacaaaggagagaagaguuugggcaguugcagaaaaucauuaauaaaugaguaauuuuauuugacuggauuagggaaggugaagaaauaaugaaagguauggcuggaaaagaagauuauggccaaauaauagagauccuggauauauugcaacaauuggauuuccugguacucaucagaugaaguaaaaugaaacauuuuuaacugggggugauauagucaguuucauucagcuuuuuaauauauaugccaaguuuuaaauaguucuuuauuaauauuaacuucuuguaacuuugaucucuuugcuguaguucauucucuuuagccuuagagucagucccucuuucauccuucaugucaaaucagauaccugucaguuuugccccuaaaacacauguaaagucuauccucauugcuccugaguuacugucucauguggcacaggaucaaccaguaaguuuccauuccuacucuccuguuuagagcauucaucaaaaccucugguagccuuuauugucuuaaaaauauagagagcauagugaaaaccaugucacugcccuugauucuuaucuucaaaauuauagcgaaguuaagcagucugcuaauucuuauuuuccuguuguagcuaaagcaggaaucacugagguaauaaguuauuguuuaugcauuaccuuauauuguugagcacuagagaugucuguuaaaaucagggcagagaaauagacaaguaaaccacagugacaagguggaguaaaauaaguacauacuuauuuuguguagugcuauggaaacacagaaggggcaaacaauacuguuuuaaaucuugcuuuugaagauggaaauuauugucuuaaagcuuauucucagagacuuguggcaauauaauggauuagauaaccugaaaaauucugugaaaugucuacaaauguccauaacauucguuuacauguuuucccugcaagcucaaggaugugaaggauuuccccagggcaaucgaagagaaaaauuaaugguuaucaagcuaaugcaggcgcugcccuaaguaagggccuuuguucaaaccacacuccagagcuuuguguuguacuggaucuucucgagaaaaggcuggauuuuucagggcagggaaauggagcugaggaucccuguauagagcuguaacucuuaaagacuuuauacucuuaguaaaaggguaggcuggggcgaacaaccacccaccagcaaaguauacugaugaaggcuugucuuucuuagccuuagauccaaauagaagucuucccugaaaauuuaaaccauaacucuuuuaaaauacagguuugcuauuugaauuuguucaccuguguggucugggaaacccagagauaagaaacuaaaaugauccugagcuagaagugccucaacuggagcagaggcaaauauauggccuuucugaaggaaugugcuuucaacacaagcuucucauauuccuccagauuaaaguuuuccaauauuagccuguaacccaaaaugacagaaccuaggaaaaaagacaacaucagaaaguugcagcaaaacaaccaacaaaggaaaaaaauagucauugaaauuuagaaacuuaauggacaaguucagcaaauagauauguuuugaagaaugguuuaggaaauuaacauauguaguacugcuuuguuuucucugagucucuuuucucugagaugaaaaaugcaaaagagaaguucaaaguuauggaaaauagaaugagguucaaaaugaaucuaauuggaguuacacagaaagaauagggauaguucucagcugcuaucaguuuaaauacauacuggcugagauuugauacaaggcaugaauucucagcuuuaggaagcacaaugaaacuccaagcgagauagguaaaaauucugcaccuagacacauuaucgugaaaaugcagaaaaucaaauauaaagagaauaucuuaauagagaguagaaaaaaauagaugauugaucauaaaagagccacauuuaacuacucaguagcgaugauggaagccuaaagacgaucaaguuauaaaauacugagaaaagauaacugccaaccuuaaauuuuuacccaggugaacuuuaagaguaaagaugaaaugacuuuuuggacaaauaaaaacugaguuggcuaccaucauacauucuuuuaaaagauguacuuaagagagaaggaaauugaacucagaaggaaagacugaaaugcaagagggaauaaugagcagauauauugguagccuguggguaaaucuaaguaaacuacgcuuauuuuaugaccuugguacauaguaaaugcuuggcuaacagauauauuauucaccaguuuuccugaaauaacguguuuucuuauuccauugugacagacaguggaauugacuucauauucagaaauuaagagaagcuggaaucucaacaggauuccuaacaugguuagucuuauuuuucaaaguuaacagauacagugucuuuaggagcugacuuggaguggcuagguuucuuaaaaguuuauguuggccaggugugugagcucaggaguucgagucuagcccaggcaacauaaugaggccccaucucuacaaaaacaguuaaaaauuagccaggugcuguggccugugccuguaguuccagcuacucaggaggcugaggcaggaguguuugugcccaggaguuugagguuacagugaauuguuaucaggccacugcacuccagccugggugacagaaugagacccugucuaaacaacagcaacaacaaaaaaacaaagauuuaugucuacuuauaggcugcugaacaaauuuuaauuuagauauuaacugaccuugcccccuccuuaccaagauccuaauuuuuuguguuugauuuauaguuuggaucuagaauuuccguucaaaauguucucagauuucacaaucauuaaauagaagacaguucuaaauuuauuauuugagaaccugugcuaaucuugggggaaacauuauaacaauaaguaaaauggaacucagugcucuuuaaauggccaagaacaucacaaaccggaagcuuggucacuugugguccugacuuguaaaaagaaguauuugcuaaccauguuuuuauuuuuauuuuuuuaaacuauugaauuucagguagucuaugaggggaguauacuuguaguagcauuuugcuagaugagcugccuuuauuccaaaucaauaaaugaguggucugagcacauguuucuuuuuuugaaauaguuucuuugaaguuuuauuguggacuuaaaucuaauaucccugacguaauauuuauugacuuucuaggcaucauucauucauucaacaaauguuucugagugcuugucagauucuaccacuaagguugcuguacugaacaugacuuauaaggugccugugcucagcaagcuuaccuucuagugaggacuaaacagaaaccagacaagugaacaggguuuaaauuuaggagaaguacauacagaaaauaaaaucaggugaugugauagugacuucaaagggucucucugaggaggugacauucagacaaagacagaggccugggcagaagcaucuucaguggaaggaacagaaauuccaaaggcuguaaggugcuugugagugaguuugguguacauuuacauggugcuguaagugcugagaggguauauuaaugugaugguuuaaugugacuaacauauuuuguggaaauuaauuuugauuuuaugaucaaucacaccagauugccauaacuuaaaauuucuaucucaggucuuaggaguuacacuaacuuuuacucuguucuauauuuggccaguggaacucaaacccauuugaaaacguuuggucugagauguucauuuauuugcuggcuuguguucuguucucuuuuagacaguuuuuuugugaccccauuguaauguaaaaacauuuaaauauuugccaaauuaguugaauuauaaaucuacauuuuuacauagggagacaaaauauaaugaaaaauaauuauaguaacuuggaagagacuucaaaagcaguauccaaaacugcaaauuauguuauacaguuuaagcacuuaguucauuuucuuuguaauaaaacuuauuccacaaauacguaauuauuuacaggauuccuacauaaauaaggaacuacuaagauugcaugaaggcugggugcggugguucaugccuguaaucccagcaguuuggcaggcagaggcggguggaucacuugagcucuggaguuugagacuagccagggcaacauggcaaaacccugucucuacaaaaaauacaaaaaucagcccagugugguggugguggugugcgccuauagucccauguacuugggaggcugaggugagaggauugauugaacccaggaguuugagccugcagugggcagugaucgugccauugcacuucagccugggcgacagagcaaggcccugucucaaaaaaaaguguagcacgaaaaccacauguucucuuuuguguugagauaugcauaugauuauacccuuuuaucaaaauuuaguaaaagcauuucuuagcuuuugcucaaauuacagauucuauaugucuguccuaacuugucauccauccagcugaagcgucucaaggucagaaucaugucuguuucaucuuucugaccccauggagcagaguacagugccuaugcauaguaaucucucaaaauuguuuguugagugagugaaugugugaacauuuuaugaaauuaucuuuaagaguaguuacucaugaucaguauacuuuaaaagaucggcaaaacauugaugacuuuuuaaaaaguaauuuuggccaggagcaggggcucaugccuguaaucccaacacugggaagugaaggggggaggaucacuugaggccaagaguucaaaacuaggcuagugaacguagccagaccacaucgcuacaaaagaaaaauuuuaaaaccagcuggaugugguuggcaugugccuauaaucccagcuacuggggaggcuaaggcaggaggauugcuugaacccaggagugcaaggcugcagugaguuacaauugcaccacugcacccggccuggguuaaagagugagacccugucagaaaaaaaaaaaaaaaaaaaagucauuucauaaaauuguuggaaaauaugcauuucugaaggagaggcgucagugugaagaacacucaucugaacuaagaaucagaaaauggaucugaauuucagcuuugcuauucauucaguguccuuaaauaaaucaugcaaccuugcacaucauuuucuuauuuauacaaugaaagcauuggauugaucauugcuaacauuucucucugcucuaaaacugugauuuuuauccuuugcuauuugcaagaaccagaagagauaaagguugccuuuuauguuagauuugauucuaaaucuaaugauauaggacagcggugcuuaagcuauuuuugugaagugauaaggaaaaacccugggaaagguucaguggugguuugcacagcugauuauuuguuaugauuaauuguuccacuuuuauuuucuuuuguggccuguaaccuaauuuuucacuuaguauugggauuauuuuaguacaaacaagugauauauuuguaagaagggauccagagaguaugguaaaaugucuggaugcugauguucucuaaguuaaaggagauucuaggggguagucuauaauaaaggaaaaacacauuuuuuaagguuuuaauuuuucagagugcagggaggugcuaggugcuuuccucacauuaaguauaacauuuccuuuuacaguaugucagcauauuguugaaguuuuccaauaugaaaauaauaucuauuuacuagcauauuaaagcuuagcaagagaauuuuaauagccucauuuagccuccuaaacagucagaggcagggaaauauuauuagaguaacaacacuguaggugcucucuuuugucucuaguagcaaaaugaauucuggcuaccauguacuguaggagugcugcuggcuugaggcuccugagaucuggcauggcuguuauacugacuuguuuucuuucaaauucauguuagaaaaaucugugcgugugugugugugugugucuguguacacaaauauuuauauuaccgugucucagugcuuugagacugugugaggcgggggaagagcuguugaggcuuuuuauagauaaaguugauaaugcuuuuuugacuugguuuucuguuaccaucuuuuuugucucuauuaugauaucuauuauauaagucagaaggagaaaugacacaaaugccaguauaccaguucaagauaggaucuugguuugauuuagcuaaaauuuacccuacuuauuggugcaauuuuuaauaauagaaaaccauuccucauugcuuggaauuuuuaucugcacuuuccauuuugaauauuauuguuaguuguugaacaccagguuuacucugcaggacaccaagcaaagcuuuagaaauuucugccaucauuaaacccugaacagacugauaagcagcaaaauugaaucaguuuaaaaaaaaaaaaaaacuugccaacaaaaaaaguccaggaccagauggauucacagcugaauucuaccaaacauuaaagaagaauugguaccaauuccaaaagauugagaaagagggaauccucccuaaaucauucuaugaagccaguaucacucugauaccaaaaccaggaaagaacauuuaaaaaaaaacuacaagaaauaauaaauaaauaaaaauuaaaaagaaaacuacagaccaauaucccugaugaacauagauucagaaaaccucaaggaaacacuagcuaacugaauccagcaggacauaaaaaagacaauccaccaugaucaaguaggucucaucccagggauccagggaugauuuaacauacacaagucaauaaaugugauacaucacauaaacagaauuacaaacaaaaaccauacgaccgucucaauagacaaagaaaaagcauuugauaaaauccaguauuccuuuaugauaaaaacccucaacaaacuaggcauggaagggacuuuuaccuuaaauuaguaaagccauaucugacaaacccacagcaaacaucauacucuaugggaaaaaguugaaaacauucccccugagaacuauaacaagacgacaaugcccacuuuuaccccuucuauuuaacauaguccuagaaguccuagccagagcagucacgcaagagaaaagaaauaaacagcauccaaauuggaaaagaggaagucagacuaucgugauuguaugccuagaaaacccuaaagacucuuagauucgagaaacaaauucaguaaagucugagguuacaaaaucaguguuuacaaaucaguagcacugcuguacaccaaugaccaagccaagaaucaaaucaagaacccaauccccuuuacaacagcugcaauaaaauauaaaauaccuaggaauauacuuaaccaaggaggugaaagaucucuauaaggagaacuaaaaaacacugcugaaagaagucauagauaacacagacaaauagaagcacaacucaugcucauggacuggaagaaucaauauugugccaguugacagauucaaugcagucccuaucaaaauaccaacaucauuuuucauggaauuagaaaaauauccuaaaauucauauggaaccaaaaaagagcucagguagccaaagguaauuguaaacaaaaagaacaaaucuggaggcaucacccacuacgggauuuccaguuauacuacaaggcuguaguuaccaaagcaacaugguacugguauaaaagucggcauguagaccaauggaacaggacagagaacucagaaauaaagccaaauauguauaaccaaccugaucuucaauaaagcauacaaaaaaguaaauuaggaaaggacacccuauuuaauaaauggugcugggagaacugguuagccacaugaagaagaaugaaacuggauuccuaucucucaccuuauacaaaagucaauucaagauggaucaaagacuuaaaucuaagacucaaaacuggaacuagaagauaaccuuggaaaaccucuucugacauuggccuaggcaaagaauucaugacuaugguggcucacgccuguaaucccagcacuuugggaggccgaggcgggcggaucacaaggucaggagaucaagaccauccugaucucagugaaaccccgucucuacuaaaauacaaaaaaaaaaaaaaaaaaaaaaaaaaauuagccaggugugguggcgggcaccuguggucccagcuacucaggaggcugagguaggagaaugaugugaacccgggaggcggaucuugcagugagccgacaucaugccacugcacuccagccugggcgacagagugagacuccaucuaaaaaauaauaauaaaaaaagaaucaugacuaaaaccccagaagcaaaugcaacaaaaacauaaauaaaugggaccuaacggaaucaaaaaacuucugcacagcaaaagaaauaaucauccgaguacacagacaacccacaaagugggagaaaauauuugcaaacuauacaucugacaaaggacuaguauccagaaucuacaaggaacucaaacaaauaagcaggagaaaaacacaaauaauuccaucaaaaagugaguagaugacaggaguagacauuucucaaaauaagauauacaaguggucgacaaacaugaagaagugcuuggaaucauuagucaucagggaaaugcaaauuaaaaccacaaugagauaccacuuuauuacugcaagaauggccagaucuggugaaaggggaaugcuuauacacugcuggugguaauguaaauuaguacaagcucuaugaaaaguaguguggagauuccuuaaagaaguaacaguagaaggcugggcacgguggcucacaccuguaaucccagcacuuuggaaggcugaggugggcagaucacuugaggucaggaguuugagaccagccuugccaacaugaugaaaccccaucucuacuaaaaauacaaaaauuagccgggugugguagagggugccuaaucccagcuacucaggaggcugagaccuugaaccugggaggcggagguugcagugagccgagaucacgccacugcacuccagccucggugauagagcaagacuccaucucaaaaaaaaaaaaccuaacaguagaaauaccauucuauccagcacucccacuacaggguaucuacccagaggaaaagaaaucauuauaugaaaaagacgccuacacaugcauguuuauugcagcccaauucacaguugcaaagauauggaaccaaccugaguguccauugacuaaugaguggauaaagaaaaugugauauguauacaccguggaauacuacucagccauaaaaaggaacaaaauaaugucuuuugcagcaacuugguuggagcugcaggccauuauucuaagugaaguaacucaggaauggaaaaccaaauacuauauguucucacuuauaagugggaacuaagcuaugaauaugcaagugcauacagugauauaauagacauaggagacagacgugggaagagagugccagauaaaaaaacuacauaaugguuacaacaucacuauucagaugacaggugcauuaaaaucucagaauucaccacuauauaauccauccauguaaccaaagcuauugaaauuuuaaaagacauuuuagccguuauuuuuguggagccaugaacaugauucagaggcuaaauuguaauaaaagauuucucuuaauguucuacuaaguugguugcuugguguuaucauaaccaguguaaagugaaugggccauagaaggccuucuucuauaccagggagaauagggaaccucuuaagggucguuguaaauuuuuuguuguaauugcaggaugagugacuuugaacaugaaaaaaguaagagucugugaauagauguguuauggagcugcuguuuuuaauucagaaagggaggguguauaguaacugcuuuaauauguaaaaaucuuuaaaauuuuuauuuggucuaaaaagcauuacaaguagaaaacuuuuuuuuuuuuaguuucuguacaguuaagucgugaguuggacaaagaauuuuuacugaaggaaauagauuauugguggagacucaaaguaguaagggcagcauuuuggaguucauccauugagccuuuuugcauucagguaaaaugagagcuaaacucaggccaaauggagagauggucagaaagaauccaguuuuauguuacuucuaagcaaccugagcuuaguauuugaaaaaucuucauucauauuugucuauuucaucuucaucacaacuuagaacuuucucauauuguaacacaucuuuauauuuaauaucaauauuguaauuccugccacagugguucuuacuuguuuuuaaucuuuaucauuuucucuguuggaccuauuuuuaggacucugguucaucuuagcuccucauugucugaagcagaaaaacuucuuucaagagguucuuugugauaaaauaauaaaaacugauuacacagcguugcacuccauuauuuacacagauuuggguaauaaaggaaaaguguuuggucagauucuggggaccuaaccaaauauauuaggaaaguaaagaauucagcuaaaauucuuuuaauaaaaauaaauuuacaaaaacucgguguccauuaaaaagauugaaacaaaaaauagaaauguauaugguaaauguuaaccauuuagugugaaacuacaaguccuuuuuccuguguucauauauauguccauagguauauguaaaagucagaucauaucuguaacuauccagcauauuuccaauuauaugcaaagcacuguagugugaaauacggggacuguuugcacuuuaaaaacuuguaucaugaaggcugauuuuuaaaaauuauaggcuggaaauggugcaaauaugcuauauauguuuauaugcuguaugggaagacugauuuuuuuaaaauuauaggcuagaaauggugcagguaugcuuauauaacuaagauaacuaaguugaugugcaagacaggaaagaaugguugaaauuaaaaaccauaauuuaauauugauuuugcacuaauaaccagacccaauuuuggaaauuccaacuuguucauaaugugcauauacaacaggaguuuugcagaguuuuggcaaaguauguggcagccacaugucuucacagaacacugaaauaauccuuaguaaacucugguaacucuaacuugugaacaccaaauuaauaacucuuaauaauuuaacguauuuguuauugguaguuugcuuucagcuucagacaauuggaacuggcugaaauacaaaggaguuugcguggcuaaucugauugagaaaccagaagcuucaaggacaauagggcagggcuguguuuggacucugcacuucuguguuuugcuuuacccucaugguugcaaaauaacugccagcagcagccagggaaauaugcuuccuuguuaauaauguccagagaaaagagaguagucucaguauucucuauuaaaaguaagacuauaucagaaagguucaggagcucuguccuugauuucacugcccagaauugaauaaaaauuugaaaugcaguucacuucugagcaagccauuagcuagggggaugggauuaaucauucaggcccuuuccuuguccuugcucuuauucagcuagagagaguuggaauggcaaccagcauguacuacuacuauguaagcccucagucaaaugucacaaccaacagaagcaacaauuuugaaucagcucuaucccacuaguggcaggaagaaaauacuuuggcaaucacuaguguaaugagaauugggcugaggauggacccuaaggaacacuaacuuuuaaccaguagagcaagaggccaagguggguggaucacuugaggucaggaguucaagaccagccuuaccaauguggugaaaccccgucucuacuaaaaaaaaaaaauacaaaauuagcugggugugguggugcaagccuguaaucccaacuacuugggaggcugaggcaggagaauugcuugaaccugggaggcagagguugcagugagcugagaucaaaccaucacauuccagccugggcaacaagagugaaacuccaucuccaaaaacaacaacaacaacaacaacaaaaacaaacaaauagagcaagaacgaggagccugugaauccauuuccuguuuuaguccauauugcuucuuugauauggaauaagacaguaaugaugacuccaggauuuuuuucuuuugcauuucuuuuuccaagacuagaguaaaugcuggaaacacauuaaaguuagaaauagagacuugaauuuauucuuuaauaaaaaauguuccuugaacauuuaaguaaaaauguaucuaugauacaagcauuuucuaauuuaagauaauagcaagcagaagaaaacaaguuaaauguaaauuuuuuuucuguuuccugcucuguauguaaagucaagaaucugaccuuugaguaaauuucaucauauuucuuaucguaaaauagauuacaaaauaaauccugagaauaaguaaacaaacacuucccuuugaauuuccuggggugguuuguauuucguuuuuuuuaauuguggcuggucuucagauucauucaaaauauaauuuuaagaguccauuuuuugggaguauaauacugacggcauuuagcaauuuauuuuuaauuaugagcuucaaaaaacuauucaguuugcuugaauucauuaauuuuaacagcauaugccauguucaguuuacccaguggcuuuucuucauuaaaucugugugucucuggucacuuuaaugucaguagcucaucaguuucuucgaagugcugcccauuagaauuauggaaggaaggcugggcacgguggcucaugccuguaaucccagcacuuugggaggccaaggcgggcggaucaccugaggucgggaguucgagaccagccugaccaacaugagcaaacuccgucucuacuaaaaauacaaaauuagcugggcaugguggcaggugccuguaaucccagcuucucgggaagcugaggcaggagaaucacuugaaccugggaggcggagguuauggugagccgauaucgcaccauugcacuccagccuggacaacaagagugaaacgccaucucaaaaaaaaaaaaaaaaaaaaagaauuauggaaagaaaagaaauauggaaggaguugugauuggauauacugagguuaaaggauaaaaugaaaaguguaucuuguaguauauaugaaggcagugugguuaguuacuaggaagaacugcauccuuguauguuuuuuaaaaaaaucuuacaaguaguguuguuaaaauguaugacucaaacuucauacucaucuuuacauacauauuuaauauguugaaaaaauuauucuucuaaaaggaauaaaugguuagguuugcugcccugugugggaagacaucagugauuggagauugauugugauuaguaauacauuaugaaugguaguggauugaauguucuacgugcaaggacccuccuguccuugagugauuauaaacaaacacuugauuuucgcuuggugcuuuacauguguaggaaugacagacacacugaacuacuguuuaucucugcauaucuuuuagacggugagauauuagccaacagacucaauucaggagaccagaguuuuuuuuuuuucauuuuauuuugcugcuguuccucaccuaguuccaaagagugggauaaagcauugcauuuucuauuucauauuugccuccucugaaguuugacacuguaagucagugguucagggucuucuagggguuuguuaaaacccagauuguugggcccccaccuccagagguucugauacaguaggugugagguaggggccaaaaaagugcauuucuaauaaguuuccaggugaugcuaugauacugauccggguacugcccuuuaagaguagcuacugugcacuguucacaauagcaaagccaugguauuaaccaaggugcccauuaaugaugaauaaagaaagugugguacacagauaccacggaauacuacacaaccauaaaaagaacaaaaccauguccuuugcagcaacauggauacagcuggaggcuauuacccuaagcgaguuauugcagaaacagaaaccaaaauaccacauuuucucacuuguaagugggagcuaaacaugggguagguaccacauggauauaaagaugggaacagcagacacuggggacuccaaaacggucaggaggaaggagagcaaggguuaaaaaauuagagaucagguaccguauucacuguuuggguuauggguucaauagaagccaaaacuucaguaucaugcaauauauccagguagcaaaccuacauauguacccucugaaucuaaaauaaaaauuaaaaauuuacaaaaagaauuaccauugugaaaacucuuauuuuuuauuuauuuuuuugagacggagucuugcucugucgccaggccagaguguaguggcgcgaucucagcuuacugcaaccuccgccucccagguucaagcgauucuccugccucagccucccgaguagcugggacuacaggugcacgccaccaugcccaccuaauuuuuguauuuuuaguggagacgaguuuucaccacguuggccaggauggucucgaucucuugaccucgugauccgcccaccucggccucccaaagugcugggauuacaggcaugagccacugcacccagccucuuauuuuuauuuuuuauuuuuuuggagacggagucuaccucuguugcccaggcuggagugcaguggagugaucucggcucacugcaaccuccaacccccugguucaggcaguucuccuaccucagccuccugaguggcugggauuacaggcgcaugccaccacgcgcagcuaauuuuuguauuuuaguagaggugagguuucaccauguuggccaggcuggucuugaacuccuaaccucaggugauccgccugccuuggccucccaaagugcugagauuauaggugugacccaccgugcccagcuguaaaaacucuuaacaguuuuaauuaaaccaaggaacugucauauuaaauuuauuuaaggaaaagaugcauaguauuuacuacuguuuagauuagacuuuauauugguucucucucucucucucucugaauguuaccuauuacauuaggugacccacagggaauacucacuuaaaauuuuauguuucuuuagucaaagaaugguuaucacuuggugaugggcauuuuguaacuuuucacagacacguuaguuacugcuguugggcugaaagccacuuuuggacuagcagaaaauaccuugcguuauuuuguuuaacauuucaagcaaagauaaaauuuuuuaaaaauuguucuuaacugagauaacauaauuauuauuucacuaaaugaauauugaaacuuuuaaaaccaaucugaagccaguacagccucuuugccauugccagcugugcauguugcuauggaaacucaguagggacuagcaggauuacuguugugaggaccacaccugguuuauuugcauccaguuuaaguugggggaacauuucaaaagaauaaaaggucucaagaugugccaauggacagcaagaaagagcuuguuaguuuguaaccaucauauuggaaggguggguagguuuuucuuacuccuuacaguuccugguugggaggguuugguggauguguuaaaaauuuguuuuguguauucauuucucucaauuuuucgcuauuccuuacgguguuuuuuuguucugugugcuuuuuguuuuagguauuucuucuuguaauuuaaauguuuuuuucauucucuuaaaguauggacagaucaaaauuuuuuaagaggaaagaauuuaauuucuuuucaguuguauuauguaauaaaauaucuuaauaagguuuucaucacuguuagcuaugguagaauuuuauguugaucucugauuuuaaguaguaugagccucuaugcuccccuucacucacaaaaacaaaaacaacuccuuuuauuuaucccccgcccccgagacggagucuugcucugucacccaggcaggccggagggcaguggcaccaucucggcuuacugcaaccuccaccuccuggguucaagcgauucuccugccucagccucagccucagccuccugaguaggugggauuacaggcacacgccaccacacccggcuaauuuuuuuuuucuuuucuuuuuuuuuuuuugagacagcaucucacugugucaccagguuggagugcaguggcgugaucucugcucacugcaagcucugacucccuaguucaagcgauuauccugccuuagccucccgaguagcugggauuacaggcaugcaucaccaugccuggcuaauuuuuguaucuuuuagagacgggguuucaccauguuggcuaagagggucuccuucuccugaccucgugauucgccugccuuggccucccaagguacuaggauuacaggcgugagccaccgcgccuggccaacaacuccuuuuuaagaagacacuuugaacugcauuugauuuuguuuguaccauugcaucucagcuguucagauucaugaaauaggaacaaaacugaauguacagaaaaaaguuaugugggccaguuauaugagcacugaguauggaucuauaaaauuuacauaguuuucauuaauuagcuauacuacucaaucaguuacacugacuuauaccaguuauacuaauuaugcuaaaucaaaaauagcuauaauaguacaaguauauguuaaauaagagucauagcauguaccauuucuuuauugguuuauguuguuugaauucuaucgaugaggauucugaggccucaugacaaagagggggauggucaaccagugauaguaaauuuucacaccuguguguaccaaguauuggucuuucucauuuucuaaauacaaaauauaaucuuauaucuuuuuucagaauacauccauagcaaccuguauggaucuauugcuaucuauaucgucuaucuauguauauauauaaagccaguagauacuuguauuguauauuagggggagguuaaugucaaauguggagaucagguuuuuuuuuuuauguuagugaaaugcacccuuuaaaaaaaaccugaguaggcuguuuuauccagcuucaugaaagaauagcaccauacgacacauauucaaagaacuuucugauuuaucuccaugguccuuuaguaagggcagguacuaguuauuucuguuuuguaggugaggaaauagguacaagaggugccugccuaaggcagcuaaucuaaauguguccugauggauagucuggugucccccacuguguguaauuguucucucuuuaaguguuagguuauuuuauacagcuuacucaguuuugccuuuuucucuuuuuguguucauagacuggaaaaguaagaagagcuuuccugccuuuuuaauuaccaaacuacucucaguuuucaaugaaucaguucaaagaaagaaugcagucuuucuauaccugguaaauauuuucugcuaaauaaagcuauuaauuuaguagcaucugauaaauccagguguuaugaugauuaccuuuaauuuuguggaaugacuauuaaaaugacuuaucaaauauauauuuuucuauuuuuaacucugaaauuuguuugauauuuauugauaugauggagugaugcuugggaugccugcgacccagccagcaauggaaaauaguuuaggauuggcccuaguucuuagauuagacucuggucucuuuugaaaagguugugaaaucaguggaaauaggguauauaaauauauuuuuauaucaucuuuauucugugaugauauaucauuagcauuaaucccuguaugauaguuuaauagaagcacuuuguaaauaaugguuuuauaaaauuaauguaguaaugagaauauuacauuuuaccauuuuacaaauuaccuacaugaagauuaaagaaguaacuugcgaaagaaauucagcuagcuaguguagaacagagauccgacuccaguucagaaucuacaucugacuccuagucuagugccuuuuuuauauuuuuauuuuuaaguacuuuaaauauaaauguacgugucuaagagaauaaacaaaccauagugauguuucacauggauuuuucuuuugauauagcuuauaauguuacaguguuacuguuaacaguauuaaccauuaauuaacugguaugugccuuugaaacuuuuguauguauuauuuuauuuaagccuacgaagaacucuugagaguauuacuguccauuuuacagaugaaaaaacugaggcucagaaaggcagucauauagcucaauaugcuagaacuggaguuuaaaccuaguucuguguucuuucaaagcacguuacuaaacuguuuagccugcuuauuuuuuuaaacgaaaauuuaugugaucacaaauucaacccaucucauguuaacuaacacugauuauggaaucauuuccucuccuaauucaccuauccaaaaaucucagcauuuuagagagaggugagguaguguugagaaaccauauauuccuccguaaugauuuuaacuaagggaaucauacuauuuuuauaauguaauucaaagauaugaaucuuaucccccuuuaaaaauguuuaugaaauauuuguauaucguaaacuauguugaaguucaaguaaacuaauuugggcaaguccaaagggauauuuucugugacugaacauuuaucucauguuuucacuuuuuauaguugauaagcaauaauuuauuuucauaagacauuuuaaaaacgcuuuucaaaauuagcugacaccuuuaaugaaaaaaaaugauguuauagaaagaguauuauucagaaauuaauauaacauuucacaucugacuggccuggggguaaauaaggcuuauuaucaugaaugaaacuguaaugaugaaaaguguagagaaaaucucuucuuaguaaaauagccagaaugucugaguuugccaaaaccaggagaaucuuugcuuuaaaaccugucucauucccugaaguucaccuuuccucaggaaucucauuaaauuacuaccaccaccuggcuggccaaaagaggguggggacacagagaauguaggcaauuuuuuuuuuuuuuuaaacaggaucucucucuguugcccaggcuggagugcaguggcgagaucuccacucacugcagccuccaccucccagacucacgugaucaucccaccucggccuccuuaguagcugguauuacaggcauacaccaccacacccagcuaauuuuuguuuuuuuguuuguuuguuuuguagagauggguuuuugccacguugcccaggcuggucuugaacuccugagcucaggcaaucugcccgccuuggccucccaaauugcggggauuacaggcaugagccacugcacccagcugaaugugauauuuaaaauaccucuuuuaauagcucauaucauguaaccguuuauuccugguacgguguggagaucuuauagcgaauaauuuuuaguuacaugaauuuuagccuaugcuauucuaaaugagaagguacauuugauugccuaaugccuuucuauuuugggcagucauauuuaggacuuuauacaaggugagaagcauuaacagauaguacuuugauuuuacuuuuuaguaaaacucuuucaccuaaagcuuauaaagauaaugugaaauuuauugagauaaucugucauuauggaaagauuacaaaguugauuacccuaaguacacuucuaccacucauccucugaguagaagggcaggaggguggggcagggcuggaacaacuaacauuuccuggaauuccuacucugcugggcauaugguagacauguucacauguauucuuuuauuuuuaguauacauagaaauguagaaguauaggaaguagggcaaagagaagaaaagcguugugcauggaauuauuccuuccuuuuuguuuguuugaacggucaacuuguuaacccuccacauucuuucuucaucugcuuuuggcagcagcaaauacaguugauuguuuccagucucugaaucauaacuaccugggacugcuguauaguguucaccuggccagaggugcuucuuuuuuaaguuuucagaagacaacauuuguacuucuuaaaaaauguuauuugaggauuaaaacaugaagacaaaagaagaaaaagaaaaccacuaguacuuuagacauguucagauaguccuaacacuauuaagacucuauuccuguguacaauaaagaugauuuucuggccuguggauuaaaaagcauggaaauacucaagagcaucgcuuaaaauuuuuucuuguacuaggagaaaauguuugacaguuguauuuauuaaauauuuaucaagauauaauaccuuuauuuuuauaauuccugauuacuuucaaaauaacauauuaauuuuaaggauaaccuugggagacagcauaauucucauuuuucaaaugagaaaauuaagguucagauguuagauuaguuuuuuaguaaugccguaacacgguacuacaaacaacagaaauuuauugucucucaguucuggaggcuagaaguccagaauaagguauuaguagguuugguucuuucugagggcugugaagcagaaucuguuccaucccucucuucuugucuucaucuguucuaugucugucuuuguucaaauuuccccuuuauauaaggauagcaaucauauuggauuaggcccaguccuaaugaccagaucuuaacauuugcaaaggcccuauuucucacuaaggucguauuuacagguauaaaggguguagacuuuaacaucuuuuuggggaagacacaguucaauccguaacagauguuaaguccuuuccucuccuaaauagugucucguaaguaggaaaguuugacauagcacauuguagugccacuaaaaugguaguuuuaaaagaacaugacaauauauuuauaauaccacauuuaaaauucauuuucuaauacuggcuuaugucuggggagauuuuauuuuaaauuaacuaaguuucuaaaauauuaauagaauuuuggguuguaaugguuucaaacuuuuucuucaaauaauaaguaagugaugacaccaacuguguaaaguuauucaaaacccagugcuuagaucuggcuuuaugucugaacuuccauuaauaaaauguagacuuguaaaauguggacuccucuauaagaucuugaaauguccaucagaauacuguuuaaauuguugcaagagcaaucugacaguggaauaucuguacauuucauauuuauguaaaaauugugguuuuaccaguguuaauacacaucuugugacuagggauuucugaguguuggagaggucaaagccauacuaggauaaccaaaaaaaaaaaaaaaacuguauagugguuuguucaucuguuuccuuuuucuuucuuugcuguuuuuuuaaauuucaaaauaauuugagaguuacagaaaaaaugaaagaauagugcaaacaacucauccuggaaccuuuugagaguaaguuacugacuugaugcucugucacccccaacuacuuuacugucccuacaaauaaggacauucuucuucauagccacaauacaaacauaaaacucagaaaauuaacauugacagguuacuaucgacuaauccguagacccuauucaaauuuugccacuuguccccaaaaugucccuuacaccaaaauaauccaauccaagacugcacauuggauuuaguugucauaucucuuuacuguuguucaaucuggaauaguuccauaagucuuuuugauuucuagggucauggcacuuuggaagaauacauuuuguggaauguuuuugaauuuggguuuaccucaugguuccgcaugauuagauucaagucaugccaugcaucuuugacaggagugucauagagugaugcuguauucuuauugcauccuuucagguggugcaaaauuuuuauuuguuucuuuuuuuuuuuuuuuagacggagccuugcucugucacccaggcuggagugcagugaugcaaucucggcucacugcagccucugccgcccggguucaagcaauucuccugucucagccuuccgaguagcuggaacuacaggugcacaccaccacgccuggcuaauuuuucuauuuuuaauagagacgggguuucaugauauuggcaauucuggucucgaacucccaaucgcaggugauccgccugccucggccucccaaagugcugggauuacaggccugagccaccacgcccagccuguuucuugacugauuacguuaccuuugaucgcuuaaggugauguuugucagucuugucuucuguaaaguugugcuucucuuuguaauuaauaauuauuuuauggggaaacuguaaauuuucaucaccaaguuuucauuuacuagauuuaauagugguccucucucccucccuuccuccuucccuggucucacucuguccccaagcuggaguacaguggcauaaucauagcucacugaagcuucaaacuccuaggcuuaagagauccucccaccucagcuuccugagcagcuggcacuauaggugcaugccacaacaccuggcugacuuuuuuguagagacaggaucucacuauguuguucaggcugaucucaaacuccugaacucaagugauccaucugccuaggccuccuaaagugcugggauuacaggcaugagccaccgugccuggccuuuuguuauuucuugacugaacuuauuacugugaugguuuucaaauauugauuucccaauuauauuauucuacauuauuuggaauccuacuauaagggaaagcuuucucuucucuauauuuauaucuguauggacucaugaauuccuuuaagcaauaguuauaauucauucauuuuuuuuuccuuauccagauugucuaaaauuuggcuaaugggaaugccuucaaacuggucuuguaucuuuuucacauauucccauaauuuuuuaaagugcuuccacuagugguuuuuuuuuuuuuucuuugagaaucccuguuuuauuaauaguagaaaguagcauuuagaagucaagaugugggugccaaguaugguuauugcuguagggguacuauugcccccaggcacuccauggacagaacuagagaauagaauauauguauauguguguguauuucacuuaaagcuguguuuauuuuugcauuuauauauuuugaaaaccauugacuuuauaccaaaacuucuaauuccaauuuaguauuagagaguugauucuaguuuuuuucucuguuuaagguuuuaguuccuuuccccaacagugguacacuucacucucauuauccuuaaaauaauuacuuacuacaguuucucucuccauauaaccagucuccucauugcuucuccccacucacuuuccuaagcuuggaugccugccuuacucagccccaucuaaugacuuuuggacugaauuaugaaaaaaaguucauuuuuuaaugacaaauauuaaaguaaauuggacaaauuugcuucuacuacaccaccuuugguuaauuugcuuccucuauucuuauuuauuuuuaauuuggaacccuauuaguuccauguugauggaaauucuuugagauuuuuaaaauuaagcuuaauuaggcauuuuauauuaucuuaauccuacucuuaggagcuguuacauuuaagguguuaaagauaauuagcuggcuaacuagagaugcucugaacauugauuauuuuuaauuucaacgcauauaaucaguuuaaaaugaauugcuuucguuauaugaaaacauuccaucauuuaugaagaacaauaaggacuuuuuacuguuuuuaagucaauucuggucucauuuaccucagcucuaaauucuuuucauagaacauuauuuaugaacaaauaaugccagaaaauaagaugaauuccaaaaaaaucaaggaguuacuauaugugcgaagaugauuuaugugcagauuuuuucuuauuagaauggucuagggauauugauuaacuuuggaaguuguuagcaaaauauaaauagcaaauauaaaaagaauauuuaacuccuggacuguuagagaggggaagaaaggggaauaaagaaauugcauuuaauauuaaaaaccaggaaaggggggaagggagauccacaacaaagaacaacuaaaguaaauaaaaacuguaaaaugacaugaugggaaaaggccaaauauaucaguaaucacaaaggaaguaguaaauggguuaaacaaaccucuacucagauuggauuuuuaaaaaaugaaaugaaaauccuaucuauuucuuuucauaagugacauaccuaaaaccaaaugacacagaaaagauaauuaaugaaucuauggagcuaugccagucaaauaguauaaaaacaaaagagcuguuauaacaguaaauucugaggccaaaaaaaggagggagguagauaaaggagaauaauuuuaaagugauaaaggaacaguuuaccaagcagaaauguccauguacguaaaaauguuuaauauaaaaugccuaauaaucaauagacauaauuaccacgaugacagagauguuaggauuaucugacaaggauuuuaaagcagcugucauaaaaaugcuucagugaguaauuauggacacacuugaaacaaaugaaaaaaauguggagucugagcaaagaaauaggccucaguagauagaaaauacaaagaaaaacuaaauagaaauuuuagaacagacagcuacaauaucuggauuaaaacucacuguguaggcuuacaacagaauggaggagacagagugaacuggaagguggaacaauagaaauuacccaaucugaacaagaaagagaaaagagaacaaauaaucaguggacccucagggaccuuuaggacuacaacaaaaauucaucugaaugcugggaagagaggagaaagaggguagggcugaaaaguacuuucagaacacugacugaaaacuccccaaauuuaguagaaggcauauaccuauauagauuuaagaaacugagcaaauuucaaacagaaaaauuucacaaaacaaaaaaaucuccaagauacauuauaauaaaacuuuauauaaacuggagacaaaggaaaaaucuugaaaacagagagaaaugacaccuuaccuaugggaaaaacaauuccagggauaguggauuucuuagcagaaaccaugcaagccaggaggccaaggcauauuuuucagguagagagagagcucagacucccccaaaucuguaucuagcaaaaaauauccuucaggaaugaagggaaaaucaagacauuguuaggugaaggaaaagaaagaaaauuuaccuccagcagaccuacccuaaaagaaugacuaaaaacaaaagagaaauguaaucauguuccauauaacaauguuucagucaaugauggacaguguauauaaccgagaucccauagguuauaauggaacugaaaaauuccuauugcuuggugaugucuugaugauucuggcccuguguaggccuagucuaauuugagucuuaguuuuuaacaaaaaaaaauuucaaauagaaaaagcucauagaaaggauguaaagaaagaaaauauuuuuugugcagcuauacaaugucuuuguauuuuaagcuacuauggguuauuacaaaaaaucauuuauuuauuuauuuauuuauuuauuuauuuauuuauuuuuucuuuuggagacagagucuugcucugucgccuaggcuggagugcauuggugcaaucuuggcucacugcagccuccaccuccuugguucaagcaauuccccugcacaccaagcguggcuaauuuuuuuuuuuguuugugugucuuuuuuggagauggagucuuacucuguuucccaggcuggcgcacucucggcucacugcaaccucugccuccuggguucaagcaauucuccugccucagccuccugaguaacuggaauuacaggcaugcgccaccacgcucggcuaauuuuuguaauuuuuuaaauagagaugggguuucaccauuuuggucaggcuggucuugaacuccucaccuuaugauccaccccccuuggccucccaaagugcugggauuacaggcgugagccaccgugcccagccaauuuuuuuuuuuuugugagacagagucuugcucugucgccuaggcuggaguacaguggcacgaucucagcucaccgcaaccuccaccucccggucuccugccucagcaucccaaguaguggaauuacaagcaugugccaccacgcccagcuaauuuuuguauuuuuaguagaaaugagguuucaucucguuuguuguuggccaggcgggucucgaacuccugacuucaagugaucugccugccucagcuucccaaagugcuuggauuacaggcaugagccaccacaccuggcuaaaagucaaauuuuuuuuuuaaugaaaaguuuauaaauuaaauaaguuacagugagcuaagguuaacuuauuauucaagaaagaaaaauauauuuuuauaaauugaguguagccuaaguguacaggcuuucucuaguugacacuaguguacaguaaugucuuaggccuucauucacauucacucacaacuccuucacuggcucacccauagcaauuuuaguccugcaagucccauucaugguaagugcccuauacagguauacuauuuuuaaucuuuuauacuguauuuuuacgguaucuuuucuauguuuauguauguuuagauauucaaauaccguuuuagaaauacuuguuagaaaugcaaauaccauuguguuacaguugccuacaguauucacacuaacaugcuguauagauuuguagccuaggagcaauaggcuaugccauauagccuagguguauaguagccuguaccaucuaguuuuuuguaaguauguucacacagugaugaaaccaccaaaugacacauuucuuagaauauagccccauuguuaaacaaaguaugacuauauacuugguuguaaauccaacaaaacauguacaggaagugcgugcugagaaccacaaaaugcugaugagagaaaucaaggaagauacagaguaagggagagauauauacuauauucagggauuagaagauaacauaggaaacaucaguucuccccaaauugauauacagguuuaaugcaauuucuaucaaaauucucacagacuuuuuuucuagacaugaacaagaauaguccaaaauuaauaggaaaugcaaaggaauugaaauagcugaaaaaauuuugaagaaaaauaaaauaagaagagucaguuaccccaauuucaagacuuauuauauagccacaggaaucaagccugagaguauugguggagggauaaacacagaucaguggaacggaauauugaacccagaaauugacccagagauguauagccaacuuauuugugacuaagguacaaaaacaauucaauggaguaaggacaguguuuuugacaaaugacugaagaaaaaaacaaaacagaaacucaaccuaaaccucacauaaaaaaacaaaacagaagaacaucuucaggaugcaggauuugaugaacaguuuuuaaacgugacaccaaacauacaauccauaaaaaauugaugaauuggcuuaucaaaauuaaaauauuuugcuaugugcaaaccucuguuaagaggaugaaaagacaugguccacagugggagaaaauauuugcaaagaacauaucuaauaaaggacuccugucuacaauguauaaagaacuuucaaaauucaacccuaaggaaacgauucauuagaaaaugaaauuuuuggauuuuuuuagaacaccuguaaucccagaacuuugggaggcugaggcagguggaucacaaggucaggaguucaagaccagccuggccaagauggugaaaccucgucucuacugaaaauacaaaaauauuagcugggcaugguggcaugcaccuguaaucccagcuacuugggagacugaggcagagaauugcuugagcccaggaggcagagguugcagugagcugagauugcgccacugcacuccagccugggcaacagagcaagacucugucucagaaaaaaaaaaaaaacaaaacuucaaaagaaagaaauagacaugucacugaagaggcuguauggauggcaaauaagcacauaaaaggguguucaguauuacuagccacuagggaaaugcaaauuaagaucaccaugagcuaucacugcacaccuacuagaacagcuaaaauaaaaaauagugacaauaccaaaugcuaguagauuuggagaagcagaucucucacauuguuugugggaauguaaaguguuacagguauucugaaaaauaucugacaauuucuuaaaaaaugaaacaguucaggcauggugguugucgccuguaaucccaauacuuaggaaggcugaggugggaggauggcuugagcccaggagauccauaccauccugggccacacagggacacccugucucuacaaaaauaaaaauaagccgggcauuguggugugcaccuguggucccagcucccuaggaggcugaggugggaggauugcuugagcucaggagguugaggcuguagugagcugugaucacaccacugaacuccagccugggugacaaaagugagaccuuaucuccaaaaaacaacagcgaaaucccuaaaccuaauacacauagaguuuggauauuuguccccacccagaucucaugucaaauuguaauccccagugucggagguggggccugguggaaaguguuuagauuaugaggguggaucccucauagcuuggugcggucuucuugauagugaguucucaugggaucugguuauuuuaaaguguauggcaaccccacuccccagucucugucucucuugcuccugcuuuugccauauggcaugccugcuccugccuucacuuucuaccaugauuguaagccuccugagaucuccccaaaagcagaugcugcuauguugccuauacagccugcggaaccugagccaauuaaaccucuuuucuuaugcauuacccagccucaggcauuucuuuauagcaauguaagaauggccuaauacauacauaugcccuaugagcuggcagucucacuucugugcauuuaucccagagaaauaaaaaauuauguucacauaaaaauauguauacagaugugcuuuacauauuauauaugaguccuguaucagaaaugugcuuugccaauauuuuuccccaguguugacuugucauccucuuuaccuccuauguacgaauguuuacagcagguuuauuuuaauaaccuaaaacuuagaaacagccaaaaagucccucaauaaguaaaugccuaacaaacagugggacauugcugagcaugguggcucaugccuguaaucccggcuacuugggagacagaaguggaaugauggcgcuugaccaggaguucaagaccagcuugagcaacauagugaggacuugucucuaaaaaaaauuguuuuuuguuuguuuguuuguuuguuuguuuuuuaauuagccagguguggugacaugcugguagucccagcuacuugggaggcugaggcgagaugaucgauugagcccaggaguucaaggcugcagugagcuaugauuauacuacagcacuccagucugggcaacagagagauaccccaucucuuuaaaaaaaaaaaaaacccugaaauuaaaaaacaagcaaacugugguacauccauaccauggaauacuuaauauucaacgagaaaaaggaauaacuauugauacacaccaaagcuuuguuggaucucaaaggcauacauaaugccaaguaaaaaaugccaaucucaaauggucacguuacuguauguuuccauuuauauaacauuaccaaaauaaccaguuaugaagguggauagcagauuagugguuguuagggauuagaaauagccagagggauaggaguuggugugacugucaugggguagcaggacggaauucuuugugaugaaauaguucuguaucuugauugcaaugauaguuacaugaaccugcacaugugacauuaaaaugacauagaagcauacuuuauaucaagagcaauuguuuggauuuaauauaaugguguaguuacauaagacguaaccaguggagaaauuaaugaaugguacaugggacccaucuuugaagauuccuuugcauuucuaguaauuucaaaauaaaaagucaaaaacaaaagagagggauaucauaguugcuauaggauuucagaagaagaaauaguuccuugauaacuaggagaaugagggaagaccugaggccauagcuuuugaauaguuuuuauaggauagguagacuuuucacgaaacaauacagggaaaagaaggguauuuuagacagaucgagguuaauguuuauggaaugacugccacuguauuauuauuaagaaauguuaguaacaucugauuagucugaagaauaauuaacuuaaugaggaggaauguaucuuuagauuuuauaucugauauagaacucugagauauuuguuacccuuguggugucacacagauucuggaagccugaguguaacagauaaagagagaaaacauaaauuaccaguaucagaaaugaaauggaacaguucaaaaaauggaugggaauaaucaaagcugccuggguuuuaaacaaaacaaggcuuauuuuuucauggauuuaagaaauugaaucagagaagaacucacauuuuauuuguugaaauaggauaacucuaauauuauuuuuauuuuuuugagauggagucucacucugucacccaggcuggagugcaguggugcagucuaggcucacugcaacuucugccuccuggguucaagcaauucucgugccucagccuccucaguagcugggacuauaggcgugcaccaccacaccugacuaaauucuuguauuuuuaguagagaugggguuucaccauguuggccaggcuggucuugaacuacugaccucaggugauccuccugccuuugccucucaaagugcugggauuagaggcaugagccaccgugccuggcuagaacucuaauacuagacaacaaugucaagacaaauuacuauaugguccuguguuaaaacucuguagugaccuauucuuuuucucccuggaauguucacaguuugucauuacaccuuuuggugauugcuuaauauuucuauuauucaguuacaagccuucugaaacuuguccuugucgagaccagcucagucguggagacccuaacccaguggcgcuagaggaauuaaagacacacacacacaaauauagagugcagagugggaaucagggggcugacagccuucagagcugagagccacgaacagagcuuuacccacauauuuauugacagcaagccaguaauaagccuuguuucuauagauuauagauuaacuaaaacaggaaacaaagagauggacucuggcuaguuaucugcagcaggaacauguccuuaaggcacagauugcucaugcuauuauuugugguucgggaaugccuuaagcaguuuuccauccugggugggccagguguuccuugcccuccuuccgguaaaccaacaaccuucagcauuggcaucauagccaucacaagcaugucacagugcugcagagauuuuguugauggccauuuugggagccugucuauggccagauuugggggccucuucccaacaugucuccccuuuuuguuuuugcaagaugauaaaagcaaagguggcuuuaucacagugagcuacuucucgcaggagucgggaucugcaucugcagacuauacacagacaacacagauuaaaagcacgaucaucauugaaaucacagagucuccaagaguuuuuauccauuuuaauggguuaauagcugcuaaucauuugcagcuccuucaagcacuccaguuccuggcauuaaggucacgugugccugggaugcuuuaaguauuuguucuuuuaauuuugcaauauccaaagacaaguuuguagaguguccuucuagaugcuuuuuuauucuuucccaaauuuugaucuuauuaagagccauuaauaguuuccacaaauccuuauguuuagcuccuacagugggccauaucauuugagguugaggugccacuagaccgccauguuuucagauaauaggaacucuugccauacuucuuaccauuucuaccauuugaccguuuuguuuagaggagcugaacauaguguggccauggcacgcagacugagaggugcaguucaagcuaaacauccccuuaggggaccaaucaauaaugaugccauaggaaucauugcucagcaccucugccuguucugcaaugcaaucuucccaaacaaguauguucauuuuuucugaccagguccaauccuguuuacaaauuuguuuuugagggccguaugccucaauuauaagagcagauuuauuaugguaaauacugagaccagaaagcauguguaacugugucauaaagugauuauguccaggcauuauuugccagccaagauugauagcgaggggguaggcaacuaguggccuuucucaaacagauaggcggacauucaaauccuaaacaaauauucauaacaguucuuuucucaugugagugagaugggccucuaacaucuguagcacugagcauccaagagcuaucauuaguguauaccuccacuggggggguccagccaaguuacaggccauagaagugguagaaaagguaaauaugcccaauaaguauaauuguucucugugucagccuuugcuaagggaauacucacgguauuggugaucaccgcuaucauagcuaucauuagauugauuacucauugugacugguuguccugcuuuccucagguuuucuuccaucaucugugacagcuucuugaucuguccccagguagguggcuguauuugacggguguugcucaugacaguugagguccuccucagugucauucuugacauggcugcaaccaggggguuuuugggauccucccaaaaccucuuccuggguaucuggcucauaguaagguuucaggugucuugaugguauccagauaggcugcugguuuuggccuggagaaacacaagcauaaccucuaccccaacuuauuauuuuaccuguuucccaacuuuuuguugucggaucucuccaccaaaccaguuguuuugcuucugucuuugcagcugguuucuguagaugcuguuuagcugcugauaacaucugggcuuuaggcaggcucaaaaaauuuaaagucaguaaugcuagauucaguugcauauguggugucccguaguuccuguuuccccccuuuugcuuuugcaacugcuguuucaguuagagauucauucuuuccacuauggcuuguccuugagaauuacaugggauaccaguaauguguuuaauauuccauagagagaaaaauguagcuagagcuuggcuaguauagccuggggcauugucccuuuuaauagaaacuggaaugcccaucacugcaaaacacugcaaaaggugacauuuaacacaagcagaagacucuccugauuggcauguagcccagacaaagugagaaaauguaucuacacauacgugcacauaagcuagucucccaaacgagggaauauggguggugacauccauuugccaaagagaauuagguuccaauccucgaggauuaacuccuccuguaaaagaugaggaaugcaccauuuggcaaguugggcaucacuugguaauagcuuuagcuucuuuccagguaaugcuguaucugcauuugagaccagaggcauuaacauggguuaaauuguaaaagugucuggcauuagauauugcaguagcaacuaggcaaucagccauuugauucccugcagucaaagguccuggaagagguauaugagcccuaaugugaguugauguaaauagggugcauucuacuccuaacugcuguuugcaauuggguaaguaaagucgucagcugcucaucuguuuggaaucguagcugagcauuuucaacuaacuguguagaaugaaccacauaugaagaaucagaaaucacauuaauaggcauaucaaaagcagucaauaccucaauuacagcuacaaguuuugcuuuuugagcugaaguauagggcgucuggaaaacuuuaccuuucaagccagaauaagaagcuuuaccauuacuagacccaucugugaagacauuuucagcaccuucaauugguuuaaauuuaguuguuuuagggagaaucuaauuaguuauuuucaaaaauugaaacaguuuucguuuuaggaaaaugguuauagagaauaccuacaaagucagcuaagugaguuugccaaguaagacuauuuguaaaagccuguuguauuucugccuuuguaagagggacaauaauuuuuccaggaucauauccauguaauuuaacaaucuuaguucucccauuuccuagcauaguagcaauuugauccaaauaagcagucaaaguccgugaauuaguuuguggaagaaaaagccacuuuacaagauguugcucuugaacaauaacaccaguaggugaaugcugaguugaaaaaauuagcaaaucuagagucuucucuggaucuauucuauuuauuugagccuuauacgcuugcuucucaauuagcuguaacucugccucagccuccuuuguuaauugcugaggguuagugagacuaggaucuccucaaaggauagaaaauagauuacucauggcauagguaggaaugccuagagcaggucauguccaauuaauguccccuaguaauuuuugaaagucauuuaauguuuucaauugaucgcuauguaugguuacuuucuguggcacaaugguagugucauuuacuaagguccccaaguagggguaaagaguaguagucugaauuuugucaggagcuauaauuaaaccagcaugaaaaaucgaauuuugcaagugaucauaacauugaaguaauauuucucgagugggggcagcacaaaguauaucauccauauaaugaauaauguaacacugggaaaauuuuuuacgaguagguucaauugcuugccuuacauaagucuggcaaauuguuggacuguuuaacaugccuuguggcaacacuuuccuauaaaaacacuuagcaggcuacagguuguuuaccgcaggaauuguaaaugcaaacuguucacaguccugcucagcugaggggauaguaaagaaacagucuuuuaaaucuaugacuauuaaaggugaauuuuuuggaaucauagcaggagaaggcaauccuggcuguaaugcccccauagguuguauaacugaauuaauggcccuaagaucugucaacauucuccauuuaccucauuuuuucuuaauaacaaagacuggagaauucuggaggaaaauguuggagcuauguguccuuuuucuaauuguucaguuacuaaguccucuaaagccuccaguuucucuuuacuuagcagccauuguucuauccaaauuggcuuaucuguuaaccauuuuaaacauauagguucuggaagcuuaacaauggccaccaucaaaaaugauacccuaaaccuuggcaggaacuuugucuuucuacuugaagugguuccuucaaaccuugcagauuuuuuccuagucccauaccagggacauaccccauuuccugcaucauauguugacuuugagggcuauauaauuguucuggaauuagaacuugugcuccccauugcuguaauaaaucucuccccaauaaauuuauagguacagaaguuauaacugguuggauagucccagguuguccauugggcccuucacaaugcaaaauauaacuacuuugauauacuucagaggcuuuaccaacuccaacuauguuaaauugagcagauugaauuggccacguggacggccagugcuguagagaaaugauugaaauguccauuccuguaucuaccaaaccuuuaaauucuuuacccugaauaguuauuucacagguaggacauuuaucaguaauuugauucacccaauaaguugcuuugccuuauuugugcuuccaaauccuccuguucguguaguuucacuuuuccccaucuccauauaugacacaaucaggagcuaugcuauaugcucuccuggcucugcuuuccagggaacagaaguagauauaacaauuugaauuuccccauuguaaucugaaucuaugacuucuguacguacuugcacuccuuuuaaauuuaaacuagacauaccuagaaguaauccuaccauccucacuggcaaggguugacagauuccuguuggcacuuuuuguggggguuccccaggcagaaggcucacagcuuuugggcagcauaaaucuacugcagcacuaccggcuguggcgggggacaggcauuguacaggggugagggaauggccugagccagaaaugccccgguuugggcgcuacuugccgagaccaggucggucauggagacccuaacccaguggcgcuagaggaauuaaagacacacagaaauauagagugcagagugggaaucagggcugacagccuucagagcugagagccacaaacaaagcuuuacccacauauuuauugacaguaagccagucauaagcauuguuuuuauagauuuagauuaaaacgggaaacaaagagaugggcucuggcugguuaucugcagcaggaacauguccuuaaggcacagaucacucauacuauuguuugugguucaggaacaccuuaagcgguuuuccacacugggugagccaaguguuccuugccgucauuccgguaaaccaacaaccuucagcaugggcgucguagccaucaugagcaugucacagugcugcagagauuuuguuuauggccauuuugggggccugucuauggccagauuugggggccuauccucaacacguucuugucuucccaauuccuaugccugugccugaaagcacuuaguaaauacuuguggaauccauuaaugauugaaaucagugacuuggcaaaacacuuuaaacuagaaugaaagaaagacaguuauagaaguaaagaaacaguaugguaagauaggaucauguaggauaggcuagacagauaaguuuagugaaaugguaaaacuuuaauagagcuacacaaagauuuaagcuuuuacaaccaagaaauucaggauuggauuuuguaauagauuuaguuuuaaagaaugccagauuguuagagugaacaguagaugagcuauguauauagcuguaaaaauguaauauagcacagguuaaaagagaccagaaacaugucauuucaaaccgcuuucugguggaguagcuuucucagugagccaccacuuaaaugacuugaugagauuaacugacagcccauuccuguuugaugcacuaucugauucccuauagcaugcugaagacuuauuccaugguaugucuaccaguugaguuguaaaguuauuaagaaccauuuacuuguuugugcucccaauacuguucaugcuaguuguacuaauuuuaaucacacuauuuauuuauuuauuuauuuacagauggaguuucucucugucacccaggcaggagugcagucacgcgaucucggcucaaugcaaccuccgccuccuggguucaagcaauucucaugccucagccuacugaguaguugggacuauaggcgcaugccaucacgccuagcuaauuuuugcauuuuuaguagagauaggguuucaccauguuggccaggcuaaucucgaacuccagagcucaggugauccaccuaccuaggacucccaaaguguugggauuacaggcauuagucaccgcacccagccuaauuacacaauuuaaauaacuauauaaaccaaggaaaagaauagaaaaagaaagaugauguuucugugaaaauuaaguuaaaugcuuuggaaagauuugauaaaggguaauuacuaaaaaauacugaauuagaugugugcaagagagcuauaaaauaguagggauaaauuauucuaaaaaaauagaaaagcauuauggacucagauugccucaugugucauauaauucuugccccacuuuuaaagcaguguuuuuuaaucuaugagacaugaagucaauuuaauagguugaagucuagaacacaucgcaauacauuuauaccuggaaagaagcauuguucuauggaacuuuucuugaguuuuuaguauuuagucuauacauauauguacaauguaaaaugugacuuucagugaaaaacguaaaaaucuuuugaguuuuuuauccaaacucaaaaggcuuuggcccaaaaaaauuggugaaugaauguguauuuauaugcuuuggguuaaaauacaaucauuauguacuuguguuuaugauacuuagguugaccauuuuguucagccaaccaacuacugaucucagucucaugggauaagaauuuuuacauauuuuauuuuacuugucuuccucucaugcccuccauauugugccugaguccccaacccccaccauaccucggcucucuguuuaguagcuaugugacccuaagggucauuaacuaggccucaguuuacuuuuuaugaaguaagauuauccuucagauugcuuguuauuuggcagugcuuaauagccacguugauaaaguacaugucuuucaugguaucugcccaucuagauuuuuaguaaaugauagacauuccguuaaguuauucuaaaagauuuuugguggggggaggggacacugagagccccauaaugcaaccuuagaggguaucauuuacauagucugugauguaguugacaagaaugguggcagugccaauaccuaucacuugauucugagucucaaauuuucaaguccuggaauguuguuucauauuuggugggcauuaguaaaauuauuuuaguuuguaugugugugauggguuuguuggacuuuuuuuguaaauaauuauugauaaugcuugagguacuaaguauuuuuauuacagagaauugaaauaucauuaaguguuuucuguaaguaaguuaauaggacacuaaauuauugguagauuggaaaagagaugaagguuggaaaggauauugguguacuguugagauuggcuggggugaaaccaguggugcuaaaagaugcagacaccccccaugauauagaaaggagguaacaggcaauaauuguugagucagacauuucugcuuguucaacuaguuauauggucaguacagaauagaggguacaaauggcuauucauauagaacaugaccaggcuggauguuaaugauuuaguaagguagaauauaggccgaucucaguucacucucacauaaaagguguguuuuaaaacacuaguuugugauuuaguugucauugcccucaauuucauuucuaaugauaccuacacuggcccauaagaucaugaauauaaaaauauuuuaauacuaguagugucggcugggcaugguggcucaugccuguaaucccagcacuuugggaggccaaggugggcgaaucacgaggucaggaguucgagaccagccuggccaacauggugaaacccgucucuacuaaaaauacaaaaauuagccugacuugguggcaggcgccuguaaucccagcuacuugggaggcugaggcaggagaaucgcuugaaacuagaaggcagagguuguagcaagcugagauugugccacugcacuccagcaugggcaaaagagcaaacuccaucucaaaaaaaaaaaaaaaacuaguaguguuaaccgugaauucuggguccuggaagagcguuuguccccucuuuuagaaaauaaaaaaaggcuacauuuuaggcguaauugugaaauacaugaguuugaauuugcccuuucagcuccuuuuuauacuuccauauguuacuacuauuuccuauuauuacuaccuucuaugaacccuuugcccacauuaccccacccccaauccagguccucuaaacaucaguuauuuuaucauuuauuggccucuucucuaguagaaacaaccauugccuuacaaucaacuccucaacuagguguuaaaugaaagcagugggauuggauuaauucaugcucaagugugaaugacugacaaucccacaaaccucucaaaaaugauuuuccuuuguacaacggguguucuuucuagguuaaguuuuagucuaauugauucuuugcuauuauuucagacagaugaccaagugaaauggacauuugaacuuugugggaaaagcugucauuuucuucuuuuggacauaaaugugccaugguuggggaguacaggcaagagacggugacagucccucucccaauccaucuguagaggcuuggacaaacuccugguauuuaaacuuccccucuaaaauuaguaggguaccuaggucaagggugguagaaagggacuuuucuugccuuuccuucccacuguagcaaugugagcuuuuuuuucugggugagcuuugcaguagaggggaagcggggggucccacucuagauaguagccugugugggcugguaaacuauagccucccugcuacaggucuugugggacucccuuagccugaggaggaggcucuuucacuaggaaggugcugcuccuguuggguacagacacacuccuuuguuagcaaugauugucuggcugcaagucauccuuagcuaauauaugaaagaccacacucacaguagaaagguaguuuagagauguuauuacauaaaguagaaaagggcagaugguaaguugcagaaauaucccauaauaaaugcaaauaauaaauuuuaaauuucguaaaggcggaagaggagggaaauaaacauuuauugauaucuacuguaaucuagucacauucaucauugcuuuucaucuuuucucaccaaggagaauuuguauaauccaacauauucuaccuuaaaaacucauuugaaauuuguguucucuucuauaauguauucuuauuuuaauacaaaguggugugaaauauuaaauaagauugaugcuuucaaaagauggacauguuuauccagugacuugaugucugcccuggcacaacugcaucacauuccuccaguccacgcucuugucugagaagcaugaaagcauuuaucucacaauaaccucaugaaagggauaucaucauuuuauaggugauaaaauuaaggcucgaagaaggaaggaacuuaaacagguauuacagguauuaaauggcuguguuaaguuucucccccaaagucucuccucauaagcauuuugugauucaguaaaacagaaaaacugguaaugcagagugcugauccaaaaguuuaagguuuuugguccucuacugacuugcaagggaaucuuuuuaaaggccccuuguuaaaaucugucuuucauuuccugaagacuaguucuaaauaaaaacaguuauuaaugggcugacaccuuucagaacucuccucaaaucuagugcacucuucuguguaucuguacacaccugacuuuuaaacacaaugucuuugcugccguuuacugguuucuucacuacacggaaaacaaaccauucagucugcugcuuuaccaccucucagcaauucccuacguguuuaacucauccauaaugcauaggaauagccaagagcacagauucugauaucagaaaauucuaguuuuaaauccugauuccgaauuacuagugugacauuggauaaaguguuuuaguucucugugccucaguuuccuuacuuuaauaauauauaaggaaagaaagggguaauaaugcuuauuacuccauggagauuuuauaaaucuccugaauugucugugaugauuaggcuguugucauuguaaugccuaaaaaauuuuggguugaugacuuaccuuguaaauauacuuuaaauugaauaaacauauaguuuaguaaggauuauauauauguauguauguucauuaagugaaauauacuugagaauaccaaguaauuccacaauuuacauggcccacccuuugacaauagagauucuaaguaacaaacugucuucuuucuacuugagauuuauuuucaugggggaaggauacugcauaauauguagcauucaacuaaucuauucuguuaauuugguaauauaaaaagauuuguagauaaugaauuucuauacucuuuaagauacuuuauacaccuugcacugcuucuggguuuacuguugccucguuuuaaagugggacuuucucuugacggaaguguguuaagaauuggaaaauucccuaucaguagacuagcaccaucuugacagccuuguguucugcuucuaccuugcuaauuguuuccuugggauuauuuggauuguguagaaagcuuuuugcaaauccucuuauuacugaagucauuguugccagcaggaauaagauuaaaggugcuuaagucuguaggguuguuucuaauuuguacgugucauuucaguggcauuuuaacagaacucugucuccuguaccucccuucucccuugguacuaucuccaguuagguccaagaagccaggccauuggaagaagucucauuuuauccuccuaauuauuaugcuggcacucaggagauaauuuuucccuucaugcacugccaauuaauaugcaaauagccugauaaauauuuaugcaacgauuuaaauuaugcagggagugcuuucaguauauucuguaaaugaauuguucauggacuucaaagugcuggcugcugugcuaacgaggagagauuugcauaaggcccuaaucacgcgcauacugauuaagcuucauuauggaaacugccagcugcaaucuuuguuucuauuuuauuacaaaaagaggaacuuuuucaugcuucaguugccuugacaaugucaguccuagcugguaggagagacuaaaacuccucugagcaacugaaguuuccuuauucaguugaagauugcuaugguguaacagaaguuguauuuugcuuuuccccuuaauccacuuuccacccuacgcaaccccccucuuuucgcuuaagaacauacuguagauuuguuagaaauaguaguaccuucuuuccccaccccaaacugcuaccuguuucuuccuuguuuggacucucugcuccucuagaagauuucacagcaaugcuggacugcagugacuauguucuagguggguaccagcacaguucuuuucuuagaagcuuuaauauggaaauagagugugucggguugacuaugcauaaaugcuuaaucgcauaugcagccuguggcgggggagggggagaguuggacugagcagggaaggaggaaagcauuugcaaagcacaagcuuacuugaauuugcaguaggucccucccugugacuagcucuucugauucagaggguaucguuaguaaauacaguuaauuuagaguucagcucgaaugaauauuuuugcuuuuuggaaauuccuauugagaacauuucauguaguuauaaaaacaucuuaaaucugaaacaaggcauagaacuguacauauauaauauauacauauuaauaaaaauguuuuucauaccuaaugagaacgucuuauacaaaaaccaaaaugcucagugaaaaauaagguugagucacaaugcagaauaguuuuuauaaauguuaauaaagaggguaauuguacugguugcugcaacagaucuguugaucgauuuccagauuuuagaaacuauuaacuuuucaaauuuuugcuaggauuaguccucuuuuuaauuuuuuuaaaaucaacuauauacucuagauaacuacaacuuuaaauguuggaaaaccuuuuuagaguuuucucuguagaacagcaagccuuuuggaguggaagauguccagcuuaaauuuguuaaaaccaucuuuggugaugaagauuucaaauaaaucaaggcacuuugauuuuuagauauaugguggcuaaugguggucauauuuuguguggaguuaugucuguuuauaugcagaauuauugagacuuuuuuaguuacucuagucaccuggaaaguuaaaugauaugaacuccgggacuuggauaucuuacauuuaaaacuuuugcaaaugacuuuuuuccuauauugucauuuucugcacuugaaaauuaaagcugcuccugucaccuucauaguugccaaagauaaaguaaaaugauacuucugaaaacguuugaauucuuaugcauaaggcauggccuaaacccaggguagcaguaucugcccagcacaguaaaagccacuauguaaagagugaaugacagaaacaacaaauuuaugucaggaauucaaucuuguauuuacucuuugacauuuacuuaguuaacaauucaaaaaaaggaaagaaaaauaccuuuuuggaauauuuuuaacacaucauuuuagaaguagaaauuacaucucuuacuuucaguuaauaguaaguauuauuuaaacagucuucccauugugcaauuuuauuuuuguguguaugugaaguaauguuuuauuuuuguguguaugugagauaauuuuguuaaaugcuuuugaagcucuugacaguucaguagaagaaucugagaugauucacuuaaaauaccugugacauagucuuuauagaugggaaaauuagaauaugaauuguacaaagucaggcucaugacuuguuaagaauuaugcuuauuucugcggugcccacauaugugagaaaacuguuacucuuuuuaugaauguuaacugauugaucauuuuuuccacuuuccuuuaaaauucauuuaaaggaagcauggagcaguauguaugcuaaugguauauucuauuacauuuguugugaucucuguugacuuucaugagauuuugguugucauucagaaagcugauuuuucacuaaguuguacaccuguuccuuucaaaccuuaguaugcuuucagaugauauuuaaauuucucuggacagugagaagaaggaaguuguagaacugcccucauuuaugaccacaaacauaugaauuuuaacccuuugaacauuagaagaccaaaccaaaguuaugacagaacugccuaagcccauaagacaagcaucaguuacagaaacuuuuacuguauuggaaaagcuauuacacaucuucuuguuggaaaugaaacuuauaaaagaaagacuccugauuuuuuuucucaucuguuaugcauggggauaauucgacuguaaagaacaugguugagaauucugucuagugauuguuuugauuuucuaguuagauguuuaagcagaugaaaaaaugugcucuuuggucaaaaacaguauaguuuaaauauuuguucucuguuaauaacuaaaguuaaaugguucuuaacuuauuuaaccacuaaauaaguuaauguggguaaaggcagaacuuauuugacaguaaacuuguuugaucauaaauauucuaaguuugaguuuacaguaguagaauaagagauauauuuauguauauuccguuucuuacccuuucaaagacuuagaagaaaagcagaguucuugucucuucucuuaauguauuuucugggauaccuaauauugcuugaugaaaacauuuuacuguggaaauaaaccuucauuaaguagauaacccagaaaugauaaacucaaauuagcaguuucauuuaggauauugagguaguauuacuuuaagugggugugguuguaaugcaguuuugaaauuauuagcuauaucuguuaugccuuacgguacaacuucuugugcugguuuauaguugagguaugaauuuaauauguucucacuuugacuuguuuaguuugguuggggaggggaguaaauuuagagauaauuuaccuuagacguguuuucuuuuaguucauagguugaguuacugucccaucuuuuaucaagauuaccaguggguuguuuugguuauaaugaaugaauaucauugcauauagaaaaagauacuuuauuugggaauaacauuuuauuaugugaggugcuuccccccuuuccaguuuuacuucauguuaaaagcauuuauuccuuuuacauaucaggcuuucuaauuuucuucagguuacaguucugcugucuuucuuuaaagaaucuuaaaauuauuuaaaaagacaguuuauuugugaaucccuucagggucuggggaauuuugaauuucuuccagauaaccuuuuauuauaauuucuaguauuuuagccagacauguauacacugggucuucuuaaacuauaugacuauaacauuaguuaacccuuuucucugccacaguuuugccuccucaaucccaucuccauccccaguuuuuuaaaaaccuuauucuccucugauuuauugcagacucaagaaugaacaauccgucagaaaccaguaaaccaucuauggagaguggagauggcaacacagguaagaguuuucugaucuagcuuuuuaauuaacucuaguagagcacaaagaagaaaguuuccauguaacuaggacuuguauuuggcaaauacagaccaauuugaguauugaguugucaaauaugauucaguccuuuaggaacugggagggauuauguuuguuuaagauuacuuaacuuucuucugcaggcagcuucguuguuuugcuucugucuaucagacaaacuaugcagaaguuaggaaaacuguccuuugggucagauaguuuuggauaugaaauauggguuuaccacuuacuagcuugugacuuuaggcaauuuccccaaucuuuuugagacuuaauuuauucaauuacaaaaugaggauaauauauuucagguuauugugaguauuaaaggagaugauauauguggcauguuaagcaaaaugccagcuacacaguaacuauucaguaaaauguuuuuucuuacagauguuaaucaaaauaguaaauuuuaucugcccuaccuuugcuauaaauuauauuaaaaguuaugauaguaaguaguuauagacacauacccauuucuaauacauucuuuuauuugguaauuuaaaaaaauuauacuucauuaaaccuuuuaucaagagaaaauuaucauauaaaugagaauacugaggccccaugagagaaagguaaaucuguaaaggaugguuugucuccacggcucauacucuugagucaguauauugcuuagaggauguaagacuauguaucuuuaucaucugccagagaggauacagggacuucccugguuucugguaaagguauaaaucaaaauaugaaaccaaauaagaagacaguuaugggcaaggaugaacagaaaguacuugcuucuaaaaacuagguuuuucgcuugcagagagggaucccuuuugacuuaucauuuuaaaaaugcuuaaccaugggcaaugguaagagugagaggcacucuuaauuugugguaaauggcugaguuggacuaauguagcaguuuuccugccuguaugucuuuugcuguaaacucuccuauaccuggagaugcuuauguuaaucucuaaacuguacauaccucuuuaugugaaacugagcuguggggcuuccauguucaccccuguuguauuuaacacacuucauaguacucuuacugaggcuagccaaguagacuucuguaguaucucuuaagaagggaaagggcagcauuguauucugucugaauugucagccagucuccuuuuuguuacuucucuguccccuguuuggacuccaucuuucuuucuuguucagcacugguuccuaugccagugccggugcuucagccaccuagcuuaggugugggaaauguuugcagagagaaauagggcagcugauccccuuaagagacuagaggguggggcagugggcaggacaccugugccuaaagaacagcuucaaagaagaaacauacuuuuuuuuucccuaagggaagauaagcaaaugauuggaaaacacugaaaauagccauuacaucagacuacauggaaaucccuguaucuacuuuaaugcuacuacuguaauagcaguuucagcaguuaccauuuauugagcaacuacaacacuuuuuuuuuuuuuuuuuuuuuuuuuugagauggaauuuugcucuuguuucccaggcgggagugcaauggugcgaccucggcucacugcaaccucugccuccuggguucaagcgauucuccugccucagccuccggaauagcugggauugcaggugccagccaccaugcccagcuaauuuuuuguauuuuuaguagagacaggguuucaccauguuggccggcuggucuugaacucugugggcauuaccugauuucgaguuaaguuauuuugacaaguuagauaccauuauuucaaauuauaggaaauugaggcacaaaaccagccaggaaauaaagucagguuuaggauucgcagcccacauguaaguuuccccaugaagugcaauaaaauaaaacugaaaauuuaagcaacacauuguguauguccagaccuguauaagguaaguucugacuggagcacuuguuguaaccgucuugugaauuucuugccucguuuuaauauagaauguguggcagacugguuccuaucagacuugcauauuuacuuaccauguuugauauauuagauauaaaauuacaguuuauuuagauaauuguaugcuuacaaauugauuuuuauuuaagcauauaacaaaugagccuucagacucuugaguuguuaguuaacuauucuuuuuuugguaguuuaugaaagcaaguaaaauguuuaaggggaagaacgcuuaacauuauaguaaaacugaagccucacaauuucuggauucagaauauguuuguguagaucauuuuuuccugaaauguuuacaauuguaauaauuuugauuugugacacuuuaaggagaaugauauuguaaaauuauuuuaagauuguguugauacguuaauucuauaccuucugucauugauucgagaggcaaaaucaaaugaugcacuuuuugucaaauaguccuuuuauguuugcagaaaauuuauaguuuagguuuuuaaaaaauguauucaguaagugcccguucuauguguaaaguacuauaaucaguguuauuaggauguacaaugcaaauagaugaaauaacccucagucuuuaaggaguuaacaauucauuaagagauaagacagauaaauaacugauucuggauagauuaugguaaauaauucaagaggagguacagaaaagugccauagugguguuaauuagguguuucuuugaagaaauuuguguauguuuauaggucagguggaaggacccaucagggagcaagagaguggagaaagaaauacaauuaauugaaccaagguaggggugaaggucuaggaucagaagugcagaaugaaggguugacucugaacaugaaaaagacuaccccaugucucuaaaacuggggagaagaagcaaauauuauacaguaacagagaauugaaauggaagggagaagcaaaacugagcaaucauucacaucagauugcuucauuuuucucauuaaaguaguugagguggucaucugagaggaaggcagggauaauaguaauaauaauggcagcagcuacuguucuuugaauucuuacuguaggugucuggcuagccacuuuauuauauauacuuuaugucguaauuuuuaaaauacucuuacaagguuaaguagauuuauaaaaaggauugaugagccuuuugagggucagucucaaagaaaauaaauguguuagcuuauccagccaaccuaguuauacagcugaucauugaauaacauggauuugagcugcauggcuccacuuauaugcaaauauuuuucauuaaauauguuggaauuuuuuugagauuugcaacaauuuggaaaaacucacaaaugaacugugaaauauugagaaauauugaaaaaaauuaaaagauauguaaugaaugcauaaacuauauguagauacuauuuuaucaucuauuaccaugaaauaucacaaauguauuaaaauuauaaaaccuuaaaauguaucagaacuuacgcacacacucgaucacauacauggcaccauucacagucuagauaaauagaaacaaauguaaacaauacaguauaaaucguaauuggauaaaauuaacugcauuaccuacuauacuacuguaauaauuuuguaaccaccucuuguugcuauugcaaugaucucaaguauugugaguauccauuuaaaaugccaugugacccuaaucaugucacagugaacaguucauccaguaaauuguguauugcaguaaaaagugaucucucuauguccuugaguauuuugcauccuguuuagugcaauaaccuaaaccuuaaauaaugccauaagaccuauacgaaguaccacugguggugccagaaguguuccccaaagcagaggcaagucauaauguuauaggaaaaauuugaauugcuugauguauacuauagauugaggucugcaguuauaguugccauccauuucaagauaaauaaauuaaguguaaggacgauuauuuaaaaaaaaagaaaaggaaauucaugaagccuucacugcagcuacaccagcagacaugaaaaacuugaacuuuuugcuaaauaccuuuuuauuucauugaaaauaccggccuggugcaguggcucaugccuguaaucccagcacuuugggagguugaggugggcagauugcuuaagcccaggaguucgagaccagcaugggcaacauggugaaacccugccucuacuaaaaauauaaaaaacuaagccaggcgccauggcucaugcuuguaaucccagcacuuugggaggccaaggugggcggaucaccugaggucaggaguuugagaccagccugaccaacauggugaaaccccaucucuacuaaaaauacaaaaaaauuagccgggcaugguauagcuguaaucccagcuacucuggaagcugagguaggagaauugcuugaccucaggagguggagguugcagugagccgagauugggccauugcacuccagccugggcaacaagagcgaaacuccaucucaaaagaaaaaaaaaaaagcuagguguaguggugcacaccuguacucccagcugcuugggggaagagguggaagaaucaccugagcuugggcagucgaggcuacagugagcugagaucacgccacugcacuccagccugggugacagugagaccuugucucaaaaaaaaaagaaagaaaaaagagaaugcagcuuuuaugugggugcaggauugcuauaagaaagacauaccuuuggacucuaaugugauuugagaggaagcacaguuguuauacgacagcuuaaaaggcaggugaaggaucuaaagcuggagaauuuaaugccagcaaaggaugguuugauaauuuuagaaagauguuuggcuuuaaaaaugucaggauaacggaagaagcagcuucugccaacgaagaggcagcagaccucaaguucucagaugccauggagaaaaucagugaaggccgucugugguggcucacaccuguaaccgcaccauagcuggaccccaucucuacccucaccccacccccugcaaaaaaaaaaaaaagauaagacaaaagaaggaaaaucauugaagagaaaggauaucugccugaacagguuuuuaaugcagacaaaagcgcccuauucugagagggaaaaaaugccacaaaggacauugauuaguaaggaaagacaugaaagcacaccaagauuuaaggcaggaaggaauaggcuaacaguacuguuuugugcagaugcaaucggguuuaugaucaggacagcccuaucuauauccuauuaaagacugcuuuuugccuucuuuuacagcauggacccuuuuaugauaugggcacugaaacuaaagcacaugguggaagaaggauugguagcauauagaaacauuuuuagacaaaugaaaaagcaaaaaagucagaaauuacaguguauuuccauaaaguuacaccaagugugccugccucuccugccuccccuuccagcuuuuugucuucugccauuucugagucagcaagaccccuccuguuccuccuucucagccuacucagcaugaagacaaggaugaagaucuuugugaugauccacuuccacuuaaugaauaguaaauauauuuucucucacuuaggauuuucuuuagcuuacuuuacuguaagaauacaguauauaauacauauacaaauauguuuuagucaacuguuuauguuaucagcaaugcuucuggucaacaguaggcuauuaguauuugaguuuugugggagucagauguuacaugcagauuuucaacuguuuguggggucgacacccuugacuccguuguucaggguucgacuguaugaccuuucuguagccuagaucagcaguccaaacucaggaaugaagaaaauggaacauuggauuauugugccaaaauaguauacuaucaccaaaaaagaaagagauagaagggagugguaauauuuuuuauaacauaguuguuugcacaaggaugcuucccuuuggaaagaugguauuuccccauucuucccucuccuccaccuuugguaaagucuauucuauguucucaagauuauuccguauuguagcauguaucagaacuuuauuuuuuauaagauauuccauuguauguauauacuacauuuuguuuaugcauucauuuguuaaugggcagcuggauuguuuuuacuguuuggcuauuaugaguaauguugcagugaacuuugguguacaaguaucuguuugaguuccguuuuucaauucuuugguuuauauaccuaggaguagaauugcuggguaaaacagaauacaaacuuauuaucuuacaguuugggaggucagaguccuaaaaugagaguguuguaagugcuuuauuucuucuggagguacuauggaaaguccauuuccuucucuuuuccagcuucuagagaccaccugcacuccuuggcuuauggccccuuccuccaucuucaaagccagauguauagcauugucaaaucuguuuccuucccucccuuuccugucccccuccuccccucaacccugcuuccaucaucauauuuccuucucuaacucuccuguccccaucuuuucuuuaaacacuuacuauccugaacuucauuggauuugcaaaauaccuuuugccgugucagguaacaaauucacagcuuccaggaauuaggaugauuauuaggcccaucuuugaugggcuguuguucugcuuucccacaagauuuucuccuaaauuaaagcugaucaucucuauuuuagaugauaguuggaaaaguaaagaaguuguuugaaguuuuacaagguuugguaggaaaaaacuaaaucaacuauuuugauguaaagaaauauugagggaaaaaggaauauuggacaaacauuaaaguuuugcucacuuuuaacucaaagggcagaccucuuucaucaguacuccugacagaugguuaucugcccugugccuggguucaugcacugacacagaacacaguacuuucuaguguuaucuguucucugguauuacaacucuguuuucuacauucuuuugaauuuuguccuuaggaguuugucaucuuuuaagaaauuaaagcucuucugaaagucauugucacauuuuaacucuuuuccauucauuugacaauuuauuacaaauuaauuuacuauaaaguaguaauuuauuauaaaacaauuuguuauaaucauuuguacuagaauaugaugauaguggcuagcauugauuaaguauuuacugggugauuuaaacauuuuacauagauuaucucauuuaauccuuauaaaaaccucaugaaacauuauuuuucucuuuuuauaaauaagggucucuuuuuauaaauaaggaaguugaggcucagagagguucagucacuugaugaaggucacacagauagcuauaaaggggagcagaaccauucuuuuuuuaagauggaauuucacugucguugcccaggcuggagugcaauggcacgauccuggcucacugcaaccuccaccucccgaggucaagcaauucuccugccucagccucccaaguagcugggauuacaggcaugcaaccaccaugccugacuaauuuuguauuuucaguagagaugggguuucuucauguuggucaggcuggucucgaacuccugaccucaggugauccgcccaccuuggcuucccaaagugcugggauuagaggugugagcaacugcacccagcccagaaccauucuuuuacccuuugagcuauguuguuucuuuuuucuuuuuuucuuuuuuuuuuuuuuuuuggagacagagucucacucuguugcccaggcuggaguguaguggcacgaucucggcucacugcaaccuccaccuccugcauucaugaaguucucccgccucagccucucaaguagccgggauuacaggugugcgcccccacgcccagcuaauuuuuguguuuuuaauagaaacuggguuucaccauguugcccaugcugaucuugaacuccuggcaucaagcgauccaccugccucagccuccugcugggauuauaggcaugagccaccaugccugcccuguuguuucuuuuugucuccgaugcgcaagauaacaguacuaaguaacaucagugaaguugaauaaaagacugauuuuguucucaauaaauuuaucuuauagagaaaacauauaugaaaauguaauauaacagaaauugagacgauucaugagaaguauaugugaacccaugagaauucaguguaggggaaaaguguuucuagcugggaggaucagagaaggcuuuggagaagguggaauugaaacuguaucuuacaggcuggguaggguuuaaaucaugaugaugcuaggcaauuuauguucagcaugaagaaacagucaaagcugagaugggggaagaaaucuguccuaaaugucucuaauuccuucaaaagauuuccauuaugucaucugauuucuagaucuuuuaucuuuuagucauucacagaauuagacaguauuccaauucuucagacuucauugcagccauuaccauuaccuuuugcuuauuauuaucuuugaaaacuuaccauuggcuuauuauaauuauuuuuauaaugcagguaaaaaggauauuuaaauauauuuuaauauaaauguuaauauauuuaaucagauuuucugauacuuguuuuguaaugugaaaaguuguuuuaaagcagcugacucaucuguuguaaugaauuuacagucaauuaacugucuuuuuuucaucugaauuaugauagauagauccaaggcuucccuauccuguccuuuuucacuugcuuuuuucauuugaauugaaaggggagaguucccugaccccccuugcaggacaugcgacagggaguggcucauauguuuggcugcccacacucaaaccucuuagaggaagggaagcacacagacuggcaggugcaggaguuaugguaagcacuuucugggcucuggccacaugauagugucuaggggugggugucugcaacucccaaagcccaagugggcacauguuucagugcacucuuuuagccuugccaucuacagacagcuuaaguguuagcucagugauccucuugguacccaaguccuugugcggcguccaggaagaaucaggucacacauggacuugaaggaugaauucagggguuuuguugagcgguggagguggcucuuagcgggauggauggggagcuggaaagggaauggaaugggaagaugaucuuccccuagaguuuggccauccagcagcugauuuccucuuugaccacccccagucgaauuccucucaacauucagacauuccuucucuucucucugccacaccauucugcuguucuucugcucuacuguucaugucuucuggagccuggggucuggggguuauauggagccacgauagugggguauggcaggccaaaaggcaacuuuugggcgcaaaaacagaaauaccuguucccauuuaggaccauggguuuccaggcuugaggguggggccuuugcuggggaaccacccucuucuacccaguauuucccugucuccuguucauaucaaaaugauuuuuccccaggauaguaucacuauauuucaggcaaaugaaaagucaaaagaaauuuguuaauguaaccuaauauacauaaauacaauaguauuuuuggaauaauauuuaugggcuuguauuccaaaaauacugucauccaaaguuccuaguaaccagugauguuauuaauucuuugggauuuacuagugcuauggcugguauuaggacauuauaugcucauuuauauucauaaaagagcaugaucagauaucauuuucuccaagaugaagagaaagaauccugaaagaccaggguaccagugaauagacuugcuauucuucauaguaauuuaacaacuugaugccuugaaccagcacuaguuuuggaaauaauuuccagauaaaauaccaguguuuuccagaaaagccucaaaauagaccucaauauaguucuuguuaaaccagaauggagcauuugcaaauuucagacacuuaaggauuauuuuccuuuugaacuuacguuuauccagaggccauuuuuaauauucuuacugcuuuuauuauuauuuuaaaauuuauuacauauuuuauuguguagacuacauucugcccuggccaagcugcucuuauaagccugagaguagaaauacuaauuuuguuuggaguaccuuuauagcuaauuuuuaauuagugggucauugaaaguggcugaagcauuuccagagagccucaggagcucagugaaggaucuuggugguuuagaagcaaauaccaaacaccuguaggaaagauagaccucccucuaguguuugauuuaauagaugucaguuacaggauauggcuucuacaagauucugaucaguacguauugagaaacuugcccuggcucugcccacuggugcacauggggauuuuaaaacuuuaggucaggggugggggucaagggggagaagggcgcuauaauuacugaagcugugcgaauaggaagugacaucugaauuaagauuauacuuuuguuaaaugacugaauaagcaauugaucuuuuugccaugagguaacccaguaacaaauuuagaauuuuaaagguaguauccauuuuuguucauuacuaauagaaauugagaacauuaaagagaggguuuguuucuaaaaugcuguuuucaguacagauuauuagagauugucuauaauuuucucccuuagagagcagcuuaguuuuauuucauguuacuuuuuucauuuuuuuuccuaacagauauuaaagaauuuuugguauaaaagaauuuuccagccauguuauacuuuacaucuugcuugaagccaaaaacuagacuacauuauucuuucaauuagauccauuauauaacauccuggcauagagcaauggcaauagaagccaggggucaauuuuuuuuuuuuuuuuuuuuuuuuuuuuuuuuuuuuuuuuuuuuuuuuuuuuuugaaggaaggaaagggaguaauuuaaaaugaauacuuguauuugccucggggcugggagagaugugguagcauucucugaguaggaacuguacuguuggggaguagacuugacaaugagaugaugaaacauuucagcacugaaaauguuguacuuggggugccuuguggugcuugcaggugaagaugugggcaauugaagauagagauagguuccugaggagagguguaagagucuuuaacagggaaaugcuacggggaggagaguggaaucagccaagaggaccaaggacggagcucuucuaagguguugaaagggcugguagaggaagaggagcccaugccuuuguugucgaauaggauggacacugacugcauguggcucuuuaaauuuaaauuaaauuaaauuaaauuaaaaauucaauuccucaaucauacuaaccacauuucuaguguucaguagccacguguaguuagugacuaccauauuggccaguacauauaauagaacauuuccauuaucacagaaaguucuauuggacagugcuuaaguagacuaagaaauaacaaccauggagaucagaugugaaucagaccagugagcucauggaguuagcauuuaguguggucaaguccugccauaggagccuuaaaaugugacccuugaauuugacaauuaguuacugugggccuuuuaaagauuuuaguuaagugguuuggaaagaaauugcugugguuaagaaagugaaugguuguguaaagggaaugauaaauguaagcaacucuuuucauggaagcucuauauggggcuauauauauguaucauagugguuaagagcucagacccugaaaucaaaccccauggauucauaucuugcuccuuucacuugcuaguuguguuaccuuaggcaaguuacuuuuuucauguuagaguuuuucuuagcuguaagauggagauaaauaauaauccaucucauagucuuguuguauacacggaaagcaaguagguauguggcacaguccauucacuaucaguguuagcuaucuauuaggaggaaggggaggaugauagagaaggaaagaaugggaggggacguuagaagggccuccuagugaagcaauuugaauauguuuagaugcuaagggaaaagagccaguguaggaggggaguggcaaagaaagaacagaugaugcagccauaaaaaggaaugagaucguguccuuugcagggacauugaugaaguuggaagccgucauccucagcaaacuaacacagaaacagaaaacgaaacaccacauuuucucacucauaagugggaguugaacagugggaacacauggacacagggaggggaacaucacauaccaggggugagggugaggggagggaacuuagaggacgggucaauaggugcagcaaaccaccgugguacacguguacuuauguaacaagccugcauguucuauguaucccggaacuuaaaguaaaauaaauaaauaagaaagaacagaugagucagggauccauuuuugaggagaggggagguguuggguuucagagcacgugguggcugaaguagccuaaaguagaagauuccuuuuuuuguuguuuuuuaggugagaaaugggagaguaaaggagauaaagacagauucagauaguaaguuuucagguagaagggaauguaagaaagcagucuagagaggauuaggaacagucaauuagggauuuccuugugauacagggaaaacaaaacugggaauagaaugcaauaaacaagucuaggauuaaaauaaacacuaucagcaggauuuguagcaaagugucauaauccaaguuaggaaggcugacaucagauaaacucagaagguaaagagcauucauuguguuucugaggaaggcaggaagcugcuaccguuuaacuggcucacauccuacagggaaagaugagcaagggagccucugacuagguugagaggcagaacagagauggagcaaggucaauguuugguaauuuucuccaccaacaaaaauauuaauaagauuuuaggauauuaaaauaaggucugucuuucugguuuucuuggucuucaaauauauuucauuuauguucaauauuuaaguuauuugaaaagucucaacagcugguaagucauaagacacuuauuuuucuacaauuaagaauaaaguuaagagccuggaauaaguggcucacaccuguaaucccaacacuuugggacaucaaggcaugaggauuccuggagcccaggaguugaagacuagccugggcaacauagugagacccgcaugucuacaaaaaaaaaaaaaaaaacuuaaaaaaauuaacugggcaugguggcacaugccuguggucccagcuacuugggaggcuaagggaggaagaucgcuugagucuaggaggucaaggcugcagugaaccaugauugcgccacugcacuccagccugggugacagagugagacccuggauuuuuuuuuaaaaaaagaauaauguuaaugaaaaccuguuuuaacugagucuuucauccagauagacuuaacaauuuagcaaacagccaccuauagaaaucuugucaugcaucacugauaaugcauucaucucuaaggugauguauaaaaguaauuuuaaaaauacacauacuauuauuacuuaggaaguaaaggauauacaauccaaucauuacaaucaaguacaaucacuguggagauuuuuagcagauaaguaauaccuauccauucuauagaucagcagcccccaaccuuuuuggccccagugacugguuucauggaagacaguuuuuccacagacagcgaguaggggaugguuugggggauaaaacuguuuuuuaccucacaucaucagucauuaguuagauucucauaaggaaugcaccaccuagaucccucgcauacacuguucacauuacgguucacgcgccuaugagaaucuagugccacugcugcucugacaggaggcagcgcucaggcaauaacgcuaucuugcccaccacucaccuccugcugugcagccuguuccuagcaggccacagauuggcaccagucuucaacccaggaguuggggaccccugcuauagauauucugugucaugaauuuugauuaugcuucuuacuuuuguaguggcuuagaaucuuucugugguuuuguuucugugauaagugauucucuuucaggauuuccauuaucccagauucuucccauuuuauggcagcucagauggaagaaacgcucuccacacaaacaaucuaaaaaaugagcaguagcuaaguuuuccuaaaagaucuuuuagcuauuauuuauguccugugguugcuugacuuucugugaacuucauuuggaauuuguccuugcuuaucaaggugauguagugaugggcacagauauugucauuauuuccuauagggugucggaaauuuagucuauugguaauuuugccuugacugccuuaaauuuacuuauaaauagaaauaugugaauaauguauuuuuccucuuuauuauguagguuuaauugaaguaguauauuauuuucauuacacauuaacauguaguauaguacuaucucaaauauaacugcugggugaugaaaaauagccuucacaaacucauguuccaaaauuucucaggcccuuauucaagaaauuguuaaucuuauuuucaugugcacuucuaacaggggugcauuucauaacagaucauaagcagccauuuauacagacgaggcuggcugcucuaggaaaguaagccaguagagcagaaacugucagauuuauaccagaacugcagucuuuuauuuucuuuuuuagauugaggugaaaugcguaacauaaaauuaacuauuuuaaaaugaacaauucaguggcauuuaguguauucacaguguugugcagcuaccaaucuauccagguccaaaacauuuucaucacccccaaaggaaacccuauaccccuuaaguaguugcucuccauuuuccccucuccccagccccugacaaccaccaaccuauaguuugucucuauaaauuuaccuauucuagguauuucauguaaaugaaaucauaugguaugugaccuuuuguguauggcuucuuuaacuuaguauaauguuuucaagguucauucauguaauagcauauuaucaguacucauuccuuuuauggcugaaugguauuccauuauauggauauaccacaauuuguuggugucccuuugucucuugauggacauuuggguuguuuccacucucuuuggcucuugugaauaaugcugcugugaacauuuauauacacggauuuguuugaguacuuguuuucauuuauuuuggguauauagucaugcauaacgucagggauacauucugagaaaugcaccauuguaugaacaucauagaguauguuucacaaacgaagaugguauagccuaugacauaccuaaacuauaugauauagccuguuucuccuaggcuacaaaucuguacaguuaguauacugaauacuguaugcaauuguaacacagugguauuuguguaucuaaacauagaaaagguacaguaaaaauaggguauuauaaucaugguucuauuguugcugauggaaaugucuuuauaugguacgugacuguaugucuagcagugaaguugcuggguccacuuuuugaugguccuucaaauaguuaaacauagaauuaccgccaaacuuuuuuccauagcagcugaaccauuuuauauuuccacaaucaauguacaaggauuccaauuucucugcaucccugccaacacuuauuucuucuuuaaaaaaauuacagccauuuuaaugggauuaaauaauguacuuuaaaaaguggcaacucuucauucauuuuccccaggaaauaauaauaacugaaaccuccuccuuuuuuccaauguuuuuguguauuuuccucuaucuuauagucaaaauaucuuguaauaaugagaugagaaugggcaauaauaaauuguguuuacaucuaaggcaguuagauguuugacuugucaccuugguuguuugugccuugcucucuuacccugaacuaccuguaucaccucaucucuccuacaucuuagccacacuaaaccucucaaaacucuuuguaccuuucuaagagcaaguaagugcucugcuuugcauggcuugaggacagugacaguaccuuauucuuuuuuguguucuaccuuccacuuuuuuuagauaccacuuuucauagauaucuuauuuuuuuuaauagugcuugucuuuuguauuacuuauuuacuugucugccacccaaaccuaacugugagcuccuuguaguaugggaauaugacuuuguaacccuaggaccuaacaggguauuuaaaauuguuaaaauucuuagauuuuauuuuuuaacguggccacggugucuucuacuuuugguauagaaaugcuugguauuuucuucccucacucaaccuuuuccaauuaauuccaucucauccucuuaagauucaucugaaauguugucuccaggaagcuucccugaccuugccuucucccuuuccccuuaaagucuucuuuuaauguucuugucaguagccuaugugguaucuguuuuauacuuuccacauuguauauauauuuuuaugaauauggaauucauaaaugcauuacuugugcaccccggccagacucgcuaucccuuuuccucuuuauuuuuccauagcauuuauuuguaucugauauucaauauuuuuucauuuuuauuaucuauuucccaacuagaauguaagcuccacgaaggacauuauuuuugucucuccacugcugcaucucugacaccuggaacagugcuugcuauacaguauaugcucaauacguauuuuuugaaugaauuaaucaguuaaugaauaggccugagaacuacuuaagagcagugacugugguguauucauuuuuauaaccucagcaucuggaauaucaauucucaauaaauauuuauugaauacagcauuuauuuuuacagcaggaucuuuugcuaugugauauuccugguucucauuuguuguuguuuuuguuuguuccuaaauaauuauauaaaaauagaaaaugcacauaagcaaaaauaauuguuucauucaaaauaggagaugauucagucauagucuuguguauaugggcguaauaauuuuaucuaaagccauuucuuauaaagguaaaacuguucauucaagggaagagaaauuucuacugaacuguaaacaugaacacaucaguuggcuaagauuuaagaaaacagcugaauauuuuuauauucauauuucaaaguaaucauugcuuuggaguagauuaaaaauaaagguuguauaggguuucaggugaguuuugauuaauaagaaaagauuacauacacaucaaguuagauuaaguucccaauaagccaaugauacuaaguauuauugggaggcaaagucauuucagaacagguguacuauacuuaauguaguuucccuugcccccugcaaguaggaucauaucagaugagagaauaaaaagaguaccuugccuuuuuacauauucaggauuuuggucuccguugagaaugaaucuuuuuuguucuuuuguuggaaaugggcuauuuacaaauauuuuccaggguuccagaaaacucaguucucugcaaccaacuuucuuacucugauuuaauucuauuuugucgucugugugauucugauacuuagucugagaccuauaguaacaaauguauuuccaugcauuuagcuaaagaacauggggaacugacauugcaaaagacagauuuuuuuucucuuuaaagugucaugauuuccuucagauguagcuagguccugaacagaugaggcaggagaauugcuugaaccugagagguggagguugcagugagccaagaucuugccacugcacuucagccugggcgacagagcaagacuccaucucaaaaaaaaaaaaaaaaagaaaagaaaauguauuaucuguguuaggcugggcacgguggcucaugccuauaaucccagcacuucaggaggcugaggcgggcagaucaccugaggucgggaguucgagaccagccugaccaacauggagaaaccccaucucuacuaaaaauacaaaauuagccaggcgugguggcgcaugccuguaaucccagcuacuagggaggcugagacaggagaaucgcuugaacccgggaggccaagguugcagucagccgagaucaugccauugcacuccagccugggcaacaaaagcgaaacuccaucucaaaaaaaaaaguauuaucuguguuuuaauuucugggcucaaaagguugaucuguuuugaaacuauuaauguuggccagucaugguggcucacaccuguaauccaagcacuuugggaggcugagguggguggaucaccuaaggucaggaguucuagaccagccuggccgacauggugaaaccccaucccuacuaaaaauacaaaaaauuagcugggugugguggcacgugccuguaaucucagcuccucaggaagcugagacaggagaaucgcuugaaccagggagacggaaguugcagugagcugaaacugugccacuugcauuccaacuugggcaacaagagcgaaacucugucucaaaacaaacaaaauuagcuggguaugguggcacaugccuguaaucccaacuacuugggaggcugaggcaggagaaucacuugaaccugggaggcgcaggguugcagugagccgagaucgcgccacugcacuccagccuggucaggaagaaugaagcaccaucucaaaaaaaaaaaaaaaaaaaaaaaagaaagaaagaaaaaaaagaaaagaaacuauuaauguuauaucuuaaguaaugauuaaacguccuaaggaaaacuagauuuuauaggaguuaagauuuuggaaauauuauuuauaauuaggcuggcccuuaaagucuucuugaaggaaguagauuccaggcuggauauuucauaaugacuaggauuuucagagcuagagaggagggugaaggauaucugcauuuucauccuauuugaggguuucaccuuagcuuucucccugacucuccucuccucccucccaccucuucuuuucuccuucuuucccuaauguguaauguuuccucucucauuuauacauuuuaaaauuaauguucauaggauauagauuuccauucucauuuguggaaaaaugacaacaggaauaggauaaaggagaggacuguccucccaccgcaaaaauagaugcacaccugggcagaauucaaacagcagaagugugucucuuuuaagagacuggagacugauugcuuuggagaugacauugaaggauaaauugaaaggaugcccauuuuaggaaaauuuuagcaauaaaaauuaaagcuguuaucacaacuuaaugguaauacucaucaugguagagaauuugaaaaauacagaauaauguauucacuauuaacauuuugaugcauuuccuauuugaagacguuuuuugacaaaguuguccuuuauaaaauguaauauuucuugugggcuauaaaauuugauuugauuccuuuuuaaaaacuuuauuuuaauguaaaagaaauguaguugaaguagcuagcugugagauagauagcaaaggccagaauucuacuacuuugucaucuuauguccccuuaugagccugaucauggccucaauuacugauuugucacuuagcuaauauuugugaaugagcauugaauuggaguccuucgucauuggaugguuuaguagaaagggcaauugggagagaguugaggcaggggugcuagacaaaucgguggaaggcucggaauuucagucugagcucaauuacuauccagcuugguuauuucaguggaaguauuucuguauauuagaaaaaauuucuuauuuguaaaacaaggagcuugauuaguucuuuuuaaugucccuuucagcuuuaccauuuccaaaauaugaaauaaauagaaucauguggauguacccuuugaaucuggcugcuuuuacuuaguauagcgggcuugagauucauauucaucugugucauauguacuuuagcucaauuuuauuucuucccucacucccacaaaauguugaggaaguaccaaauguguuuucguaguaagaagguauagauuauugcuuuuggguuagagagaugggaaacaugaaagaaaauagcauuugagcugagcgcugaaagacauuuaaaugccugaauccugugcaaagcugaguaauaugaacuguucaugaagggaagaaaccuuugccuauuugauccuugacugcuggcuaugaagagaaaaacagaacuuucugggagaugaggacucuccagugcuugaacuuaauauaaauccaacugucucucagcugggucuucacugucacuggugcuaaccuuggauucaccucuaauuuauucccugucacauuuuucauugcauauuuccagucuucucuauuucuguuuugcucuuucguuuucugaaaauaucugccuuuugauuacugaaaaaauuguagcugucugauuugagccucaccaccucccucuucaauacuuuacauuuuucuguuuuuaccuaccuucuccuuuuuuuuuuuuuugcaucugacaaagaaauaucucucuuuacccccaccgccuccauuauuugaauugucuucucguacccuucagguuucugcccuaucuuucaaccgcuauuguucuuaccuuuucagcauaucccuuccacagacucuuucagucuuuuaaguuugcucagguuuuaucaaccucaagucuuuccuuccacccuaucugccccuuugaauuaucauccucacgcugucccgccaguaccugacuuaugaaagaaacgaucaucacucaccaccuuggcuucauuauuaccugcuuuugccuuuauuccuugcaaucuggauguguacccagaauuuuguugcacuuuuuuuuauuguugauucuuuuacgauuuuaugcaaaaguaauuguaaaaacuuguauguaaacaugaauguagcguuuaaguacucauaucuaccacuguggccauaaaguagaauguuaccauuccucagaaggcuucuguaggcccacccugaacauauuccauuuuucuaccacaaaaauaaccacuaucccgaaguuagcguuaauggugacauugcuuuucacucaaaauauuuuuccaucuacauauuuauccucaaauaacacauuacuuagauuugccuguuuccauaaugaaauugaauuauacuguaccauggauauuuuauuacugauuucuuuugcucaacauuauguguuugagauucauccauguuaguacauauaccuauaauucauuuucacuggauauaauaucccauuguaugacuacauuagaauguuuguuuauuccauuauugauggacauuuggguuauuucuaggcuuuugcuauuacaaauaauauggcuauaaaugacuuuguacuuaucucuugauacauauugugaaaaaguccccagaguauuuucuuuauuuuuauuuauuuauuuauuuuuugacagagucucacucugucacccaggcuggagugcaguggcacaaucucagcucacugcaaccucggccucccggguucaagcaauucuccugccucagccucccuaguggcugggauuacaagcacccuccaccacgcucagcugauuuuuauauuuuuaguaaagacgggguuucaccauguuggccaggcuggucucagacuccugaccucaggugaucugcccgucucggccuccugaagugcugggauuacaggugugaguacccagaguauuuucuuaauaguguuauugcugaacuuguucuaauguuacuuaguacugccagccaguuuuccagagcauuuguacugguuuauacugcuacuaauagcaacugggauuaaccgacuuugcaauuuuagccaauuuaucagguguaaaaugguaucucauugggguuuuaauuugcauuuccauaguuuccaagcagauugaacaucuuuuccuguguuuaugggccaucuguguuucuuccuuuguuaaauuccuguucauuuaucuugccuauuuuuucuguuggguugacuuuuucuuauugacucauaggaguucuuuguguauucugaauacuaauccuuuguuguuuguauggauuguaaauauuuucuuuuuucaauucacuuuauguagcccuuugaugagcuuuuaauuuuaaaguaguuaaauuuauguguuuucaucuuuugguucuugauaaagaaauucuucacuuucccaagguuagaaugauauucuuuuauguuaucuucuaagaauguuauaguuuugcauuucacauuuuggcuuuuaauccuucugaaauuuucauuuuucuuucuuuuuuuuuuuuuaguauaguguaaugugucuaguuuuuuguuuuuuguuuuuuaaauagauacccagcuaccccuuuauuaaaaacuccacccuuuccucauugaucugucaucuuucaucccuuccucaccucugucauguuucaaguguucauagguguguguaccucugucucuagacucugcacugguauauguguugaucccuaugcuaauaccacacugccucaauuauuauugcucucuaaauguuaauaucuugauaauccacgucuccauguuuuaaagaacaucuuggccccaugccauucuauguaaauuuuagaaucaacuuguuaaguucuaccccucugcuccaaaaaaaagacagagagaaaauaauuuauugagauuuucauaugaauuuacuuugaauccauaggucaguuuggggagaacugacauuuuuacaauauugagcuggcaucugucuauacaacuggcauacuauaauaacugcacauuuuuaauuacuauuuuuuuucacuauguugcucaagcuggugucaaacuccuggccuuaagcgauccucccaccucucaaaucucugggauuauaagugcgagccuccaugcccagccaugucuuuguuuuuaaauaaaguuuuauaauuuucugccuauggaacuugcuguauuuugauagauuuauuuucaggacuuuguaucuuuuaaguguuuauaaauaaaaucuuuaaaaauuguuuucauuuggaauauacaaagacaauuuuauuauuauuauuauuuuuugagacagggucucacuuuguugcccacacuggagugcaguggcaggaucauggcucacugcagccucgacuucccucagaucaggugauccucccaccucagccuccuaaguauguuacuuaguacugggacuauacuguuacuaaguagcugggacuauaggcacgucccaccacgccuagcuaauuuuucuuuuucuuuuuuuuuuuuuuuuuucuuguagaggcgggguuucaccauguugcccaggcuggucucuacuccugggcucaagggaucugcccgcccuggcucacgccugcuaggauuacaggcgugagccacccugccuggccacaaaggcaguuuuaaaguagauuuugugugcugcauccucauuaaacucucuuauucuaauaauaaauuauuagauuccuuagaacauucuguacacacaaaucaccugcaaaggguuuuauuuuguuuuuuccaacucagauguuuucuuuuuugucuuguuuugcuggauaggccuuggaguaugauagaaguaguaguaguguuaccaguggcaaauauccaaguuucacagcaucaaauguguuaccgguagaagguauuugagucacuggcggcaaauauauacgggucugcagcaacuucaauucuugccuccucagaagaaagaauucgacugaggggcauaaggcagcagaagagaccaaggcaaguuucagagcauggguggaaguuuacuuacaaaggcuuuagaacaggaaagaaaggaaaguacacuuagaagagucccaagcaggcaccgaggucaagugcaguguuuaaccuugauccugggacuuuauaggcuggccccuuucccaugauucuucccuugaggugggcugcccacauguguagugcccuccuuacccuugggaggugagcaggcgcaguguguuuaggaaguuguagacaugcccaucugagguuuucuucccuuuucugguggugugcccccagaaggucauauuccgccauuuugucucuuaaugcacaugcucaagaaauuacuucucccuggucccugccuucaauuaacacuuuagcacaacagguguggaccauuaggaaauggccuuucccugaagccggcugccaauuuaucacuuaggcaauaugaaaacugccagaccaucacccgacauuccuagugggcaagggaagagcccucugcccugcucaugccugucuaccuauuguaacaguaacuggcccccuuaucuucuucuuaaucuuaaaggaaaugcuuuuaauuuuucaccauaaacuaugauguuuauuuauuuuaaugcuuauucuuuaucaaguuaaagaaacuuguauuccuaugccaagauugcccccccucccccacgccuccccccccaccccccccccacccccccccgcuucuuugugagacggggucucacuuuguuccccaggcaggaguguaguggugugacgugggcucacugcggccucaaccuucuggguucaagcaguccuuccccucucagcccaaguugcugggacuacaggugugcaccaucacgccuggcugauuuugguauuuuugguagagaugggguuucaucauguugcccaggcucaucucaaacuccagagcucaaauaauccaccugccucagccucccaaaaugcuaggauuacaggugugagccagcacacccaguccuuaugccaagaauuuuuaucauaaguggauauuguauuugucuaagaguuuuaugcaucuuuugagauuucuauaugauuccaccccgcccuuuauugaacuuggugaaucuuauuaauugauuuuuuuuuuuuuuuuuuuuugagacagagucucacucugucuucaggcuggagugcaauggcgcuaucucggcucauugcaaccuccgcuuccuggguucaagcaaucccccugccucagccuccugaauagcugggacuacaggcgcacaucacuacacccagcuaauuuuuguauuuuuaguagagaugggguuucaccguguuggccaggauggucucgaucucuugaccucgugaucugccugucucgaccuuccaaagugcugggauuacaggcaugagccaccgcaucuggccuaauugaucuuuuuucuuuucuuuuuuuuuuuuuuuuuuuuuuugagacgguguuucgcucuuguugcccaggcaggagugcaguggcgcgaucucggcucacugcaaccucugcuucccagguucaagugauucuccugccucagacucccuagaucuaccuuagccauaauauuuuauauuaguagauuagguuugcuauuauuauuuaguauuuuuucauauauguuuaugaaugaaacuggcuuguauuuauauuuuucacacuuuaucagguuaugguaucgagguuaugcuggucucauaaaaugaguuagaaguguuucugguuuuguuguucucuggaaacguuuguggaggauuagaauuauuuguuccuugaauuuuuggaagcacuuggguaaaaucaacaaggcuuuuuauucucuugggaagauuuuuacuuaccuacuaauucaguuuccuuaaaugcugugggacucuauggauuuucuauuucuucuugagucagucuugauaaauuauauuuucuauagaguuauucauuuuuaaguuuuaauuguauugacaugaaacgcuucacaauauauucuuaaucuuuuuauuaucugcagcuuuuuuuuuuuuuuuuuuuuugagacagguucugacugugcugcucaggcuggucuugaacuccuggccucaaguaauucuucugcuucagccugucuagagugcugggauacaggcuugagcuacugcaccugaccugcagcaguuuuugauaggccuuuuuguuacacuuaaauuguuuguuugcuccuucucucuuauuuucuuguuccaucuuaccagaaguuuauacguuacaaagugacaagauucuuuugaaagaaccaaguugguguuucuauuauguggaaguuuuuuuuaaugguauucauuauuggucuuaccuuuauuauuaccuuucccucuauuuucuuuggauuuauuuauuucucagugcucuuauccuuaucuucucuguaccauuuaauaguauuaaaccacuccauccuuguagcuuucucaucccuggcuccugaaacacacuagacuuuuuuuaaaaaaaaaaaaacuauuuuuguuuuagauguaggggguaaaugcacagguuuguuacauggguauaucgccugaugcugagguuugggauucuaaugauucugucacccaaguagcaaaccuaguaccguagguaguuuuucagcccuugccuucuccuucccuucccccuuuuggaaucccuaguuucuguuucugucuuugugucuuauguguuuaacucccacuuaaaugugagaauaugugguauuugguuuucuguuccuguguuaauucacuuaggaaaauggccuccagcugcauccguauuacugcauggauuuuguucuguuuauggcugcauaguauuccacggugcauauguaccauauuuucuuuaucuaauccacuguuuugggcacuuggguugauuccaugucucugcuguugugaauagugcugugauaaacaugcaaaugcaggugucuuuuggguagaacgauuuauuuuucuuuggguauauauccaguaaugggauugcuagguugaaugguaauucuguuuuuaguucuuugagaaauugccaaacugcuuuccacagggacugaacuaauuugcauuccuaccaacaguguguacgugguuuuuuuuuuuucagcuuugucaacauuuguggguuuguuuuuuuuuuuuuuacuuuuuaauaauagucugccuagugugagaugguaucucauuguuauuuugauuuguauuucugaugauuagugauguugagcauuuuuucauguuuguugacuugcuuguaugucuucuuuugagacgugucugucuuugccugcuuuuuaaugaaguuuuuuuucuuguugauuuaaguuccuuauagauuuuggauauuaguccuuuuuuggaugcacaguuugcuaauauuuucuccuauucuguagguuguuuauucuguugauaguuucuuuugauaguugguuuuggcccucaguguaccuaucuccucaguccugucucuuuaguuuaauuaaauccaaguugucuguuuuuauuuuuguugcguuugcuuuugaguaguuagucauaaauucuuugcuuaggccaauguuuacaagaguaucuccuagguuuucuucugggguuuuuacaguuuguggucuuacauggaaguauuuaauccaucuugaguuaauuuuuguauauagugagacguagcgguccaguuucauucuucugcauauggucagccaguuuucccagcaccguuauagggugccuguuccccauuguuuauuuuucuugacugugucaaagaucaguuggguguagguguggggcuuuauuuuagaggucucuacucuguuauauuggucuguguaucuauuuuuguaccaguaccaugcuguuucauuaaguagccuuguaguauagcuugaagucagguaaugugaugcuucuggcuuuauucuuuuuuguuuaggauugccuuggcuauucaggcucuuuuugguucuauaugaauuuuagaauaguuuuuuucuaauuauguaaaaaaaaugauguugguaauuugauaagacuaguguugaaucuguagauugcuuugggcaguauagacauuuuaaagguauugauuuuuccaacccucgcucauggaauuauuuucuauuuguuugugucgucugugauuucuuuuaacaguguuuuauaguacucauagauaucuuucaccuccuugauuagauguauuccuagcugguuuuauuuuauuuuauuuuauuuuuuauuuuuuucaauuuuguggcuaccguaaaugggauuguauucuugauuugguuuucaacuugaacguuauucauguauaggaaugcuacugauuuuuguacauugauuucguauccugagucugcugaagugguuuaucaggucuaggagucuuugagcagaaucuuuauauaauuuuacuucugcuuuuccuauuuagaugcuguuuauuuguuucucuugccugauugcucuggcaaggacuuucaguacuauguugaauagcaguggugagaguggacauccuugccuuguucuuaggggaaaugcuuucaacuuuugacuguuccauaugauauuggcuaugaguuuaucauagauggcucuuauuauuuugagguauguuccuucaaugccuaguuuauuaggaguuuuuauuauaaagggauguuagauuuuauugaaugcuuuuuucugguucuauugugaugaucauaugguuuuuguuuuaauucuguuuguguaguuaaucacguacugauuuguauauguugaaccacccuuacaucccagaaauaaagcccacuugaucauggggaauugacuuuuugaugugcugcuggauuuggauuacuaauauuuuuugaggauuuucgcaucuauguucaucuggauguuggccuguaguuuccuuuuuuuguuguaucauugccagauuuagguaucaagaugaugcugcuuucauagaagaaguuagggaggaguuccuccuacuugauuuuugggggauaguuucaguagaauugguacgagcucuuccuuguacggcugguaaaauuuggcugugaaucuaucugguccagggauuuuuugguuaaguuuuucauuacugauuucguuuaauuacucauuauugaucuguucaggauuucuguaaacacacuaaucuugaaugguuuuuuuucuacuuuuccaacugcuccuucuguuucucugugucuucaugucuccuaauguaggugcuccuauuaugucuccuaauguagggugcuccuuuucucccaggcacacaaaaccaagugcuauuugguuuuggcccgcaauguaccuaccuccacauuucuagcucauacuuaacuuccaguugggguauguguguguguaucuguuucucucuccuuuccuuguaguccaauuuaggucuuuauguuuuacaagaaugauuuccauguaauaacuacuuucuucuacuucucaccucccaguggagccucaguugccacaguaaaagagguuaaccuaccuuagcaccuuaaauuccucuauuuaucugaguaguugucuaagaguauucuuuuuaccuuacuaccuuugaauacuguuuuguauucuguuaugaggugguuaguccaguguggccacaauaggugacauaagaaaagcucaggaaaacaaaguuuauuauacucacagguccuagagacaggaggcacagcacaccaugcagggucacauggggaagacaccagaguggugaggaggcagaauauaggagugaguggaagguuuaggccacuaccuuugcuggaguuucuaaaggggaauaguuaggccaucaccuuuuugcaguggcaugaucguagcugguugcagccucgagcuccuaggcucaaaggauccuuccugccucagccucugaguagcuggaauuagaggggaaagcuacccacuggcucuaggccacuacuuuuguugggguuucugugggaaagucaggacagaguaaacaguuuaggauuggcuaauuugaauaauuuuagagggcuuugggaccaccuaggggucgucucuaguugcccaguaccuggcccuaggaugaaggcagaauauugccuguagagucugauugaggaaguauagcucuagauugguuaguuuguguaucaaagacaugcuccugacugggcccuuugcugucuccaagaauugacuaaaccugggaggggcagucucuccccagccagaaagguuuuuaugaugucaaaauaucauaauacauuaaaaauguaagaacauuuuacaauacagagaccaugccuucagcuccuccucccccccaaggcagaaccagggcacuuaaauacuauuaccaguagaccauuguaccagggauacuagacaucaaugucucuguuacuuagugcuuugugacuuauaagaagcuuugauagcauuuuuauggcaacuugaaaguggaaccaguauauagaauuuucacaaacuccaugagaguggaauauuugguucuggaagaccuccuauuaguaguguguuaaucuuuuaagugcuugucucgguuuuucaaaaucucauauucuuuuagucuuguugauuuauuuaauauaucuugagcauguuucucuaauggugaacagucucuuuuuccuccaguuuuauugagguaugauugacaaaauaauauaaugcuguacuaucuuaaaaucuccacaaagggacugauauccugcauagagauagagauaacaacuaaugacaaaacgcaugacuuuaaaauagugaaacuucuacauguggcuuauggaagugacuacuuacuugacuagaaugucucguuguggaaaaaaauaaaaaauaaaggaggugauucuaauuacauuuuauuuucacgcaaguuuucaauuacuugacacaagcaugcauucuuaauuuuacuaacuguauaugucuaaguaguucuguaguuuucuauuuguggaagacuuuaggaaaaaauagaagcgauuuuaugauuuuuagaaagugaaauauucauacauaucuuuuauaauuaucucaaggaaacaaauagggcucugcuucauguucuauaccuaauuauucauucuuauuuaaguaauacaucugccagaaauuaggauguguauauuggcagacguuagcacugucuuacaaacacugcuguaagguucuaacuuugugcucuucugacugguuugcucuggaugugugugcacauguaaguguaaggaugggaagaaugggauguuugagugguaggaaauggaaguguagaaccauauccauggucuagacaauucuuagagauuccuguggccuauuauauuuuauucaguacauaauguucuggcuuuuuaaaauaauaacuggauauaguaauuugaaaacaauguauuauaaucccuuagaaaauauuucuggguguuaggguggcaugucuuuccauaaauuagcccuauucuaauaucagaucacagcagaagugguuaaaaagcucuugcauggcucacgccuguaaucccagcacuuugggaggccgaggcgggcggaucacgaggucaggagaucgagaccaucccggcuauaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagcuccgucucaaaaaaaaaaaaaaaaagcucuugcauaacauuuuuuuuucuuucuuucuuucuuuuuuuuuuuuuugagacaaguuuuagcucuauuacccaggcuggagugcaguggcgugaucucggcucacugcaaccuccaccuccugggcucaagccauucucccucagccucuggaguagcugggacuucaggcgcacaccaccacacaccuggccgauuuuuuauagagacaggguuucaccaugcugcccaagcugaccucgaacucaugagcucaagccaucuacccaccuuggccucccaaagugcuggguuuacaggcauaagccauuacacccagccucgcauaacauuuugaaaaauauaauuacagcagggcccuugcuaaugagauacaugcagcaaucuguuguuuaggauuaaaggaauuaguacagcuauuguuuucuuuaugcuuaucauggagaagguugcuuuuugccaucagauugcuauucauuaaaguguucagaguuaauaauaagucuuucuugcucuuggcaaagucgccagugaauuucuucugucuaagccacauaucaaguaggcugaaaaauagaagagagccucagggugucuuugaacucuguuccugugcuagcugcuccaguugcugcauucacaucugaauuuucacauaccaucuuaugauuguaauuuauuauuuauauuuuuguuucuguuucuuaagcuuuaucaguguuuguguacuugucaugcaguccugcuuuuagaagauaaaccaguuuacuguuuccuuucuuuugaaucccuucuccuuggagguacuuagaaaaguacuuaugcaaaauaggugccugaugaauguugguaacugaaaucuagugcuuuauuucauuuauuucuuuuaauaguugaaauuauuuugcuugcuuucuaggcacacaaaccaauggucuggacuuucagaagcagccugugccuguaggaggagcaaucucaacagcccaggcgcaggcuuuccuuggacaucuccaucagguaggaauguucugcucaaccaucagugagagugaaagauagaggcguaaaguacuggggccugaggaaguuauuucagaaugugggaccuuuuaaauuauuuaaagccuagugcuaauuguguaauugugucauucuauuugguuaguaugaaauccuaugguuuaguugaguguauagucauugaccccacaggugugugggaaacaaaagaauuccuuguugugaauggaauguguauaacaacugguuuauuguuuuuauaaguggguaucugugguggcuaucugaugguagcaaauuaucaaaaucauccagaaagauguagcuaccauugccugagaccugcuguguaaggcucugagcuccaagcucauuucuguccucuaaaacaguuccagaccaugacaguugauuugggcaacuacucagaggcuuuugcuugacugugacccccgcacccuaguuugagguucaaaagacucugccucaacuuuauuacccuaugucacaacauuuuuuucccugggucuaaaacagaccaugaauucuguucauucaugcuuuagcuauaauguagagggaaugggaauaaaaaaacaaacacuggcuacucaauaguuuuggaauauggaagcugguugaaaauggaaaacagugaaaacaguugggagcuagauuaucagagugucucaaccucuugacuuauguucacaauuauauauuagaccaauauuuugguggucuauauguguugauaguaauggugcuagugauggugccuaaugaugguagugguagugauucagugaaaaacccauauguacauaagacagguuacauauuaauauacugaguuacugagcacugaauauauacaucuuacuaaagucuuuucaucaaaauaugucaucagaccaccuaaacuauaaaagaaauucuucuacuugaaaacagguaaaauccuggaagcuguucuaaagcccauuuauuuguucacagacucaaauggauaucauguaggcagcaguuauuaucuguuacagugaggccuaauggaacacuuuugcucaggcacauagcuucguuuauaucuuugaaauggaaaaacuuugacauuaacuuccagauaaaauauuaaaaugaauuaacaucuaaaaugaauuuuaaaauauauuuuaaauauauccuagaagaaaaaaauguuuucauguugauuuuuuuucuaagaacauauucaagccuccaguaauuuuucuggguuccuaagaggaauagcauuuuugacagaauuuagucaauuauuugucaccuaguaagcaucuuuaucuggcuuaaauaugugaugguccaaauguauuaaaaaaucacugagggugcacagaugaugugcaguuuucucugcaggauccuucuggauccaaauuccaagaugauugcaacucucccuguaccagcuccaagaccucuagaucuagccacugauuaccaaaaucacagacccuucaauaccacccagaccaaaggacugcaaacaaaagaauuuuauuugaaauugcgacaccauugaaucucccaucaagacacaaguccuugcaucugauuagcuacauaauuaacagugugacacuugccuucuauuuccaagccccuuauugacagaauuagcaccuugaaccuuuccuuaccauaauuauaauauacauacacaaaaucgauggcuuuaggucuguugccccauuaacuauaaguuccaugaaaauggaaaccuuuuguuguuuaccugugucccagcauuuaccaaagaaccccauaauacaauagguguucaguaauuauuuguugaauaaagucauagaugacuaaauggucaaguaugagacuacugaggaagaaaugauuagcuuacccuguacaaucuaagacauuucucucagggugauuuuugagcugagucuugagggguguuggaaacuagcuaaauggaguugguaaaggaaugcucucuucuuuuuauuuuuaacuuccuauuuuaaaaaaacuuucaaauuuguaagaguuacaacaauagaacaguguucaucugaaagcccuucaccuagaaucaccaguuguuacuauuuuaccauauuugcuuuauaccauauguguauauguauguauguacacauacaaaauacauuuugcuuuuaccauauguguauauguauguauguacacguacaaauuuuuuuuuuuugaaaugaggucuuauuauguugcccagguugaucugcaacuccugagcucaagggaucuucuugccuugcaucuaacugugauuauaggcguacaccauggcaccgagccaaaaaaaauuguuuuuugcuaaccccuuugaaaguugcagacauuauaaccauuuacuucuaaauacuucagcauguuuuuccuaaaaacagcauucucuuauaaaacugcagugcaaauuucaaauuccagaaauuuaacauugauacgauaucauuuuccaauauuggcccauauuuauauacuuccugcccacaauccaguccauacuuugcguuuagcugucaugucuguuaagucuucuucaauccagaacaauuccucagcaugucuuugucuuucaugauauuggcauuuuugaagaauagaggccagcuguuugauagaaugcccauuuaacuugaauaugauuguucccucaacggcugaacccaaguuaugcauuuuugaaaggaauacagcagaaaugaugcugagucccucucggugcauucagaagccguaucauauugcuuugucccauuauugugauauuaaguuugauuauuuuauuaagguaguguuuauuagauuuguccacuguaaauaugucuuuuugccuccugguaaguaauacucugugaggcaguacuuuaaagacuguguaaauaucccauuccucaacagacuuuuacccugaaacguaauaaguaaaaaucacauaaaauuuuuaucuucuucaaaucuuuguaccugaaguucuuuccuugggcucuuugacuucuuagccuuuaggccuuaaacauauuaucuguucagauaggccucuccugauuacacuguauuuuaaauguguucuacauaugucuucagauuuugguuuuuuguuuuuguguuugaggguucucaucuacuaacaggacuagcaguuucaaauaaaggacauaguagucaauucauuuuagcucuuaacucuucacugagcuccauaccaacauuuauauuuaaucucaggacaucuugaugcuaucugguguauacaaaauggaacucauuaucuucucugucccuguuagugguacuaccauuuuccaguugcccagauuugaacccuggaauaaugcaugacucucuuuuuuuaaucuaaauccagucaggauccuuauguagugcauugcagagacuuucauguuuccuacuuuuuauucccacugccaccauucuaguuuaguuuuccauuuauucuagccuaguuuauagucucuuucucccuccucagucuuucuuuguuucaggacauugacuguuuugaacaguguacacugguuauuuuguaguguuucucaguuuggguuugucugauuuucaucaugauuagauucagauucuacacuuuuguuagggaugcagcauaagcaaugcuguauuccucucagugcaucuuagcagaaggccugugucuccuuccuggugacucuuguuugugcucacuugauuauuugucugccagguuucuccacugaaaagauacuauuuuacccuuugugaguaucaaguaucauuggagacauagcugagaauauguaaauauccuguuacuccucagauuucucacccauuaguuauccauugaugacucugccuaaaucauaguuauuaucauaguugccaaaugauggucuuaauuccauguguauccuuauuuucacauaaccaugauuugaacuuucugaauguaugaaauguauuaaauguuuugacagacuuuuaugugugguuuauaggguagauuuucuauuucagcuaagaguuuuaaguuaugauuauaaauguuuuaaggacuuggcuguguggguguguaaauauauuucuacucugguguauacauggaacauucaaaauuaaaauaaguagaugguucugauuguuucuaauaauaaagaauguauauagauagcuuauauguucuuuaacacaauguggaagguuaauuaaauuuuuagaaucuuaagcauucugugaauacaaacaauguuauguaaggagcauucaauacaaguguggcauggcugauaauguucauuuagugugggaaaacaucuucaaaaaaagauuaacagcauuuuucugugggacccguuggggugggguaggguggguugagaagggacugagcuuguucauaaaguuuuaacuccguaagacaaacuucuuugucuucucaguucuagcucggugacacauaguagacuuuauuuagugaugacaaccccuugugaugaaugucaacaguauuaaacuagaacuuccccugauuacuuauagguccaacucgcuggaacaaguuuacaggcugcugcucagucuuuaaauguacagguaagcugggaccugggauuaugggucaaucuuuuauuuauuuuuucuuauauuuuucuguagugagcauauauuuuauaauaggaaaugcuuagaaguauuaccuuuucaaaauuagugaaucucgugaagauucaaauaaugauaauuauuaccauuaaugaaaaucaguuuuauauuaugcuacugugcaugaaccaaaaauggacaggaaaagucuacuuucaaaguuguauguguaaguucaguaaaaauguuucuaaguuauacugcuauaacacauaccuaaacacacagccugaaaguucucuuaaaugccaguuuguuuccaaaagacuuguuauuuaucauuuuugaugucuuagggagaccuuauagggaagaggaaagaacacuggacugagacacaagggucuuagguuugcauucucauucugccacugacuagcugugugaccuuuggcaagucacauaaccuccuuggguucaguuuuucucaucuguacuuaaguggggacauuuauaagauugccaggguuccucuccauccuaaaauguuaggcuucuaauaauuguaauuaaaccuguuuguagauguugguggauagacaaucaaaaucuuaaaacuuaaaucuggccacuuuccuucuuugaaccauauggcacaacaugcaaaguucaaguguuagacauugcccucuuaauauuucuaucaaccugcugguuccuuucauuauaguguuuagguaacuagcagucaagagggaaagacaguauuauggaagauugauuucaguguugcuaaugacuaaagaccuuggguugagcauuucaugaaacccaguugaauauggaccuaguaacacguaggaacaaggagagaaaagaaaaagagauaaugugaccuuacuuucugagggagaggaggcggaaaauugccuugguugccaugguaaacuuucaucccuuagagagauguuggcaaacaggcuguaucuccagugcagaauguuuacaguccugcacuguaauuaucucucaaugacuggcagaauuaaucagagcauuuauguuaauuagccuugcugcaguccccaaaacagguggugagaaauaugcaaaucuaugcagaauuuuaaugcuuugcauaaccaguuuuaauuaccguaaaauuuucucuucgugccccucucucuugacugcagcauuuucucucugagcuuguguguuaguugaugggaguugcuagauuuaccguucuguaaaauauuagguggaaaguucuguggaucaagugaucauucucugagaugguauauggagaaguuucagacugaccaccagguguauguuaaaauauugguuuggaaggucuaauguagaggugaauugaaaauauauucuucccuuuacccccuauuucuagaguugaggaauugggggcuaugaaaaaaaucuauaaauuugugggggaugacuuuauuuuuaaaaauuguaauagcagcuuugcuggcauuagaauuaacaaguuuaaaaacuugguaugugaaacuaggaaaauacaaauaaaagaaaggagguaaaccagaacucaugacugaauaagcucauguuuuaaaugauuccuaaaagaugggguuuuaaguacauuucuuuuaaucaaccauuugcaaucuuuuauuuccuacccaccccaccucagucuaaaucuaaugaagaaucgggggauucgcagcagccaagccagccuucccagcagccuucagugcaggcagccauuccccagacccagcuuaugcuagcuggaggacagauaacugggguaaguguucacugagagaauuauaacaaacuuuuucugugucagaacugccauuggccaauagcugauuagaauuguucaccauagcugguaguaacauggcuaugccuggcacuauugugucuuuaaggaacuuccuacacuguagguaguaaguugcucugaaaaaggaauuaucuuugucguaaguuuucaggauaucuuuuauuagaauuguggaugcucuggauaaauuaaaaaccuuauuaaaccccuguuucagguguugcuucaucaugcaauggaguaauuaucauaugguugagaucauuacacugaaaauggcaguuauccauuuggcauuaagacaucacugcaggguagaaguuaaagaauggauuaguaccugcaaaagaaaaacauuuuucuuuaaguuacuguguaaugaucuaaaauaaagcauguggcuucauauccuagcucugcaacuuaccguauggccuaauuacuucauuucccucuaccuguuuuccuucuguuaaauggagauacuaauaauaccuaucucacauuacuguuguaaagauuggagauaauacauguaaaacuuauagaacggugcuuggcauguagcauucaacaaauauuguuuauuuuuguacuugaucuuagccaaaaggcugagacguucugucauuuauuuuuuaugguuaauaaauuggccuguuuggcuauauuaagcuuuuaaguuuucagcugucuuuucucuaaggcaccauucaaaauauuuuuccaauguugaaaauuuguguauuaaauuaucuuuguggggguugguuuagggcaaugguaaggaauaguuuuuauucaauucacaucacauuaacucccaagaauuuccuaggguuuuuuguuuucuuucuuucuuucuuucuuuuuuucccaguuaaguguguuuugucaguggacaacuguuuuaagaacuguugcaaaauuguucacaaaaucccaugaguagagauguauguauauauauauuauguaaaaauuaaaaauauaucuauacuuuauauacacacauaucccuugaaggguauugaguuuuugaaugguuugguuuugagccuuauguuucuaaugcacaaauuguguuugauucuuuuagaggagguuguggcacuaagugacuguacauauacuucagaaaauuaugguuccaucuuguuugaucaaucagaacuugucaccaaaagaaaaguagaacacauuuacuacuuuaaguguguuugaaauaaguugcauuaugaaaacaacuuuaaauaugcucuaaauacauuuccuacuuuacuauuugggucuuguuuuuggugacuagugucuacaauaguaagagggaguugggauucuagguuccuuuggcuggagcuucuguuaaaccugggcauuaggguucauuugcauguaaagagaacggcuaucaccaccuguuucauagagauaauguguuggaaaggagauguaaaguugcagagacucagugcuuucaauaacagaaaagauuguguuagggaggggccuguagggagacuuggaaaagaaacaaauggagcucauauucuuuagucauaucuuuggacuuaauggaaaugauggaauauggcagggauucaugcuaaugggaagcagcugggccuuaucaguucuuuccuugguuauauccagcauccuuguuccucauucaucugacuaaucacuugcuguuugguuguguguaaauguauuuucauaucuugucaguggugauucuuuuuuuuuuuucuugcuuacuaguuaauuacuuuuuugcccaaacccuagggcccuggacaagcuugaaugauuaaguccauaguggggaccaccauuuuaauuuaaauguucugcuaguaaugguaguuugaucacugaugaacauuuuagcugucugcuaagcaagugaaguuggguagcuggggacugauaucauuugaguuaccuauuuuaaagcaguuggcuugcauuaggagacuuucuccuucaacacuuucccauaauguguucugguuuuguuuagcuuacuuugacgccugcccagcaacaguuacuacuccagcaggcacaggcacaggcacagcugcuggcugcugcagugcagcagcacuccgccagccagcagcacagugcugcuggagccaccaucuccgccucugcugccacgcccaugacgcagaucccccugucucagcccauacagaucgcacaggugagugaggaacuccaauagcuggggcagcaagugaggaauaaaguggcagguuuuauuuaauguuagauuaacuuuuugauuguuaguguggggccuuaacugccugaggagcucuagaucagugagguaagcgguacccuuccuuaccacugaauuagaaauaauguuuguuugcuuauuguaguugauauuguaaacauauagcugauuauuugaauaacugacuuuauauuaagugacaauucuugaauaauuagcuggcauauuuuugaagcaggggauuacuguauuuauuuuaauuagcuaauuacagcagacauggauuuuuuuucaugugcucugcggugaauguugccacccaugugugagacagugagucaucucugcuauggagugauuaacauuauugcauuagaauguuguuugguuucaauuuucacauuuuagggcaaaguaucuagagauaauaaaaauuuauuuaagaagcgccaggcgcgguggcucacgccuguaaucccagcacuuugggaggccgaggcgggcggaucacuaggucaggaguucgagaccauacuggcuaacacggugaaaccccaucucuacuaaaaauacaaaaaauuagccaggugugguggcaggugccuguaaucccagcuacgcgggagguugaggcaggagaauagcgugaacccaggagguggagcuugcagugagccgagaucgcgccacuaaaaaaaaaaaaaauuaagaagcauacacaauaguaccaaggaggaaaauaaauaaaaucuuuaaucucaagaagaggaaaaagguauaaguagauauaucaguaaaauauaugaagaguuauuaugagucuaauuguuagacagcugucuuuauccgucucagaaaagacucagaaauggacuuaacuuguagcaagaguuugacuaaccauuuaaaaagaacuaauuaacuguaagaguagagaauaaauaucagacuagucuuuauacaaucuuuaucaagauaauguuuugauuuuggccacuuucucaucaccaaauaaauguuuuuagugccuaagcugugagacccuauauuaacauuagucuaaauaagauaacguucaugaaaacacuuugaaaauuauaaaacaguaggccaauguaaggugcuauuguuguuagggauuaaauuuuuauauggauagcuauuuuugguuuuaaaaaauugaauacuuuagaacauguggaaaagggcaaaaaaauugaauacugauuuuucaguugaguuagauaagcuguugucaaaugucauaagucauuauaggcccuuuauugauggaaauucagacauaacacgaucaauuuuuauuuaagagaaagaucaaucaaauauuuaaaaacuguuuucucacuugauuuuuaaaacccauauuggucuuuacaugauaaaaaacagaaguauauuuguucugagggaauuuuaaagaaacauugaaaauuaggcuuaucauaacaauauaugucaguccacaaaaauagucaguugcagaggcuccagguugcuucacgugcuuugucaagcacacacagagcauacccuguuuggaauaugaaagcaugcgaaguauuuacucuucuuuauuuggaugugacagaagucaucagcuggaagccuuauaauuaagcgaacuuuuauuucagaaucuccaauccauguuuuaauuccaauuuuucaggaucuucaacaacugcaacagcuucaacagcagaaucucaaccugcaacaguuuguguuggugcauccaaccaccaauuugcagccagcgcaguuuaucaucucacagacgccccagggccagcagggugagcuccuccuuagagcuuauuagugguauaccaaggcuguucgcugaauguuacacaugcaugaacuacuaucauuuuggcccugaaacuauuagaccaauguuuuuauuaaauuuuauuugauuauaaacuuucguuuaaaaaaaguuuuguuuuguuuuuugucauaaauaccacauuauugaagguugcccugaacugccauucaucugcuuaaucacuaaggaagaaccaagaguuuggccaaaagucuaagugaaauuauucaacaugccaaacauaaauuggauaaguugcugcuaguguuuugauuguuuuucauggaaguguauucaaagaauauagacugaguguugaaaguaugugcuucuaaccauuguuuuuuuaauuuaaggagggaagacugcuauaauagaaacuacaaauuucgugaguuauaaaaaacaucuuugagucauuugagugguaaauguuauauaauuaauauaucaaacaaccacucgucuguaaggucaguuaauguaaucagggugaagaaugucagaguaucaaggcuucaacccaaggaacauuagugcaucacuaaugauucuuuauuauuucugaguggguuuuuuugccuuuuuucuucuugaucauucauuccaaaaucuuuugucaugaaauaauuauucuagcauauauucaagauucagagauaaguaauucaguauuuacuugcagagggcucacaauuuaguggcagggaaacagaccuaaauuauguuagauuugauaugcacacaaugcuaugggaaccaagcaaagagaccccuguaacuuugugcucagauaagucuucacagugaauuugggaaaauacauucauaggcuuacaaaagagagaaugucagucuuggaaaaugaacagcauuugcaaaccuuagaaacauggaagaaaaaucaauaagcuguguuugagaacuauaaguagugccuuacaacugcagaauaaguuugcauaugcagguaauagugaaauuugaacccagaaagauuagcagagaccagaucauuaaagaaccuuagauuaaguuuccaggaguuugaccuuaaauccuauagcuuagugcuuccuaagauuugauuuauuuaagagucauuaauggccaggcgugguggcugacgccuguaaucccagcacuuugugaggccgaggcaggcagaucacgaggucaggagaucgagaccauccuagcuaacacagugaaaccccaucucuacuaaaaauacaaaaaaaauagccaggcgugguggcaggcgccuguagucccagcuacucaggaggcugaggcaggagaauggugugaacugggaaggcagagcuugcagugagccaagauugaaccacugcacuccagccugggugacagagugagacuccgucuaaaaaauaaaaaaauuaaaaaaucacuugaggaauuagaaaaguuuccugagcccuaaccccaaccucccaauuacuuuuuuucuuauuuuuaaacuauuagguucaggguuacacucagguuuguuauguagauaaacuacaugucauagggauuugauguacagauaauuucaucacccagguaauaggcauaauaccugauagguaguuuuuucgauucucauccuccucccacccucuacccucaaguaggcccugguggcuguuguucccuucuuuguguacauauguacugaaaguuuuauggcuguauaguauuccguuguguauaugcaccacauuuuuuuuaauccagucuaguguugauggauauuuagguugauuccaugucuuugcuauugugaauagugcugcaauuaacauacgcauggguaugugucuuuauggcagaaaaauuuauauucuuuuggguauauacccaauaaugggauugcuguaucaaauggcaauucuaaguucuuugagaaaucgccaaacugcuuuccgcaauggcuuaacuaauuuacauucccaccagcaguguauaaguguucccuuuucuccacaaccucgccagcaucuguuauuuuuugaguuuuuuuguucuuuguuuuuugggauuuuaagagauggaguuucacucuuguugcccaggcuggagugcaauggcacgaucucggcccaccgcaaccuccgccucccagguucaagcaauucuccugccucggccucccaaguagcugggauuacaggcaugcgccaccaugcccagcuaauuuuuuuuuuuuuuuuuuuuugagacauaguuucacucuuguugcccaggcuggagugcagcagcacaauuucagcucacugcaaccucuaccuccuguguucaagcgauucuccugucucagccuccugaguagcugggauuauaggcgcccgccacuaugcugggcuaauuuuugguuuuuaguagagaugagguuucacuauguuggccaggcuggucucaaacuccugaucucgggugauccgcccaccucggccucccagagugcugggauuacaggcguuagccacugcaucaggccuuuuuguuuuuuuguguuuuuuugagauggaauaaauaggaaauggauucacaggcuccucguucuugcucuauuuguuuguuuguuuuugagauggaguuaaauggcaugaucuuggcucacugcaaccucugccucgcgaguucaagcgauuauccugacucagccucccaaggagcugggauuacaggcaugcgccaccacacccagcuaauuuugacuuuuuuuuuuuuuuugagacagagucuugcucugucacccaggcuggagugcaguggcacaaucauggcucacugcagucccagccucuugggaucaagcaguccucccaccuuagccuucaaagcagcugggaguacaguguguacuaccucaccuggcuaauugagaaaaaaaaaaaaguuuuuuauagagacaugucuugcugugguugcgcaggcuggucuugaacuccuggguucaagcgauccucuugcaucagccucccaaagugcugggauuauaggcaugagccacuguaucuggacucacuuagaggagucuaaugugaauggcccaauaucuuccaauaagaaagucuucugucaacucuacuaaaccacagauuuaaucagaaaaguggcauuuccaaguuuuuauuuaauaaaguucauguugaaacuuggguagggaaaauugguaaauaaguagguagauggacaggaccugguggccaguuauauuugauuaaugauaggaaagaaguaucuagguauaaugccuggguuuuuaggaaacuacgaggguugauagggucagagaaaauauauauguaguguuagaagaaccuuggugaaaccaaccuuuuagguguaaaggauuaaguagauucaaaagauacugcauuuucagaagucaaaaacuaguggagagugguaaucgcaauggaagaaaaugccaagagggaaggagaaagugaccuagaucagaaagacuuaggaaggucaaugcaaaguguguuuauuagauuuguuaauugccaaagccuuaagauagaaugagauugccuucauucacuuucagcaaagccaagggcguugucuuucccuuuucauaucugggaccucauuuuauuucaauuuuauuugucucaaaucaagauaguaggaauaaugaauuacuguucauucugauuuuuugguacuugcaaaaguauguguauguuuuuaaacacucccccaacuuccagacuuuuauaagauugggaaaauagcacagauaauguaauacugauuggccuuagagccagugacccuggacaacucaccuaaccuuucugaguuucccauauuucccuuuuuaucuuccccuucacuuacaugggugaauuacaaaaaaaguuuuacuacccuaacaucaggaaggucauuauaauguaguagcaaagagcauagacucuaaagccaaacugucucuuugugaaucuuggcucugccacuuaccuguguguccuggggaaaguuaacuuuaugggccccuguuuccucaacugugauauuaggauacuuucaguguucaccucuaagaguuguagggagucaacgaguaaacacauguaaggcaccuuuuagaaagcugccuccuacauaguaaccuuucuaaaucuuugcugcuguuaccauuaugacauuaucaugauaccaguaucauccucagucaacaaacgauagauaacucagagaaugaaaagguuguuccuuuauauaguuucccuagaaucaccuuguaccacugcugcugaguugcaaucauucguuagucguaugugaccuagauuccauuuucuaagauuauucaacaauguagaggaucagcguaguggaaauacgucuauaaacauuucuaagaauugaauucauuguaauuaauagcaucagagaagcugaaaauccaaagagcuaaucucuuaacuucaugauggaggacaaagauuuuaucuuuuggaauuuuaauaauguuuccagcaugagauuagccuucaauauugauuucuggaauucuguuuucccuuguuuuucauugauuaaccuaaaacuuuugagauguaguucauauuuuugguaauauugcuaugauuauauaacuguaacugucuagaauuuaauuucuagcaagggaaauuuaagccuuuuccucagaauuauuuuucaugggaaaauucuuacugauagauuacuggacuugagucauaauuuauugguuaucuuauucugcccuaucuacucucagcacuaauuauaaaaauaaucaaagaaauguuuuugguuagaaaacuguuguucauuugaguuuuguuuggguuuucauuguuuagguaagggaaaguggcaagcguuuuuuuuuuguuguuguuuuugagauggagucuugcucugucgcccaggcuggagugcaguggugugaucuuggcucacugcaaccuccgucucccagguuagaaggauucuucugccucagccuccugaguagcugggacuacaggcgcaugccaccacgccuggcuaauuuuuuuguauuuuuaguagagacuggguuucaccguguuagccaggauggucucgauuuccugaccucaugauccacaugccucggccucccaaagugcugggauuacaggcgugagccauggcgccuggccaagcauugguuuuuuaaaaaguucuaaaccucuaugggcccuuucagccuuuucagcugaccuuguuuggggguaaaaccuaagguuugaauuuguuuacuuaucugcuuuugucucuuacagauuaaacuaacuuucauuguuaaacuuuaaagaaacuccuauguugaaauagccuauguuuaauggaacuucauuucugaccuuugugcucucuucucuuuuuuuuuuuuuuuuuuuuuuuuugagacagagucuuguuuuuucacccaggcuggaguacaguggcgcagucuugucuuaacacaaccucugccuccuggguucaagcaauucucuugccucgccucccgaguagcugggauuauaggugugugccaccacacccgguuaauuuuuguauuuuuaguagagaugggguuucaccauguuggccaggcuggucuugaacuccugaccucaagugaucugccugccucggccucccaaagugcugggauuacacacaugagccaccgcgccuggcccucucuuuuuuuauuauuguuuuugaauauucuuuagucuuuucaaaacaauuuuauuuaauuaguuuuaauaguuaacauaguuuuguuccucuagacuacccuucaguauuuuucaaaccaguaaaguuugauauuuuaauuaauucacucaaaaauuaguugagugccugcugugucauauagugcucugauaguuagggauguauuuugaacaagaugcaggcccugcccucauuaagagacgucaaauaguaaacauguaaacaaaugguuuagauaccaauaaguacuagucagguagcggaucauaguaaucugguaaugguuaaccuaaagaagaaugggcccauggucuggaaaagucucucuggagaagcaauauuugaauugggaacuggugaggaaggaugagggagagguuaccacaccuagaaucugaagacaagagucuuguaggcaaaggaaugugaaacaccugagaugggaacagcuugaccugauccaggaaaagaaaagccaaaguagcuggaguucagugagucaaaggaagugguagaaguugagauacgauagcuagacagggccagauaccuagggcugcauagauuuuguucuaauucuaauauaaggccaugacagcauuuuaauugggaaauaauaagauuauaaagaucacccuaacuauuauauggagauugaacuauagggagacacuuggggaaggaggauggucauuuaaacuuccauaaaccugccuuuuaagaaauguuuguaguaauauaugcugaauuuuauuuaaucauauuugcuucaauauauauuucacuugucccagaucagcaaaagucaggguucuuuagaaaaauucaaaucuauuuaauauauuuaucuuauuugugaccuacauuaugaaauaaauauuaguaucuuuugauagcuuaaauuuaggcagugcuuaguuacuuauaaauaagugauaaauucuauggcuaaucucuggcaggcuuaaguguucuggcuguuguccuacauauuacaacauuuaauauauccaaauuuaguaaccuaaugaaaucauaauuaggaagcuauugccucagauaaucuuaucacauauucaaaagaaaaugguaaaaucccuuuuguuuggugugcuuugucgaauacuuucuaccauugcucuuaucacagcaaacauaaucuuguauuuaguauuuuagcaacagcauuuuaucugaaacucuuuacuuaaacucuuuacucuguauuuaagauuaaauccuuaaauacagacauucuggguugguccugucuaucaguuucugaaaauaaaaagccauguauucaaguaauugagcaucuucuacaaacaaagaguuuguauuucuacuuugaaugucaguuugucaucaugaagcauugguggcauuacauuaucaauuauuugaaacuaagacaguucaguguucaugcagauauuaauagaauauuuuacauuucaacuuuauuaucaccaacaggcaaauguuugauaaagagaacuugaaaaugcuucuuuuccucugguccaacauacgcuggcaguuucuaauggauucuagguuaagaaguugagcucuuuuuggaauuuccagcuguuucuauuuagaauaguuuuuuaacuuucaucccauucuuuccuaaaauaaaggauugaccuaucacagagcuuauucagauuaugccaaagacauaucaguuuuaauuuaauguuguauaucuucucuuccaaguuguaaaacaagauugaauguaaggcaaauaagauaaauaagaguuuugauaccaguaagacuaccagagaucaacuggaaauuuucagcucauuuucugauucuuucuuucuuuugccauguguucgaagaaaucuuuaauguuucuggauaacauguuuuucuucuacaggucuccugcaagcgcaaaaucuucuaacgcaacuaccucagcaaagccaagccaaccuccuacagucgcagccaagcaucacccucaccucccaggucaguuuucuucuaugggggcugcuuucucuuaucauauuguuuggggagacuuuuggacuuuauuuaauuuuuuuuuuaaaucuaauaaaaauaauucggucuucgaaaacugaccagaaaaucaaagcuaggcuuaucagcucaaugcuaccaaaucaauauagucuuugaaaaucuucagaguuccuguuucuuauauguucuuaaagaauaacugcauuagcaguaaaugaguaaugaguucuagcuaugugacaucuccccucaccauacuuggcgguagauauuaccacuuaaacuggaaaccuagugagccucaguuaaaaauccauuguuacccuuuacccuuucucagaaacugcuaagagauuuugaucucuauauuuucuuuuuucucaaugcuuuuauggugcuuuagcucauuucuacuagaccauauaaacacuauaauuauauuaaaaaaauuuagacauauaaagguuuaaauuauagaccugauuccacuucuuaucuagcuguugcuuugaacaugucauuuuaucucucuggaccucagucuucucaucuauaaauuaggugacugaacuggcugauccugaaucuccuuccagcucugacuuucuuugucugcaguauggaaguuaucacuuaauacuaacacauuaccagauuugacagaauucagcauccauuuaugauaagaacucuugcaaacuagauauagaagguaacuuucuuaaccugguaaagagcauguauuaagaaaaaaaaaagaaaagaaaaaaaccaacaucauacuucacgaaaaacugaauacuuucccccuaagaucagaaacaaggcaaagugaccaguugccacuuuuauuccacauuauacucaaggugccaguaaugcaauaagacaauaaaauaaaauauuaauaaaugacauacagauuagaaaggaagaaguaaaacuaucuuaguugcuagaugacaugauugucuauguagaaaaucuuaaggaaucuaccaaaaaaagcuacuggaauaagugagcuuagcaaguaugauacaaacucaauauauaaaaaucauuuacauuucuauacacuagcagugagcauuuggaaauugaaauuaagaaaaagaaauuuacaguacuuagggguaaacaacaaaauauuuguaaggccuauacaaauaguucuauaguugaaaacuauagaacauugcugcauaaaauuaaagaccuauaaaauagaaagaaguaauauguucaugaaucagaagacuuaaguuaaauguuaaaaugucaguuuuucccaaauugaccucuagauucaacagucucaaccaauaccuagcaggcuuuuuuguagaaauuugcauacuguuucuaacauuuauauagaacuguagaaaacacagaauaaccaaacgauuuugagaagaaaauugaaggacuacugaugucaagaauaauuauaaaacucaaguaaugaagacaguguaauacuggcauauggauagaaauagagaucaguggaacagaauagaagguccaguagauccacauguauauggccaacugauuugccaaaggugccaaaggauuucaaugggaaaaaaaaagucauucaaaaaaugcagcugaaacaauagggaaaaaaaauaaaaaaccuugacuauuauuucacaccauguacaaagauuuguuugaugggucauagaccuaaacuuagagaaaaaagcuuggaaaaaaaucuuuguguccuuggguuaggcaaggauuucuuaaauaggacacaaaaagcaccauaaaauaauggauaaauuuaauuucauaaaaaucaaaagcuucucucaagugaaugaaaagaaaaccacagauggggagaaaauauuuaugaaacauaucugauaaaacauuuguguucagaaugucuaaagaacucauucaaguuaauaauaagacaaucugauuuaaaggaaugggcagcaaaaaaauuggagauacgucaccaaagaugauauguaaauguccagcaggcauaugaaaagaugcucaaaaaccguuagugaucaggaaaauuuaaaugaaauaucacuacacagucacuagaauaagcaaaauuuaaaaggcuaugacaaaaccaaguguuggcaagaagguaaagcgacuagaguucucauacauugcuuagugguguugcaaaaugguauacacacuuuggaaauuauuuuggcaguuucuuuuugggggggugagggggaggcaaggucuugcucugucacccaggcuggagugcaguggcacaaucacagcccacucuagcagccugaccucccaagcucaagcaauccucccgcaucagccuccugaguagcugggacuacaggcgugcaucaccaugcccagcuauuuuuuguagagaugggguuucgccauguugccuaggcuggucuugaaccccugggcucaagcaaucugcgugucuuggccucccaaaguguugagaugacaggcgugagccaccgcaccaggcuggcaguuucuuauaaaauuaaaugugcauguaccuugugacccagcaguucugucccuagaaaugaaagcauacguccacacaaagacuuguaugugaauguuucuagcagcuuuauucaccucaaacuggaaacaaccuaaauauacaucagcuggugacuagguaacauaagcuuuagcauauccauaugauggaaugcuacuuugcaguaaaaagaaacgugcuucugauacaugcaucuccugugaaucucaaaagcauuauacuacaugaaagaagacauaaaagacugcauacaguaugauucaaugcacauggcauuuuagaaaagacaaaacuaagguacauaaaacauauuagugguugccagggacggggggcuaaugguggggauuaacugcaaagggaacaagggaacuuuugggagugaugagaauguucuguaucuacuacuaucuguaguaacugcuacugcaauuaguagcaguuguaugacuguaguugcugaaacauauacuuugcccuuuuaaauggugaauuugugaauaugcugaaugcaagagugagguugggauuuugaaaaaagccuauaccagagacuucuuccuggccuccguucucugcauaugguggcagggccguuguggcuucauccugacuccugcucacugaauucuacucugccauuucuagaucuggcccaguccagccugagguuucuggagcugggguaacuuaucuguaaccaccccaucuaaagguacccaagcgauuuuuaguccuuuauuauuugagaauggggcuacuucaggcccggagaugaaguaacaaugugauaguuaagacucaccuguaacugucaaccaguuucgcugugagaaauguacagcuacauaggggucugcuaugguuggugcucguuuuggcuccuccaaaauggucagguugaaaauuacgcagugucagcaugacauagaaaugaacuuuguuauugucauugaaacaggauaagagaggaacuuaacuccaguugucgccuguguaaugcuuauucuguaguuuucugggacaguuaguuccuuuggaggaagccuugacucauaagguaaaggucaggcuuauauaacucaucuaaauuugaagaagaaaaauucacagccacagacuuuaucuguaauucugguuuauaaucgcucaccugggcuacucuucacaggaggagucaacugagcaacuaagaugcagucaggcagugccucccacuagugagguguguuccacucagggcuugugaauagaacagaauaaccuuaaguuugugugauaagaaaguagaguauuuuauuuuuaaaaagagacuauacccucaugucccaaaauaaacuauacauggauuuaaauaaucaaauauucaacaaagaagaagcuagcagauuaaaaggaauuuuaucaauguuagaaauaagugaagcuuucucagauuugaaguaacaggauauauuagaaaggaaaauuaaaagcucacccaaaugacaauuuaaagguuuauguacccugaaaaauaaaaggaagaaagcaaauuggaaaagcauuugcauuaauaugacaaagcuuccuuuauaaaauuugaggaucucucuaaggauaaggaugagaauaaauaucauuaauauauaaauugguuaaggacguaaauccaauucacauucaaagaaauacagauaauaauugacacaugggaaaauuuugacauugaguaguaagagaaauacaaauuaaagcagcagggaacuaccauuuacuucuugaauuagcaaaacauuuuuuaaaacugcuaacguaagucauguggaagaguguugcauagugggaaccaacguuaugauauguaucaaaaaccaugaaauuguuuaucuaguuaccagaaaagcccuugagaauuuaucucaaaagaacuaauuacacacauagguggaaaaaauaacuaauaugcauaaaguuuuucauuguguuaucuauguuagugaaaacauaaaaacugucuagcaauuaagaacugguuaaguaaauuaugagaauauugccuuaguuuuuaaaaaggauaacuaugaaaacugaaauacuccugauuucaguaguccaagcuaucaaagaguaagucagugguagugcuuaaaacaaauaaaaaugcuauauauccagacaacuauuuaaaccauuaaauauauucacucuucuuuaaaaguccucgguuagcugacaaauuccagaaaauuaauuuggauuuugguuaauuugggguuuucaucuucuauagauucuugcucgauuaacugguguuagcauaggcuuagagaguaugugugccugugcuugcaugccugucuccaucacccucucucuuccaaaaaguuauuuuuauuuuuaauuuuuauuaauuuuuauuuuuuagagacagugucuugcucuguuaaaacaacguuaaauaagaaaagcagagaguaaaauuuuguauaccauaauuacagugaagguuuaaagauauagguccuuggggaaaaaacuggaacagauauacaaaagcgaaaccuguuauaagcuauuuaaacugcaggugguuuacuuuucccccuuaaugauuuugaauuaugaucuugaauacuguuuuuauaauacugugucacagguuggagauguaauagugguaaacaagacagauaugcugucuacuguuuugacaguugaagugcuagacuuaugaaauagauuuuuugaaauaaagaguaauuuauuaaaagacauaagauauauguauucagaccauuugaaaacccaguuauaauagguuucauuuuuguguauucauuucauuuuuguguauucauguuuuuucuauagaauuacauaauuacuuguaauuacaguauacauaauuucacugucugcuuugcucacugaacauuauguuguacauucuguaguguuacauggucuucaucguuauccauaaauguggcucuuuccuucaguuguuuacuuggaguaaaccuaaauaucucuucacguguuuuuccucauuguuuuauucuuucuccaacagccagcaaccccaacacgcacaauagcagcaaccccaauucagacacuuccacagagccagucaacaccaaagcgaauugauacucccagcuuggaggagcccagugaccuugaggagcuugagcaguuugccaagaccuucaaacaaagacgaaucaaacuuggauucacucagguagggugaauuggccuuacauugauuccccuccuuggcuggguccaaauacaguuggcucucuguauucauggauuccacaucuguggauucaacuaguccaaaauauuugggacgggggacgaaaaaggauggucaugucuguacugaacauguauagacuuuuuucuugccauuauuuccuaaacaauacaacaauuuacauagcauuuacauuauauuaaguauuauaaguaacguagagaugauuuagaguauaugggaggauacacguauguuauauacaaauauacauuuuauaauuuggaggacuugagcaucaguggauuuugguauccaagggaggucccgaaaccaauccccugugcauacugagggacaacuguauuugcuuuacauguccaaagaggcuucuaagauacaauauguuccucagccauguuguuuuuugguuuuaaacugcaccuuuuuguuagccuuuuccugcauuuuuaauguaugguuuaauguuagucuagaagcuuuaugauuucuuucagaacacaggccucugaaaucauaauuauaucacuaaauugugaagacuuuaaaagauuguauggaggauuuuguuauuugaagaauaucuggugguagaccucaguacuucauauguaagauugagagaguaaagauuacgggguguauuauauuagcuaaaaggggaaaaguuuagaaggcuuauuuaaaaacaguuuuuuguagugggggcaguagcucuaaucuguaaucccagcacuuugggagacugaggugggaggauugcuugagcccaggagauggagaccagccugaucucuggugggacccugucucuccaaaaaguaaauaaauaaaaaauuuaacuggguguggugacgcaugccuguaguccaagcuaucaggaggcugaggugggaggauugcuugagcccgggaggucgaggcugcagugagccaugauugcuccauugcacuccagccugggugacagagcaagacacugucucuaaaaaguaaaaauuaauaaaaauuaaaaauaaaaauaacuuuuuggaagagagagggugauggagacaggcaugcaagcacaggcacgcauacucucuaagccuaugcuaaaaccaguuaaucgagcaagaaucuauagaagaugaaaaccccaaauuaaccaaaauccaaauuaauuuccuggaauuugucagcuaaccgaggacuuuuaaagaagggugaauauauuuaaugguuuaaacaguugucuggauauguagcauuuuuguuuguuuuaagcacuaccacugacuuacucuuugauuaaccugucauaaauaauauauuuuuuuagagacagggucucgcuauguuggccagguuggucuugaacucuuggccucaaucaacccucccgccuuggccucccaaagugcuaggauuacaggugugagccacugcgcccagccugcaaauaauacuuuuaaagcaggcaaggaauuaaacugaaugaaauuuauguaaaaugguauaagaucauuagguaaaaaaaaacugaaguauggauuagacugggugccuuuauggaaucaggagaaaucuguuauuuucuuuccagggaauauaauuuaaaguuuuuaagccacuaguuaaauauuacucaaauuauuuuguguugaaaguacgguaaugcuccaccuggccugguaggucaaaauccaaggguagcauccccaaauguacuauggguguuuuuaagaacacauuuauauauaucuuuauauauaucuuuuuuuuuuuuuuuuuuuuuuuuuuuugagacagggccuuggucugucacccaggcuggaguacaguggcaugaucacggcucacugcagccuugaccuccaggggucaagggauucucccacuucugucuccugaguagcugggacucaggcacaccaccacacccggcuaauuuuuguagagacaaggucuugucauguugcccaagcuggucucgaacuccugggcucaaccaaauccacccacgucagcuucccaaagugcuaagauuacaggugugagccaccaggcccagcccaggcuuauauuucuuugggaauucauuuuugcucaaagaaaucaauuguguuggggaauauguaaugauuuuuuaaauaggcaugauuuuagaggaaauacaguuacauuugugaggaguuugacuugugaagaagcaaauuauccagaaacauuuuaauacuuucaaagcaucuuaaaugaucugaccuguuuuaaaaagaaagcuaggccgggcacaguggcucacaccuguaaucccagcacuuugggaggccgaggcagguggaucaccugaggucaggaguucaagaccagccuggccaacauggcgaaaccccgucucuacuaaaaaauacaaaaauuagccgggcgugcuggcgggcgccuguaaucccagcuaaucaggaggcugaggcagggacaguggcuucaaccugggagguggagguugcagugagccaagaucacgccacugcacaccagcuuugggggugacagagccagacucugucucaaaaaaaaaaaaaaagaaagaaagaaagcuaaacauagaacuagauugauaugaguaaguuacaaagcugaaauaaguauaagguuagcauauuuagcagugccucaaguuuuaaacuauuagcacagcauacucugggguucccugagagauuguugcguaagugauaugccaaagauguuaaggcuuuuaaaaauccuuaucuuuuacucaaauagugguuugccuuucugcauuugacccaacauauugccaguguuauguuuuucucucccuccgcacaucucuccagguaaaggagcuucccuauggucugguguuuuguuuugugguuuuauccuauuuuuuggcaugaccauuccuuauuuuucgaaaugacuuugagacagcaguggcaaugguucacaaacuuggacuauguggguuaaaguacauacuacugcugcagaauggaaaaucagucuaucaaccucuguuuuuaagucagauacuucaauuuuaguuauucaaagguugcucuguguccaauuuauuuauauacacacacaaaguuuuagccauuaaaguuauuugcugaaacaaaaaaagcucuauucucuguguaaauauacacauuauuagauguuuuaaaguuauuuucuaauuucauaauugcuuauuaaaggauuaccauggcugucuuugcauaauuagaaaacaugucauagcauaauacauuuaucacaugugguacauucauuauuucccagucucaguuuuuguuccuuuuuuguuauguucuuuuuaaaaauaucaaagggauauaauauaguuaagauuauauaugaaucgacuacuuaaaacauuuacuuuugugagugauaacccaagaugguugugaguuggauuaucacgaaagagcauuaaaccaagccuguaccgaauuaaugaaaauuaguauguuaacugaggagucuguugcuuuuuauucaauuaagcaauuuaaaugugaaauaaaacauauuaauaaaugauaaagugaguuuauuauuuauuaucaugguucuaguuagugaauggcauagcuuuauuuccagccaccaccuuaaaguaucauuucuuauaauuacugucaugauuuuuuaauauauauuuuauuuacuuauuuauuuauuuuuuuuagagagagggucucacucucuuggcucuggcuggagugcaguggcacaauuauagcucacugcagccucaaacuucuggggucaagugauccucccaccucagccuuccaaguaucugggacuacaggcacaugcaccacacacagcuaauuuuuuuguguuugguagagauggggccuucuguuuccaaggcuguugacuuauuuuuugcuuguuaaauuguuacuuuuauaauaagacagaaguuugugaaaauuuguagcuuauugugcaguuacuaugccagaaaacacuuauugccaucuaacugcuacauaaguuuauauacucaaagaauugcaagguuuaguuggcaccagcuguaaucuaaacaagcugaccaugacaugaauauaugugauacacaaugcauaaguucaaugcuugacauauaguaggcacuuagugaauauuugauugaaugaaguaacauuuuauuuuauuuuauuuuauuuuauuuuauuuuauuuuauuuauuuuuuugagacagagucucacuuugucacccaggcuggagugcaguggcaugaucucggcucacugcaaccucugccucccagguuucaagcaguucucgugccucagccuucugaguagcugggauuacaggggugugccaccacacccaacuaauuuuuguauuuuuaacagagacggggguuuugccauguuggccaggcuggucucgaacuccugaccucaaauaauccacccgccugggccucuuaaagugcugggauuacaguugugagccaccgugcccugccugaaugaaguaacauuuuaauaaauauauagagauacagguauagauaaacauaaucaucugugucuuuagacauauuuguauacaguauaauggauagcauuuaugcccugcucaccacugauucugauucuugcaguuuuaugguaauuggaaugaaaucaauaaacagucuacuucaguauauucagaacugucauuaaaacuuucugugaugaugggguguucuguacauuggacaugggauguccaauacaauagccacugucuacuuauggcuauugagcacuuggaagggcuagugaugcugaagaacugaauuuuuaauuuauuggguuuuaauuaauuuaaauagccacuuguggcugguggcuauaugggaaggcagaggauaucaaucacuugaaguucagguauucugggugccucauuuugucuuacauuucaauauuucucaucuguuaaacuuuuuaucagaaguugcucaccaaaaagaaaaugggguuuuaaaaauauguuacuuuuuuaacccaacuaccaccuaauaaaaaauguaguauucaaugugcuaauaaaaaauguaguguucaaaagauggauuuagggguaggggggaaucaaaagacugggauaaucccaguucaaacaaguguugccaggauaguugagaguuggcugucucauaguaggauuaguuguauaguacuuuggaccagaaaugauguugccuuucugcccugucacuaaacuaauugaaaugaaugggugaaucauuuaaacuccgugagccucuguuuccuguauauaaagcaacuaucuuacgcuuuuuucccaguuugaucaagagagauucagcaagaagaaaagcucuguauacauuucaaagguuauaggcuuauagagaaagacaucuuuuguaauauauucagggcaucauuguucuauugcuauaagguuacuaaguuuccauugcccaugaagguuugacuaaaugggucaaaccucucuacugugaauuucuauuucuaugaugguuacaaaaguagucuuuuagaauaccuguuuuuuguaacuaacuuugaaauccaaacuaggagugaaaauagauuuuuuuuucacugcguccagaaauacuugauagggaaaagaagaaaagagaugauuucuaauuuuuaaagugauuuuugggaaguuugauuaguucguaaauaucuuggguuaucuagagaguuauacauaauaucuguaggugauacagauaaauuuauuuuuauuuuucuuuuuuaaauuuuuuucuuuuuuugagacaggaucucgcucugucacccagacuggagugcggugccaugaucacggcuugcuaccgccuugaccuccugggcucaagcgauccuuccaccucagccucccaaauggcuaggacuacaggcacacgccaccauaccugccuaauauuuguauuuuuuguagauguuuugccauguucuccaggcuggucuggaaauccugggcucaagcauuccacccauguaggccuaggcuucccaaaaugcugggauuaaaggugugagccacugugcccagaccagauaaauacauuuuuaaaaauuacuuaaaucacuuugguuguaucaauuaaggggcuuguuagaauauuagcacuauuuuugauaccuaguugaaauuuugguaucuccaugauuacauaagguggcaagaagagauucaaaaugggaaaguaugugggacaguauugaacauuguaacgaucaggccuaaaagaguccucacaguaacacugugacuggcuuagggauggaguuuaugugggaccccguaaguggaauaauuacugacuccuugucuaaagcaguuauuggagcaacaccccagagugaaggcuuuaagcacuggugagauaacucugucuuuccucuccucuucuccugcucuguauuguguguagggugauguugggcucgcuauggggaaacuauauggaaaugacuucagccaaacuaccaucucucgauuugaagccuugaaccucagcuuuaagaacaugugcaaguugaagccacuuuuagagaaguggcuaaaugaugcagguaagugacuguauaagacauuucuuugucauucauuggaauuuuacauggggauuguuauauaaauugggguuuauauuucuuacucuauuuuuguuguuacagaaccuugaagcuuacuaauccugggaggaucauuauaaauuauggugauauaaaucagaaagcugauucauuuaaauauucuaguaauuacaguauaaauaauuagccguaauuuuuagccugaaauacucuuguauuugagccaggauuaggaacacacacacacacacacacacaguugaaggaauaggauaaguaaggcuuuuguauuuagauaagcuugaaguagaagcuuauuguuucuuccuugaugaauuaucauagaacuuguucuugcaauaguucugcuuuuguuauuucaaaugaccacacauuucauucagaaaaguuggacuacuagcuuugucuuacguuuuuuugugcugagaguuccuuuuggaagauuggaauuuugagucacaggaucauagacuaugaaagcuguaggagucauguagaucccuuaaacuaugguucuuauuguagauaugaacaaaaauuaggccuuuggaaaagacaaaccugaaacacgcauccuuggacaguuuuauucaguagcuaugggugaggccuaggcaucuguuucccaaguccacagauaagaaccacugguuuacuguuuccaucuuauuuuacguguagcagaaacaaacucagauguguaugacaugcccaagguuauuaaacugugaaauuauagaacccugugauuuaacuucagagaauuuauaaauauuucauuuguuucuuuucuuuuuacccuagauuauaccaauaaaaugagaggccauuuacaagauaaauauuaaacguucaguaauuucuaagaaacuuucuuccuuuuauccccagaacuuauaaacaaacagaacuggagacauagagcugaguuuaaggauaggaauaguaaaccucuucugucucagaaacagaaauccaaacauagugguaauauugucaaccauccuagcagaaagaaugccaauaagggcagcagaaauauccaugguaguaaauauauauauauuggggggaugggugguggguagggggagacauggucucacucuguuguccaggcuggagugcaguggcaccaucucaggucacugcagccuccaccucccagguucaagugauucuccugccucagccucccaaguaacugggaccacaggcgcacgccacugugcccagcuaauuuuuguauuuuugguagagaugggguuucaccauuuagccaggcuggucuugaacuccugaccucaagugauccucccgccucagccucccaaagugcugggauuacaggugugaaccaccaugcccggccaauaagcaauauuguaauguagguuaugugaaaaccuuuucauacuuggauguagcuuauuuugucaguuuuguuguuaauaugcauauuaugcacaugaaucacugugcucagcuaauuuuauuucuguauuuucuucauucuuacagagaaccucucaucugauucgucccucuccagcccaagugcccugaauucuccaggaauugagggcuugagccguaggaggaagaaacgcaccagcauagagaccaacauccguguggccuuagagaagaguuucuuggaggucagugaggauuuuacuuuucuguacaugggauugucuguguaguacuuaacauuaguacuuaguagaaacuguaggugguaaaagaugacaugucagccucugcucuuauggaugauuauaaauaggugaaguaaguaaguuacuaacauaggagacagaaccagaguucugcaggguucaggagagacuagaaucacauccaugcaagcacucaguaugagagagguggcagcuuaccauaggauacauaggaauuaauuccacagacuagaaaagguggggggaaaguacuuuaagcagaggaaaugcaugagcguuucccccucagagugggggagaaacacuggagugagggaaaccauaggguguaugaggagacacucuaguagauugguugguuaaauuguagugucuguaugccuggaauaguaguuugggacuggaacacuagagaccuugaguguuaggcuauggagcuuaaguuaaugcaagagauauuuggcaauuauuuuuuuguaccagguaauaucauaacaaagcuuuuaagaaaauuuugacuucucuaauucagaaaagacuugagcacauugggaggacucugaauuaggaguuuuugucagcucugccacuuaaacugugugauugggcaaaucaugugauuucuuuaagcuaaagguccuucauugugaaauaccugccuuucuuacugugagauccaaauuagauagcaugaagcauggagaaagguuaaauuccuacuaauacaugugguuguacugguauuuuguuaauuucauucacaauuaauagaucuuaaaaaugaaaaacuauagauauuuaaggauaacuuauccuaaguuaauaugaauaaguuuaauagguguauguucauuagaacuucuaucuacacaaucucuuuguugaaaguggccuaauguggauggucauauguaucccagcuucauuuucuaaccugacgugauuaugccaguaguucaaaaaguuauugcaaaggauagcuuuuggaauuacaucuuuucacccugcagaaucaaaagccuaccucggaagagaucacuaugauugcugaucagcucaauauggaaaaagaggugauucguguuugguucuguaaccgccgccagaaagaaaaaagaaucaacccaccaagcaguggugggaccagcagcucaccuauuaaagcaauuuuccccagcccaacuucacugguaagaauaaaaaauagggagugcaagcucaagggcuaauuuuugcaauuuuacaaaugaccuguuaaaucaguuuauuucauaauaguaauuuaaugaauaaauacaucaaauaaaugcauguaaauuuguauuuuagacauuaccaagguaaugaaauucucauucucucuuuccuugucucucgugcucucucucucucucugcugaggucacuggucuugaggugccccugcauggagggugaaaucucguguuguuauuaacccaagaacuuauuggucuugcuuauuuuuuauuuauuuuucuauuuauuuuauuuuuuugagacagagucucauuccaucacccaggcuggagugcauuggugcgaucuuggcucacugcaaccuccgccuccuggguucaagcgauucuugugccuuggccucccgaguagcugggauuauagacguguaccaccauucccggcuaauuuuuuguacucuuagcagaagcaggguuucacuauguuggccaggcuggucuugaacuccugaccucaagugaucccuuggccucccaaagugcugggauuacgggugugagccaccauucccagucuuuuuuuuuuuuuuuuuuuuuuuuuuuuuguugagacagaguuucacucuuguugcccaggcuggagugcaaugguacgauuucagcucacugcaaccuccgccuccuggguucaagcgauucuccugccucagccucccaaaguagcugggauuacaggcgcccgccaccagacccagcuaauuuuuuuguauuuuuaguugagaccaggguuucaucauguucuccaggcuggucuugaacuccugaccucaggugauccaccugccucagccucccaaagucccaacgugcugggauuacaggugugagccacugcgcccagcccaccuaucuuauuuuuuaaagugaacaauuuuaauucuuucaucacauuuccaucauacucuucucugguauaguucauuagauuacucuguaaccaugggaguaaauuugcugcugaucccaguuaucucagaaaaucuuguuacuuuuuauucauguugaguccuaaagcccaguuuauuaaacuuacacucacgugauuaagugacaauaaguuaccagauaaccuucaguucugaacuuguauuaaaacaaucaucucaggucuuuuacuuugaaacaacauaugauccuuuccugugaagccucauugaguaacuucugcuguuugcauuauuccuagacugaagagacauacaguggucguaugacucccuugguuuuuaggaugauuaugaauuugacuucuacauugucaggauucaaaagaugggaauauuguugaguuugcauuucuguucuuuuuaaauuugguuuuauuuuauuugaaugucauuccauacuggcaggcuuuuuaaacuaaggucagcauuaaaagcacauguuaguuuaugugaagguuguaguuguuaaauggugggccuguagucauaaaguuaugagauaguuaugaaaaagauaauuauuaaucaacaauuuuguuuuguaaaggugauguuuguguuuuagauuuguacuaaaagaaagacaguauuucuugcaaaacuagaauuuuuuguuauuucaaaacuaauccguuuuuuuuaaaaguuugcuucacauuauuuucauaauuuuauuuuauuaaaaccaaaccuaaggcaauacugccccccuacagagucaaaaguaaaaguaauacauguaccccagauucccugauccugucaaauaguuuucuuauuuagguaaaguugauaauuaguauaauguuucuuaccgacuuagaguauaucugucucaacgcuauugaaauuuacgaacuuuuuauuauuuauuuuuaaaacccaggcaaagcuaucugugauaucagugaacaaccaucuucgaauagcagcuuuccaacauaggaugucaggugucucaauuccaagaucaaagaaagacuguaaaaucauuuccucuuuaaguuuugauuuuaagugcuuuguccauguuuucauuucugaccucaagguggcgaccacaccaagccuugugacuagcagugcagcaacuacccucacagucagcccuguccucccucugaccagugcugcugugacgaaucuuucaguuacagguaagcagcugccaggccaugcaccugcugagcacaugggaggcccguuuuggguuauuauaagagucuaccauuaaauugugaauuaaggcccuaacuaaagauagguguugcucauaaauaucaauuuucuuuaaaguaacuccuuuccuuaaaagccuucaauagccguggcuuuuugcauucagaaaaaccuccaaguuugucaauucgugaagguuauuuccggucugaaccugaucucccacuagucuuuugccuacgcacccucaacacacaggaggccuccauccauaccuuuguaaacaucccuacaauggaaauguccaucuuagccugcaguucuugaucuguuacugauaaaacuauaccagcuuguaugucaauuuucuuggaaauauucuuuagcuuucccaggaaacuauucauuuccauguaccuguauuauaaaugauuuuauuuuuacacaccugucuuucccaauagacugcacuucucaaaagauuugauuauucuuuuugaacucuugaugccuagcucagugcaugacauacucacuauaaaaugaauguuuuuuuuuccuuuggccucuuuuaaauagcaaauuuuccagauaaauuuaaaaucacuuagcauugucaucagauguuuuuuagugauacauagugcauaagacaugcuguaauuauucaccagguugguuauuugcuaguacaucauuggguagauuaaugauauuucauaaugaagcuugauuuaaccuagagguagggacuuuuauuuuucucacccauguuuuaaguuuacaaugccuccuuggcucuaugaccuacccaugauguaaaaauugaauaaauggcuuuauauuauauuaaauuucuacauuauuagaacauuuuguuuauuguuuucugcauccaaucauccauuaauuuuugcuuauguuaaacaguacuucuugaccucuucuggauguuggaccuuuuuaagaauuugaaagcuacagacuuuuccucacacaaaauagacauauacacaauuuuuaguaaaauuuaaggagauuuauaaaugacagcucccaucaaccucccacuccaaggcuauuuguggauaccuacagguuccaguuuuaauaaccuugguucaagaauauacuuaagaaccuugguuaagaauauauauaauauugagcacuuccacuuaauaagcaaacuguuagugauugauuggcauuguguugggcaccaagaaugugaagaaccaucucugaggaccuuguuguccaaauugacugccagucaccugguaaauuaugaacugaauccuaccuucccaacaaauuauauugcuuuaggucuaaaaauaccugucucuuacagaaauuuuguuaauaguuuacacauuaagaacaaauagcuuugcaguuuucuuaaaauauggggaaaaucaaaguaauuuuagagagauuuuaauacucaaaacuagcuaaaaauuugcaucaguuuuugauacuucuuaccacucacauuuucuugaacucuuacucagccuauuuauguggaucuauuugugauuuuuuucugacacguugauaauuuuuccuggagugaauuuuuuuuaauuauuaaaaacauuauuaggaaauucaaacaggaaaaacaaucacaaguaccauuuuuauuuucucuuuaaauccuuuuuauauguacauguauguacaguuucaguaguauuugugcaguacaguauuugauugcagccuugugauacucuaagcagaggacucaggcucugccuggacaccugacccacaaaaacuaugagauaauaaauugugaugauuuaagcugccgaauuugugucauugcuccuugaaagagaagaagagucagugucaaguggguuuucuuuucuuacucuuuuaucagccguugcucaaaaccaugccccuuuuuaauuuguuuuuccucuuuggacuguaacuuucuuguacagccucuuuuccucugauauuuuuauacugccuucuuuuuuucucuguugagaaaaguagcauguuucuuuaucauguuauuuauuaaagacggccauugucuuaaucauacaacuuauguaaugcaaucugcuuucuuccugaagacuuucuucuugggauuucuaugauugcuuauuuuaaauuguuuuccuuguuuuccugaguuagauccaauguuucucagaugcccugucauccucuuugauuccuuuuugucuggagcacguucucaaguaauuuuauuuagaaagguuacaugggagguaaaacuucuaaauacauguauaacugagaaguauuuauuuugccuucacaguauuuuuuggaguuuguccaguuacaaaaguauuuuuccuuugaauuuuguuguguuuuagcaucuaguguugcuagugaaaagucugauuucaaucucuuuuuccuuguuuuuucucucuguaaaccuuaaggguuuuuuaaaaucuuauacuguucuaaaauuucacuacaagguuucaaagaaggggccuuuuaaaacuugcccucauuggccuucagcaagcauuuucaaugugaauuaauguauuucuugcacucugguaauuuaucuuuuuuuuuuuuuaaguuaggauuuuuuggcauucacucuguuuauucauuuugugucauuuguaaugugcuguuggcuuuuuucauugucuggugauuuuuguagugaugaaugcaagauuacauuacuuauuaucaguagccuguaaggguuuuuccugacauuguguagcuucuguuacucaagaguccccuccccugaauggaagggcucgcggugagcugugaaugugaauaaagaacugccaaacuuuauuucagccuaugaacaggaagcaggcaggcaagcgaggcuuucugucauacuuuuccaaaaugagggguaucuuuccucaugcaugcaaguaccuacacuagaauccuuagcguuccauagucagauuuuauuuucuuucaagaguaggugacuuugguucuguucauuugagaggucugguagaaggagggaaaggcccacugugagagcuauuaugugaauagcccuugaaucacccuguucucugacccuauuuccaucuaccucaguaucugacaaauaacucugagcugggacucucugugaggcuccaucagagugaauaauuuccuccucuaucauagucuucuccugugcccuucuggauuaugguugauuucuccaccauccaguuuuauccuuuuucucauuucugcaaaucugucuaaaucucaaaaccucugauaccugucaccagagcucuuuuucccuuuuguaucucuuuacuauuauuuggaauaggauuuuagaaaugaagggaaaaaccauauccuuagcacuaucuucuaagaaaaaucauguuugauugauguggucaucuuauuuucccauagguacguuugacacauaauagguccuugguaaacauucuaaaauagaugcaagugagcauugccauacuccuccagaaagacgaguguuccauugugucucaaaaacuuguaaaaauuccacagcccuuaauaaucucaaccaaacaugccccgcccccaauucauuuuccaaaauauuuuucauagugacaaaauuguugauuccucaggaagauauagcaacuauaauuauauagccaccuuaacaacaaaggcccaagauacaggaaacaaaaaggaauaaaauucaaagaagaaauagacaauucaacaauaacaguugcagacauaguauuuauuugagccacguuaaaaaaaaaaaaauucaggccaugugcaguggcuuaugccuauaaucccagcacuuugguaggccaaggugaaaggaucgcuuggguccaggaguucaaaaccugccugggcaacauaguaagaccuugucucuacaaaaaaaaaaaaaaaugagcaaaauuagccaggcgugguggcacgugccuauaguccuagcugcucgggaggcugaggugggagggucacuugagccuggaaaguugaggcugcaauaagcugagauuguaccacugaacuccagcuugagaacagagcgagacccuguuugggggaaaauaaaaaaaagccgugaaggauauacaacauuugagcacuaucaaccaacuuguucuaacugccaucugcagaacacuugguccagcaacagcagaaaacacauccuuuuuauguacacauggaacauccaucucccaggauacuuuuagccauaaaacaaguuucaguaaauuaaaaaggauuaaaaucauacaaaguguguugucugaugacaacugagauaaacuagaaauuaacaauagaaagaaauuugggaaguccccauguauuugaaaauuaaaacaugcaucaaagaagaaauaacauuucuccucuauuuuccuaucaggccgguauuacccagauaccuaagcuuagauaaauagcacaagaaaaaaaaauuacaaacucauauuccucgagaaaauauaaaccaaaacucucaaaagaaucuuagcaagucaaauccagcaacauacugaaaaaaucgaacgauuauauacaucauggccaaggaggauuuaucucccaggaauguaugguuaguacaauaacugaacaucaauuaauguaacacauuauaauaguagaagaaaggacaaaaaccacauaaucaucucaguggauacagaaaagauauuuguaaaaauccaaaacccauucaugaugaaagcugaaauacaaaggaacugccucaccugauaaagagcacuuacuaaaacucuccagcaaauagaauacuuaauggcaaaagacugaauacuuuccccacuaagauugagaauuagguaagaguguuuguuugcucuuguggacuucugauuaacaucguccuggagguuauagccuccaguaagggggagaaaaaaaacggaagacaauuuggaaaggaagaaguuaaacugcuuguauuugcauuauucuauauguauaaaaauacuaaggaauucaccaaaaaaagguaucuaggacuaaucaauaaauucaguauuguugcagaauacaagauugauauauaaaaaauaaauuacauuuguauguacuaucaauggacaguucaaaaaugaaauuuaggaaauaacuuguauguaacaguaucaaaagaauaaaauacuuaggaauaaacuuaaaagaaguguaagacuugaacaaugaaaacuacaauuugcugaaagaaguuaaaagaagucuaaauaaagagacauuucauauuccauguucauguuuuggaagacuaagcauucuuaagaugacaguuuuucuccagcuugagauauaugugcaucucucuuucucucugauuucaagguuuauccacauuauagcauaaauauauauuuuuuuauuuuauuuauuuuauauauuuuauuauuauuauuauuuguuuucgagacaggguauugcccuaucacaguggcgcaaucacauuucacugcagccucaacuucccaggcucaagcaguccucccacuucagccuccccgguagcugggacuauagccacaugccacccgcccagcuaauauuuguauuuuuuguagagacgagguuuugccauauugcccaggcuggucucgaacuccugggcucaagcaauucacccaccuuggccucccaaagugcugggauuacaggcaugagccaccaugcucagucuuccagcuugauuuauagauucaacaaaaucauaguaaaaauuccaacagguuuuuucuuuguuuuguuuuaaagaaaucgauaaacucuuggaagggaccaagaauagccaaaacaauuuugagaaagagugaaaucagaggauuuucauguccuaauuucaaaguuuacuguaaagcaacaauaaucaaagcaguguauuacugguauacauauagauauauagauuaaauggaacaaaauuaagaguccagaagcaaaacuuuaaauuuaugcuuuauugauuuuugacagaggugccaaggcaauucaauagggaaaggacagucuucaacaaaugguucuaggacaacuggauauccauaugcagaaagaggaauagaggaauuuagauccuuaccuuacaccgugcauaaaaauuaacugaaauggaucaaaggccuaaauauaagagcugaaacuauaaaguugcuaguaaauaaaguaggacaaaaucuuugugaccuuggguuaagcacagaguucauauacacagcaccaagagaacgauccauaaaagaaaaaaaaauuaguaaauucagcuucaucaaaaguaaaaucuuuugugcuucaaaagccacagacugagagaaaacauuugcagaucacauauccaauaaagaaauugugucuagaauguauaaacaacucuuacaacucaauaguaagaauauaaacaacucagauuuuuaaauggacaaauguuaguagacauuuuaccaaggaagauauaggagugacuaguaagcacauggagagauaugugacauuagcauuacucauuagggaagugcagauuaaaacuguaaugagauacuacuuuguacucacuagaauggcuauaaucaaaaagacccaagaugauaaauguugggaaggauguggagaaacuggaacuuucaugcauugcuuguaggaauguagaaugauacagcuucggaaaacaucuuggcaguucuuuuaaacauaaauuuaccguccuacccagcaauuuccccaagagaaaugaagacauuucuacacaaaaacuucaaugugaauguuuauauagcagccuuauuuauaauauccaagaacuggaaacaaaccagugcucaucaacuggugaaugaauaaacaaaauguguuauaucuacacaguggaauauuauucagccauaaaaauuaaugagguguugauucgugcuacaauguggaugaaccuugaaaacagaauguuaaguaaaagaagccagaugcaagagacuacauauuguaugauuccauuugugugaaauguccacaaaaaucuagagacaaaaagcagauaacuagguaggagugugacaugauuacaaacaggcacaagggaucuuuuuugggaguggaaaugucauaaucuggauugugaugaugguuguauaacuguaaguugauuaaaagucaucaaauuuuaaagcuggaugaauuuucaugugcuuacuagucacuccuauaucuuccuuguuaaaaugucuacuaacauuuguccauuuaaaaaucuaaguuguuuauauucuuacuauugaguuguaagaauuguuuauacauucugacacaauuccaguuccuuuauuggauaugugaucugcaaauguuuucucucagucuguggcuuuugaagcgcaaaagauuuuacuuuugaugaaguugaguucacugauuuuucuuuucuuuuauggaucauucucuuggugcugugucugugaacucuuugcuuaacccagggucacaaagauuuuguccuacuuuauuuacuagaagcuuuauaguuucagcucuuauauuuaggccuuugaucuguuuuaguuaauuuuuaugcacaguguaagguaaagaucuaaauuccucuuucugcauauggauauccaguuuauaaguuguaucucaauaaaagcuguuugagaaaagacaagacagggcgggaagcacagggaagugccagguacuauauacacaccuugacuauagcuuccuacugccccugugaggugguuggugguaucuuauuuugcuguugaggacauugaggcucagcaacaauaaguucacuagucaaaguuacccaaguaauuaaauugccaaguugccaagaauuuacagucaugaaauacauauauugaugaaaacaugacucacugacugggauaauuaauuugaagauaauuuuaaguuguuauaccauaaugcuuauuuauauaacauuuauauuggagacgccuagaacaauuuugaaugcuucuggagucaucaucuucuggccuagguuaaauucacugauaaaauuugacugggauuuucuuuguaaacuuaagggauuuaagaaaacaguuggugaaugauuugaagguggcuggagaguaaagaaauaacuauuuuaagccuuuugagcucaagauauuaggacuuauaaaaauaggcaauucaauuucagaacuuugaaagggaaguaguacccauagguaaaaucagguuagauaaggugagaaauuggucaaaaaaagauugaaaguacauugaaauugcuuagcauggaagagaaauaaaagauguucaccuuacuaugugacagggggcaugucuuaagagaagauuaaagcgaaaaaggguauaugaaucugccuaacacaggacccuacacagcauccaguguucagugguugauuguucugagagauuuagaaccaaagaaguaaugaacgaaaauaggauucauaguaucuacaaagauguaaugauauuuaggggcaguggcaauaaaaauaaaucacuuauauuuuucagaaggguagacagaggaagaaagccuuccuuuuuauuuaacaauaagaacauuauguuuaccucauucauuuggcagccacuuuugcacagcuuuauaggaggugaagaaaguagucagugcugaaauaaaugaugucugagucucucccaacccugugacaugugauaaaaacugaagaguggaagugagaguucaauucuagauguucuuaguacagaccagaagaagguuuuaaaacagauuuuuggaaggacaaaauugccugaauuuguaacaagauuguuaugaaagaagagcauguucugaagcuugguaaaagauuucaucaccaaaaaauguuauuauuauuauuauuauuauuuuuaacggagucuuacuucgucacccagacuggaguguaauggcgucaucucggcucacugcaaccuccaccucuugggcucaagcaguucuccugccucagccuccugaguagcugggauuacaggcgcccaccaccaugccuggcuaauuuuuguauuuuuaauagagacgggguuucaccacauuggccaggcugguuucgagcuccugaccucaaaugauccacucaccucagccucccaaagugcugggaucacaagcgugagccaccacaccuggccuugucuuaccauuuucaguggggcuacuagaaauuuuuaaauuacauaugucuuguauuucuguuagacaacacugaucucaaacauuaaauaaucccagcaaauguguuuuaguguuuaguaaugauauauuuaaugucaguuagucauuuauauccaaauguucauucuccuuaaaccaaaagcauauucaggcacuuuuuucuaagaccucacaaauaauuucuuuuuuuuuuuuuucuugagauggagucuugcucugucgccaggcuggagugcaguggcgcaaucuuggcucacugcaaccuccgccucccagguucaagcgauucuccugccuuagccucccgaguagcuggaacuacaggcgcgugccaccacgcccagcuaauuuuuguauuuuuauuagaggcaggguuucaccauguuggccaggauggucucaaucucuugaccucuugaucugcccaccucagccucccaaagugcugagauuacaggugugagccaccauacccggccuacaaauaauaauuucuuagaucuuaauuuuuaugcuuuuaugagauucauaguaucauuguauguuguuuuuuuuuuuaccacaauggacuuuuugagagcuaauuuuuauuacagaauaguuguuugaauguagagaaggcauguagucauuuuuauacuauguuguuguugauacugaauucuuagaaaagcauauaacuuucuguuuuucuucuccuuguuuugauuuuucugaggagaccccuaaggagauuucugaaugaaaagagcuuuacagaaguuuuucuucuuuugcuuucuuuuucuuccccagagcaguuguauuccauaauuagagcuucuaugauucuuuuguuucuugaauaggaaacaggcaauggaaaacuucucuguuucuuucauugcucauaucucuuaaaguaggguuccuagcugugauccuaaaauguuugguuuuguaguuaauuuccauaaaagcacuaaacuagguuauuaaaggacagcuuuacuaggugguagguuaauuauuccauugauuauagaguuuggcugaguaaagccaccauucuuccaaaaccauuuacaaaaggucaucuucuaaucuguuugucuuuucaggcacuucagacaccaccuccaacaacacagcaaccgugauuuccacagcgccuccagcuuccucagcagucacgucccccucucugagucccuccccuucugccucagccuccaccuccgaggcauccagugccagugagaccagcacaacacagaccaccuccacuccuuuguccuccccucuugggaccagccaggugauggugacagcaucagguuugcaaacagcagcagcugcugcccuucaaggagcugcacaguugccagcaaaugccagucuugcugccauggcagcugcugcaggacuaaacccaagccugauggcacccucacaguuugcggcuggguaaggcgcuuucucaucucauucacgucugagguggaggucaucccuggaauuacucacaggggagacuuuacaucacugacuuagauggggaaaaaaaugucuuuaaagcaguaaucucuuugaagugggcuguuuugugaucauacaaggacuuugauuauaguugaguuuauguuucuuaacacccugggaagggcaguagucauaccuuuguuuccagaugaagacccaaaauaccaggucacuaauuaccuuagugacggggccaggaagaaagccuagaauucuugacucuuauuuuccccauuaaacucucucaacugccuacuuccuaauucucaagcauagauaagagauguaauaggagucucaauuuuauacuguuauugucacacauuauaagaauuaucuuguaaauauaucuuuuucucuagaauguuucuuucauuuuggaaagaaagagaaauaagucuuucaaagaagggucaaaaugacuauaaaaguuuuacauuuugugcugaucauaaccucguuuguaugaguaagcauccaggaaagcaguaacugagaagcacaaaccauagaagaguaaagaaaaauaaauauuuccaccuauuuccccagcuggauuuucguuuuguaaguuccuuuugguguguugucaaaaugagaccugcgucugcaugguaauaaagugacuccucuuuuggacuugcagaggugccuuacucagucugaauccagggacccugagcggugcucucagcccagcucuaaugagcaacaguacacuggcaacuauucaaggucaguagaagccuuuuucuuaauuugguggcaugcacgugugugugagugugugugugugugugugugugugugcuugagacagagauagaggaagucugcuuugcuagagguaaaagugaugggaaagagucaaaugcugacuaacuuguucuugagaacuaagaaaauguccucguaaaaaagcuuuguaagaaaaguauagguguuaguaugugaguaaaagcaggaaauauacuuaguuugguauaugguaaaaaaccagaacuuucaugcuaauauugaucuuaugugaguagacuugaagccagauuuuuuuccccugauaaguuuaucccaaguauuaaucuaaaacccgucucuaggcaaacuugaccaaguaagacucuccaguucccagcugcacuccugagaaagcugugcaugggaaaguccuguaaugaacaaacauuggaacacaucagguggaccucaggagugcuuuuaauucucauuaaguucugcucuuuuuauaucgccguuaguguagaacauauauucucuuggauuauaaugucucuuuuccaagcucagcuggguuccuuuugccuuuuagcauguuacccagggcaauauucauuccauauacugaaggguuccacuuguuuaguaccuaagcuuucugucuaaaaauguuuacuguuaugugauucagggagacaauuugagagacaucacuaauuaauuagaauuuuuuucuuaaaauaguuuugcuaagaggcugaggcaggaggaucacuugaggccaugaguucaagacugcagugugcuaugaucaugccugugaauaaccauugcaccccagcguggguaacacaguaagacccuguuucuaaaaaaaaaaaaaaaaaauuaaaguguuuugugcauaaaugagaauucucagggccaaaaauaacuauuagccaaccuaaauuaagauuaauauuucacagguaauaucucuaacaguguacuagagaauguuaauuacagacaaaaccaaaccauggccuagauuaccuuacauuauauugacuuucugauugacuaaaucauaccugaauugguuagcucuaaagcuuuuguuauauaauaauuuuuuuuugcaauagaauuugugauaaaucacuuuuucuucugcuuuauugaauguuucugugcuguguugauacuacaaaggcaaaaugucuucccuagggcaugauugacacucugaaaagauacuaaguuuggaaucucagaaaaacuucaagcugcacugucucacuguucuguacuauuuguaugagcaaggccaaagucagaggcauucccuucagcuauauuuuauguaagaaaucaaauguguaaugccguuagaaaaucccucaaaucuacauguaggagugagguuauauggcuagagagauuuaggaauguugccagacaacagguugagauacuaaaugagagucucgauuauuuuaaauaaaauguugaugaugccuucuuuggggaagcaacagcaucauagaaaauuucucacccauuaaagcacauccuagacuuagaucacccaccuacaucauuaugucuaauuuccugcuacaauagauucaucauucuccuuugcacaagucauagaaaucaaguauuuagccucaggaagugagaaauuaauuauaccuuuuaacuuuauuuggugauacauaauuuauuuuagaacuaaagccuuuuugcaagaugauuuucaucuuguauaucauaauauaaagcagugguccccaaccuuuuuggcaccagggacugguuuucuggaagacaguuuuuccauagccacauugugguggcgugguuucuggaugacacuguuuccaccucagaucgugcucuaugagaaucuaaugccgccacugaucuaacaggaggcaggccucaggcuguaaugcccaccacucaccuccuguuguuaaugcuuuaaucacuucagcuaguuuguccuuugaacagagguaguuuaaaaucagcagucuucauuaaagacaaaauuauuggauuuaucaaauaugucuagguaaaugaaauaaacuggugauuucaagacacgaacaugacucuaauucauuagacaguuauuagcugucuucuaccccugcuugugcccauuaaauuagacauuucagucuuuuaggcucuucaaaauuaaaaauaaacuacaauugguaucaauauagcacuguguuugaggaaaaaaauucagugaagggcuauacuuuuuccugguggguuguaggaaaaugauagacuuuugauguguuauuuggcuucuccaggaugauguuaauguuuucauuccugccuguuuugggggguuuuugucuguagcucuugcuucugguggcucucuuccaauaacaucacuugaugcaacugggaaccugguauuugccaaugcgggaggagcccccaacaucgugacugccccucuguuccugaacccucagaaccucucucugcucaccagcaacccuguuagcuuggucucugccgccgcagcaucugcagggaacucugcaccuguagccagccuucacgccaccuccaccucugcugaguccauccagaacucucucuucacaguggccucugccagcggggcugcguccaccaccaccaccgccuccaaggcacagugagcugggcagagcugggcugccagaagccuuuuucacucugcagugugauuggacugccagccagguuaauaaacugaaaaaugugauuggcuuccucucgccguguugugagggcaaaggagagaagggagaaaaaaaaaaaaaaaccacacacacccauacacacauaccagaaaaagaaagaaaggauggagacggaacauuugccuaauuuuguaauaaaacacugucuuuucaggauugcuucauggauuggagaacuuucuaaccaaaaauuaaaaaaaaaaaaaaaaaaa

SEQ ID NO: 12938 - RNA, 37792 nt, Homo sapiens
aagaauuuccacccacaauuuuauuauuacugaaagcauuuggaaugaagcaaaggauuuaacaauauauauaaaaauauacauuuuuuaaaaaaucgcaaguagacaauagauuuauggaauuauuuuucugaucauccagaaaagauagcaauaguaaacugcaguugggugagaccagccacugguccaugagaccuaagcagcccuaacgcugccugagcucucaagaguagaagaaaugcucgacaaacagaaggaggcugugggagggcagcaggacagccccaccagaaaaccagagcccaaaugggcugggcagggccagggcugagguaucgggaugcaggaacaaccaggaaccccauguggguugaggagacaugccaauuauucuggccuggagaggaauuaccaggacacaagaacucagaccaucugcaagcaagcucccuuguguguguucacuuuaaaucaauucguguuuaacucacugaaugaauacguggguuugggugggaaucaucccugugucuacgaucaucucaaggagaccagagaagggaaggcacaaccaaucaaagcaguuuccccaauuaagcuuaagugcccacuaggaugggcgccagcuacuagggcuucagggaaagcaaaagccaugaggcccaggcccugccccaaggagcuggcgcucuaauacagugagagcacucgcucagaagacugugccuuguggcccaugauuggacgugggacagaguaacaggauuguuuccacguauguggacaauuaggauaggguuagagaaauccuugugauuugagaugggccuggagggacagguacgauauugacaggcagagauggaaagugugugggcaaaagcuccccagggccugugcagcaggagugggagguggccuucccaggaggguuuggaacauacuggcagcuacgggaagugagguuggaaagggagugggagcuggaggccaggccaaugcagggcccaagcauacucacuuauucuuucauucauucaagaaagauguguggagugcaaacccuccaccuggugccccuccaggugcugggcacacaggugagcaggacagcccccaccccccaaggcuggcaucgccucccuggagaguucugagugggagcgccccaugcucagcgcugugcuuccaggagcuccugccaacuacgagggaaguggaggcugcagccuggucuugagugagggccaggcccgcaccaggugucacagccaggagggguuacuucacaggacagugaggucagcaggaucagcacagggacccccuuaccaggccagccauguuccccacagcugacacuggggaagaaauguccccaucaaugucugggauggagggacaggagaacagggcuuagaaaggagaagggaggccaggaagcgggagaaugaaccccuaacccuuccuccgccgcccucugcugcuggccugucacuggucgaggugguccggggauucacgcccagugcuccucugcucuucuugccuguagucauccuccuccucccucucucuggaaaguucucuuagcugcucugguggcuccucauaggcuucccgguuccugcagggcagcaggggacagaggggaaggauuugcucucagguggacccucaagggagcugggccucaugugcauuacaggaagagcagccuccagaccuccuccccacccaccagcugcagaggacacugggcugaaaggcugggcugagaguaaaggugccacagacuuguuccacgcaugagcugaggggguuacaggaacaggcuggcuuuaccagcccaggaggaacuggccccgugacaggggcuccaggccacacuuggcucuagucaugccacaggaagcccggcccugagcucccagacuggaaaaccacaggacugggaggcagguccuggggcugcaaugcacauuuuauggcuuggacaggucauuguuucaucagcacaaaaugggggugauauaccccaaggggugcugcaaguagaagaggcugugaggaauugggaagcauauuuccagucuccccagacccuuccaacaggcuaccagcccagacacucacggccuugcauccuccuugucuucaguguugucguccuucccucggcagcagcagcaguagaugaugaugccaaugauaaugagggcugcaaccacgcccaccgcgaugcccacauacagggccacguucauggaggcugcaagaggacagagcagcugcacuugccgagcuucuaagcuagcuccgggucuccucccagccaggggagcagcagcuaccagcuucugguaacacuccaugaaaggcauggucuuggaggaaugugaccagccauggcccaggaauauucuucaggauggaggugcagacagagacauaugguccacuucacaucuuaacacuuuccgggcuacccuggcucugcaaaaguccucagaugucagcccagccagcucuuuaagcuagauuuggugucucaccccagaaggaugugguccagacucugcggcagcugcccugggcacuuccuccacgcccaccgagugguuccuaggcaggugggacugacaaagccucugaguccuagaagucaguccuagguuccacuuccaaacaccaguggaacuggacuggccucagagugaggggagccugggacagagucauccugccuaggucaccacagcuaaccugcaggugcguggcccuagagagguuccccuauuccuccucacgguggucucagcugacuuucuggacccccaccaguuauccuguggcguuugucagcccuccccccgcaggcugcucuuacgagaucugacggccaccgugauguugcagaacugcguccccuccucauugcuggagguacagauguaguaacccgaugugucuguggagauauucuucagggagacaggcugaccugaggcugcaggggaagaagagucagggugaagagaggcacuacaguggaguggagacagccaggaaugggaggucuggacuccuugggaagcacaaccucugccacugagcuucuucaggccggagccccauguccaccuccagggcugcaggacgcuuaaaccaggcagggcccacaaugugaagugcucagaauucagucaggcacccuggguuugacaccuggcucugccacuuauuaauuugucuuuagcaaguaacucagcuucauucaaccuccauuuccucaucuaaaaucagaaauaauaguaccugccucacaggguacuugcaagcauaaaaugagguacuaauaauaaauauaagcccacaacagaaugccugauauguaguaagugcucaggaaacauaaugcacauuauguauuacaugaaaaugcuuucuaaucagaagauauuauuacuuuuaugaucuucagaaaccaaaucucuuagcuuagacucauaugaaagaagccuuuggaaaucaaaaacucugaucucuggauuucugccaugagagaggugugugggguguaugugugugugugugucuguguguuaugugguguguguggugugucaguguguguggugugucagugugugugguguguggugugucagugaugugcagcgugugugugcugugcucugugagaguaguguguguaugguaugugguguguguggcauaugugugguauguguguaugugguguguguaguguguguggugagugugugaugugugugguguguguagugugugugguacggugagugugugaugugucugguguguggugggugugugguguguguaguguguguguagugugugauguauguggugugugugguguguguauggcgugugugugguguguguggcauguguaguguggugcguguggugugguguguauguggcagcguuuguaguguguguggugaguguguaauguguguggugugugugugguguguggugugugugguguguguagugugugugcugcauguggugugugugguguguacugugugugguguguguggcguguguaguauguguggugugcagugugugauguguggugugugguggguguaauguguguggugugugaugugugguguguguugcauguguagugugugugguaugggggguggugaaugugugugcuguuggggugggacggaggcagacugucuagacucuuccucuacaucugccgccacuugagcaagccauuuaacuucuuugagcuguaggcuuccuucggaaagcaggagugaaaacaccugauccuccugaaucgaagagaacggaccagaauaucucauggaagaccuuuccccucaaucuaucauccuaugaauuucuucaucuugaaagcaagagcuuugugcuugggcauauguauauguccugccauccaagaugcuuuguuauaacugcuauuuugagaggagcuggagaccuaccuccucuaauuuugcugcagagccagccuugccugaucccugcugccaccaggugguuacacgccaucccuaagagacgcucuaaauuguaaauacgauccugucacugcucuguucagacauuucaggggcugcccagcaaccacuagacguaauccucaguaacaaguccaagcuucaggucacagaucuggcccugucaaucauaccagcuuugccucuugccacuuggugcuaggggcaaaaccaggggaguuguccucucuccgccccaccgucacuuuccugcaagauugcaucucaagauuuuccuucuccggaugugcugcucaguacacauccucaaaugugauguccuuucauccuuccagcaauccucaauauuucaaucuccaauucauggaguuaacuggaggcuuaaagaaguuaagugaacugcucaaggucacaaaauuaagaaauuauaaaacaggaacaaaaauccuguuucaggucuagaacucccuggagccauugauaauuuucuuuuaaaaauuuguggccggguacauuggcucacgccuguaaucccagcaccuugggaggccaaggcgggcagaucacuugaggucaggaguucgagaccagccugacuaacacagugaaaccccgucucuacuacaaauauaaaaauuagccgggcaugguggugugcgccucuagucccagguacuugggaggcugaggcaaaagaaucgcuugaaccugggugguggagguuacagugagcugagaucgcaccacugcacuccagccugaguaacaaagcgagauuccaucucgaaaaaaauauguauaaaaauaaaauuuuguaugauaaaagcaauguaugcuccuuauaauaauuuauaaaugauauaaaacuauuauuucaauucaauucaauacagaaaaucuuuagcugcugaucacagcuauaaacgagaugaggagggucccuguccucuugguguuuccagucucccaaagaagacagacaugaaacaaugaugguuacaguucaagauggagguacuaucugagcuuauggcaagggguuuuaaucucauccaaagggccaaggaaugccucuuuaaagaagagagaacaaauaaaaaucauucauaauuccaucaccuauaaauaacacuuugauuuggugcuauuuucuuucagucuuuucacuuguacuuucuucaaauucuucccuugacccccaggacacuacucucuggaugcucauucuucauaaaauguguccccuucuauccuagaauuccacgccucaguauguuuucuggaacauuguuuacaugugauauuaacaugcggcauggagaaggagucccuaaaaaagcaaguuuaggaaucacugaguuaggauuaaguaaucuuucuaagggcagcacuuucagagcuccuacaaugcuguugagcacugggaacuucugacagcggggugugguauucaugcucucauuugcuaaaugaaucggauuuguuauuuuuaagaggcaucuugaaggaacacacuuuaggaaaugcucuauggcccugggcauacuuaggaggucuagagcucauaacagauccccaccacuuaagagugugaagcucggacucuggauuuaguguaggcagcacacugcagacagucaggacuuuuuuaguugucagaguccagcuuugagcucuaggccuuguuuaggguggggaacaugggguuuccuaguccaaugagucagcgcuauccucccccaguucccugaugcaaaccgugugcacuggaagcugcugggaugaaccagugcaggucuugugccacaggaccuucuuugauuccgaguuggggcucccaagccccuuuuccuucggaaagggacuaguaauuucugauauccggagaaaacuaauguuuccgcugcaguggcgacaccuuguggucagaaaggggaaugcacaggacggucauacgcuucccaccuuccucugcuccagcuguggagagauuccccucaagagaaccuccugucucaccaagacgcuaaugucacguugacaagaccuaacguuuccgcauccccccaaccccuacccaauccuguagcuugucgacaagccccugcugccaccucucucucacaaagggcccucacgauccuccuuggacugguccccacccuucacaaccgccuccccuuaagugcuccaggccccagaacuacccccucccccacuuccuugauauccaaauuccuguuucuucagugcaugaaacucagcuuccugggacacagcuuacaaagucuguucagagcuauuacacaugggaucuccucucauccucuucacagcuuuuggggaaucccaguuuuuuucaaagggcaguacuaaggguccgagaggcugugagugacucacagcuccaaaguggagaagucaggacuucuuguuuccugauucuggauucccuguucuuuucacugcuagcuuguuuccacugaggguuuagucaaaggaaugaaucucuaauguuggaaauugucuucagauguaggagagcagagguacccuccucuccaaaucguccaugguggacugaaauguuuuaaaagccagaaauaauuugggcugacccacagaggaagaagaauuagcagauucucucuauuuauuuuuuguuuguuuguuuuguguuuuuaagauaagaucuggcucuagugcccaggcugcaguggcaccaucuuggcucacugcaaccucugccuuccaggcccaaggaucuucccaccucagccucccaaguagcugggacuacaggcacacaccaccaugccaggcuaauuuuuguauuuuugguagagacaggguuucaccauguugcccaggugggucucgaacuccuguacucaagcgauccacccgccucagcuucucaaagugcugggauuacaggcaugagccacacugcaccuggccagaauuggcagauucuccaaggcucugcaaagcagaguggaaacgaaggcuuugagaacucugcccucaccccgcaaugucuccagaugccagggcauguuguuauggacauuaaccauauucuuuucugucaccugcagguccccauucugacucagcaaaucuuaacuagagacaggauaaagcuuucacaaauuaaagcuuucacaaauuaaagaagcaauucucuuuucaccuccuuuccuguccucaggauucucccuuuuggauaaugaaagaacuaaguuuuggcuucuaacaaccagaagagucucccuguggaggcaggagagaacugcagcugggcugccccuuugugaggcuccucagaagguacccguggcuuacagggcaaagacgaaccucccuagcguaacgcacaggcucuucaugauuucucaucacuguguuucuuaacaagaguaucucccaccauuccuacaccuacacacgcacccuaccccuuagccacaccagacagucaugauuccuuccuguucuccaugccaagccuccucauccuugaggacccaacucaaauaacagcuaauaacacuuagcauuaaaugagugcuuacugccuaccaggcacuagucucaaugcuucacaucuacuuuuauuuaaucuucacaacccuaugaaguaaacacuagcauuguacccauuucauagacauagaaccuaaggcacaaagaagcugagucacuugccaaggucauacagcuaacaaguguccgagccaggagucaagcccauggcaugcucuuaaccacugucgacuccaauacccacuccuuggagaaaccuucuuugaucuucuuaugcaucuucuguguuacaucaccacuggguauaaagcuauuauagcaucugccaccuguaaccuucagcuuugggucuccauauacacacuuugcaggaaagaagaucagacacuaccaguguccacagcacaccuaccaugaccauggcuggagucacuagacuauucauaggccagagagaggaggccacagagcccccggggagcugccaggugguuucaacaaaaauuccagacacacucgauaaaaaguugccaaccagaaauacguaaacacaacuggaagcuuguugaaaaccuacauuacauugaccuauuuuaaguuaggucgaguggauucuacuaacuguuuuuuuuuuuuuuuuuuuuuuuuuuugagacggagucucgcucuguugcccaggcugcaggcuggagugcgguggcgcgaucucggcucacugcaagcuccgccucccagguucacgccauucuccuaccucagccuccggaguagcugggacuacaggcguccgccaccacguccggcuaauuuuuuguauuuuuaguagagacgggguuucaccguguuagccaggauggucucgaucuccugaccucgugauccgccugccucagccucccaaagugucuacuaacuuuuuuaagaagucgauuugcccccaaacgagugauaaagcucuuccuggauugagugcacccccaaugugugcauccguccggcugggcuuauccaggacaccagauauucuucccccggguccucauccccacccccggggcaccucaucuucucagaagagcugugugcccugcuggcuuugcuuuccaccucuggccuccuuuuccaccuacacugaacugaaagaccucccagaagcuaaaucggauggacaccuuucaggccuugucuuucuuuuuaaaaaauauuuuauuuauuuuauuuuauuuuacuuuauuuuauuuuauuuuacuuuauuuuauuuuauuuuauuugaggcagggucucgcucugucaccaaggcuggagugcaguggugugaucauggcucacugcagccucgaccuccagagcuuaagcaauccucccaccucagccuucugaguagcugggacuaaagggugaguccugccaugcccagcuaauuuuuuaaaaauuuuguuuggagacaggggucucacaauguugcccagacuggucuugaacuccuagccucaagugauccuccugccucagccucccaaagugcugggauuacaggcaugagccacggcacccagcaagccuugucuuucuugauccucaggagcagggguggcacuaggggcccugggacuccaccaggguauuuccacacccauuggcucuggguguggaaaggaugguaggauuuuuauauagcucuuucuuuuuuuuuuuuuuuuuuuuucaguuuccugacugaaagguccaauaccaagcugcccaguacaaaacuggucuccuggcaacuauagcugaauccaccaucgccuccccuaagaaggugggacccuuacagcaacauggugcugucguuguguggagccauaaaacgguggugugucuggggcagcggggguccgugacggcugagagggaccggccuggauaaggaaugggaaaguuaaauuccccaccuuugcguggagcccccgaguuagacuuggggucucaaauguauacuucaggacacaaucaaauuaaaauccuacccaugcuuuugcacagagugcuuaucagggcacguucauccaagagaacugaggaaugaggaacaaagaaaacaaguuaacauuuaccacggcuuccgcuacgcgcuuuacaugaaucauuuuuguuucuugccagaaccuaugagguagguauuauuauaagaaaccagugcuggccgggcgcgauggcucacgccuguaaucccagcacuuugagaggcugaggcggguggaucaccugaggucaggaguucaagaccagccuggccaacauggugaaaccccgucucuacuaaaaauaguggugggcaccuguaauccuagcuacuugggaggcugaggcagaagaaucgcuugaaccugggaggaggagguugcagugagcugagaucgugccaacugcacuccagccugggccaccuggcgagacucugucuaaaaacaagaaaccagugcuuagagagguggggauagggggauagggauggguagggaagcaagcggccuucagggggaucugaucggucaacccaaguugcagccccuagccaaucagcugcauguguugcacuuugacguggggagcccgccuucccuacugcccccuuaccuggcugggccaggggcugcuccugauucaggauguuguaccucuuccagcuguacugagggguuggugagcccuccuuugauuggcaggucagcuggauguuguucccaauuauggucucucccucgaugccgcauucugguuuggaggguggcacuauauagaggagagaccaaagagaaggcaugaggcagguggggcuuggugacagccacccaccccuccccacccaccccccacacacauauacugccuuguuuguucacaggcagaaaacuccauaguugaguagugagauggaaugcuguaaaaccaauucaccccaauauggccucaguggucugucaccaccacaaaggagcaguacauaugcugggaagcauugcgggccugcaguagcuuuccaaggcauggccucauguguguucuaguuuacagucaugggauuuuaaagauagcggaacauggccguuagaaagaugggguucgagaugaguuugagaccagccuggucaacauggugaaaccccaucucuacuaaaaauacaaaaaauuagccggccgugguggcacccaccuauaaucccaguuacucaggaggcugaagcaggagaauugcuugaaucugggaggcggagguugcagugagcugagaucgugccauagcacuccagcuugggcaacaagagcaaaacucugucucaaaaaaagaaagaaaagaaaaaaagaaaaagaaagaaagaaagaaagaaagauggggacauugaggcccagagaggacacuugcucauagguacuggcagagcugggacuagaucucagcucuuauaacuccagauccugugcacucuccaccagcccauaugagcuccuucugccacuaauucauuugugccauuuugggaaaauccucacuuccccucgaccucaguguuccauucuguaaaauuaguggacuacaaaccuguucuguaaagggccagguggcaauauuuaggcuucgcagacuacauauugucuuuguugcugcuacuuuuucucuuuaaauaguauguuagaaauguaaaaacagucugugggcuggauuugguccuaguuugccuaccccugaacuaagugaucucugaagccuuccacucuuaacuucuuaguaauguucuuucuggguucagcaccauccuccuccugugcuuugcagauaacgugcaguugccauaagcacgggaugaugggcggaagcaguugccauaagcacgggaugaugggcggacccacaggcagcaguaaaguuaugugcagggugaaggaugaggacugaggggacucgagcaggcagagggcgcagagguaaggagagggaagcccauagacuggagguuacccagaacggcagccacccucaucucacaaccccaacccgauucccuggauuucugggaagcuuaagccugugccuuucacucagcauugucaagauaccauuguggagcuggguucauucuacaaaccucacugggugccuacugugugucugacaaugcugggcacuuggaggacacagugggugggucaaggaaucuagugggggcaaaagacaaguagcugaacaaugaccagacaggaggcaaggcugcuggggcagauaaggccuaaaacagccccaaacccaagaucagcugugacgugaaggaagcaugacaguaaacaaggccagugguggaggugggagugguggucggagaaagaggugaugguacuccaggcagagugaacagcaugugcaaaggcucagaggcaagaagcagcaugaagcaugcuugagacuucaggucguguccuuggaggugagaaggggaggacacacaguggagaggguugcuccuggaaucccuagguggcaagccugucuccucugcgucuuucuuuucacauccccuuggauggcuugcucgcucaauaaacagugcugcccauucuauaauccaggugcacggucgcugagcaucaggagugcauucugaucucggccccacccggcagcugcugagagaaacccuuccacacacaccacuccccucuagcccagcagccacaguauuuccucuuggaaagagccaggcuauuguugggugugcccaacaucuccugcugccauagugagggcuggccagguguggggcgagcaugagggaaauuagaggcccucccugauugucacuuucccuuggaugguuccuaaacauaagagguccaaaguucaaggccgggccucaucuauccugcaccagacccugggacuggagcaguguggggagggggagucugcggcuuaaggaccacucuuaccagcagccaacaagcagguccccggggaacaagagaaggugaacaccacuucccagaggaccccuaggaugggcuugcugagccaagcuuuaucucuugagcuuuucagagguacgggagcaucccucuccacgcauccaaaccauucagccuuuucccaggaaugccuugaaucggaagcaaaggcuuuauuccacaauuggagagcgggcaaaacaccaaucccaccugaggagucccagguguccccaaagucacaccaagugugcaugacugacaguagagccuuucuacaaccagguuucuuugggauaaaagacaaaaagggaagaaaaguaacugaggccuacuggcaucuacagagcacucaaaggcauccgaaugcauccaaaaacuguuauagcuuugcugaaaccaccauuuucuaagggaaaacugcugaaagcaaauccuuaauucucuccagaggcagagguacagacaauggcaaagaagugaccagccacucccaaagagaucagccuuagggcggaaugugucaguucccagccccuaaacccucuggccucacccaggaaccccugcucucacccuguccagaucccucacuaaggucucuccccucagccuuccaccgucaaaaacagguaggaccuccgaucaaacagaucuuuaacagaucaaaucguccuuccacacauguggggcccgugagaccuccgggggacucgguauauuaucagucuuaccuccccagcagaaugcagauguuaccugaauauucacuggaggagcagugauagggagggaggggaaacggaaccagucgggugccaaggccucuccgaagccugcgacucccgcuacagacgucagggggcgccagaggccggagcaccggguccccggucccggagccccaguuuucccagccgaaaccgagacugagaccacgcgugcugccccgaggcgcgggcugaggggccgccgggcugggagcuucaugcucgccucgguuuacugaggucauccagccccagugggcuggcugccuuaaaauagccuagcugcaaagccauuaggaaagaaaacgugugugugaauguuuauauauguuuuuauuuauguuuauauauguuuauauguauauaauuuaaacuuguuucuucgagugcauuaaaaaaaugggcucuuucuuuucucuguguuuuuuguuuguuugcuugcuugcucgcuugcucgcuuguuuguuuugaggccggucucugucacccaggugggagagcagcggcucgaucacggcucauugcagccucgaccuccccaacucaagagauccuccaccucaauuuauuuauuuauuuauuuauuuauuuauuuuguagagaggaggucuggcuauguugcucaggcuggucuccgccucggccuccuaaagugcugggauuacaggcuugagcuaccgcacccgacccuucuucuuuuuuaaaaaaguaaaacauugguuucaccgaguuccauaaucucagauuaaauuuguauccuucuggcuggcccugguugggaggaagagggaucagcauuuauauaaugcuuauguggaggauuucgggggagugugcauuaauacuuccauugcccaaaggaaaugagaccuauuuaagggaccccuaacauacauauguacguguguguaugggaugucuauuguaguauuguucauacaaaaaaauguuaacagccugaauauucaucaguauggaacacuugaauaaaucaugguaccuccgugugauggaauguaugcuguuaaucgguagaucugcaugugccgaucuggagaaaugcgcaugaaacaagguuagaaagaaaaaacgcagagugaucuuuauaacaugauuccauuuuuuuuaaaggaaagaaaggaaaagagaaaaguaugcaagaguguguguguguugaaaggacaugaggaaaauauggaauaccuaccuguguugccauuggcuaccucucuaggggguaggguggaaggagaccuuaguuauucuuuauacaaugcgaguuugcauaguuguauaguuggacccacuauaaugcuuucaaaacgucaggcaaccaccuuaugcaauaaaaauaucuuaauuauuaauuaaauuaaauuuuaaaauaaauuuaauuuaaauuaaacauauuaauuaaaaauaaaaugcaaucaauuauguaaaaggaagagggaaaaaagaucuuuguuuugguuuaaagcauugcuaccucccagcaguggugccauuucuuauauuggacauagacuaagugcucauuaaauaacaguuauuuuccaauaacgauuugacuuugagucaguuccuuccuuucucugggcuucaucuacaaaaugaggauauuaaaguagaugaucuuucagauccuucccaaacuauaaauuccaauaauaagucauuccuaugaaaagaauguuaucuugggacacauuucaaagggagcagaaccugacugauggaguaucuguugagggaugggggugagcagaugguggcaugaagaauuucugcuggguagccaaaguuacggcagggaaagauauaagagaaucaugauguggcccccugagcacccaauuaaggcacaaugagucuuugcaauaggauuuaagauuuuccuuuaucuuuguaauaagugugguaugaaaaagaggagcugguauggaggaaaggacaccgacagagcaagggaccacuccaagucggccuucucuguccucgagacuguuggccauuggcggagaacucagaauaguguuuaguuccaaagggaggagcggucccucugcugaagacagccuggacgaggugaggagucuuagcuccuuguugcugccucuggcuucgucucaacaccugggcucuucucccugugcugccaccugcccacccucuuccuacaacuccugaaagacaugaagacacucaccgaggaccaacaggcggacacgugacuugguguugcccuccaggucugacaucagcgagacagaacacucguaggugccguugucagccauggucagcugaucaauggugauggaggcaucggacugcucagcauuguuggauaugcugacgcgauucuuauaaagcucaccauggauguaguuuuuguuugaaaacggccagaugaccacccuuuccuggagagagaagaaauggcaccaggucuucacccaaaggcccuugccuggugcuuccagccugcccugacuacccucaucccccaguuuccagggcccagaagcacagaccugccaaccccucagaacaaauagcucgcauaugugcuacccauuuguggauuucuuguauuauauauauauuuuuuuaguuuauuuuuaaaaugaaaauauugaaagaaguuaggcaguucauaccgcaguacacaugugggugaauggguccaucugggaucccagcacuuucaccucuuguaaucuccggcaucucucuuauccauuccauuuucuccauagccuauccucacucauucagucuaucaguauuuacugagcaccuuccauguaccaggcaugaugcugggcagccagccuuggcugccaaacccacuuuauuuucuugacucuugccuuuggaauguacugauugauugauagacucaucauuuaucaaauuguaugugguaauggcuaaaucacagacuuucaagccagacugcuucaauucaaauccccauucugccauguacuaauuguaugaccuugagcaaaauguuccaccagugauucuguuaacuauucugcaaaauggagaugaugacaauaacaccugccucucaggacuguagugagaauuacaguaguaauauacacaaagcaguuagggcauuaugugacauguuaaguuucuagaagugcuagccauuauuauaacugagcaucuacuaggugucugacauuugaagaugauaauucacgaauucugcacccaaagagugauggaagugauagacaaccaaaccuugcaacaucuugugauuaucucuaggaccccagaagaaaauaucacuuccagagugguaagucaggggaggcuuccuaggagaggugacaguugccuugaauccuaaaaacaacuaagaauuagccaggcaaagggcuggggguauugggagaguaaguguuggaguaggauaaagguguugggcauuucaggcaaaagaagaaccacagagaaagaauuagaugugggaagcaacauaucaaccccagucauucaguaugaauggagguaagugugugagugagggacuggugagagggugagcuugggcagguagcaauaaagaucauagcugcuauuuauugaguguaugcuaugugcuagguacuagccuaugcacuugguauguauuaucucauggaaucuucacaacaccccuaaaguagguauaugauuacacucauuuuacaaaugaggaagccaaggcaccaagaaguuaaaggccucccccaaguucacaugauguuuaaguaaacgacagcgcugagguucaaaccgggcauuguggcuccagagccugaaguccggagauucuacaaugccaggucucagacaucguguauaugggacuaaacaguuugcauuuacccugaagugcuagagagccauguauuuaggaagucagcucucaacacaggauggaaagugacuuggaaggagaaaagggacugguuaagaaaccaguuuaacaauucagguaaaaaaugauggguccucagauaagguuguggcaaugcagauggaaagaaugaaaugaauuugaggaguaugaaagugggggcaccaaugagaccaugaagccaggagaagauccgauggacagaguaagggaacggcagacuuccaggguaagaguuuuuuggcuuggauauuuggugaugucauuuccaagagaggaaacacaaaggaagggaauguuuuaugaauaaacaauguguucucuuuacgugugggguaucuggagugucggugggagauccaucuagguggaggagucaguaagagccagacaggucaguuuagugcaacuggggaugaagguuugggagccaaugacaugucgauguucacugagacaugggcuagaugaagccacccgggauaaauaaguagagaaauggcaagucaccaaguuacuucauuugaagggucaaggagaggucagagagcuaagaggaaaagccaagacaagacuuccagaaagucaagacaagaagacuccaagguuggaaaguggcugcuggugugaaaugcuaaugagagaugaaauaagauggcugaaugaaguguacugaauugagcgaaaaaagagguugcuguugauuucuguagagcauuagguauagaagcgagaccaugauggacagagaauguggagacccgaugucaagucugacaccugugcgugcagugcgcuuugugcaacauuagaauaaggggcucuacagccugugcugggauacauggcuuggcuaaugaagcacauauccuugugcagggugcaaucuacccaaccacaggcaacagaccagguugaggcagacagcucuuucaggaagcuuagcugacaagcgagggagaaacaagaugggagaugcaaaggugucucgggcuguggaucaguccauggauaccgguccuucccaauucugcucuuuucugaugcugacuggcucugcccaggacccucugcccacuaacccuccucccaucaaagauauccuaagccucccucccuggaccuccgccaggcuagaagaccugcuaggaccugucacaauaaucuccuugaggggccguauuuaaaucccuuucucuauacucuugcagggucucaaggcaauugccugaaauccuucuggaaguaagggacccagcagucaauaaaauaacuuuaguaucuaccuuaacacccagaaaacugucaggcagagaccucaagucuggccugcuaaauaaguaugauggcaagagaagguucccuuucgcuccuacaagcuaaaggcagcagcuccccucucugggauuuuacccugggacucugggagcagucgggacagguggcuauggcccaucauggucccuuggugcgucugaccaagacuugcucucuuuccccauccguccugcccgcucgaggccuugaguguucuaggccaccccuucuuuccuguuagggaaaaagcuaagucuuuccacucuaaguggucggggaccuaaugcuuaucucugccaggcacguuugcauuuuaaaagaagaccucacuuuuaaacuuaugaauagaugcucuacuucuuauaauuaaagaaauguuaauuugaugaugaaugagauguuuuuucgcuuaucagacuggcaaauagcgaacaguuugagaaugcucuguguuggagaaauagguguccucacuguugguggugaaaauaaagauugggagacauuuaaugagaaaaauuugauguuauuugucaaaauguuuaauucacauacccuuuuucacaugacccagaguuuuaauaauuuauuuuauauauguauauauagagagguacauauaaggguauuuauauuuaugcagcguuauuuguagcagcaaaauauaagaaacauaccaaauguccauucaugguacauauaguaccuucauaaauugaaaugccuuuugcaaauguugaaaaaugagauagauaaauauacucauauacacaaagagcccaagauguauuaagagucgaaugcaaaacaguauguguguaguauauguaaauauacauauucauauacgcaaauacaucuauaaaaacauauauccaugcucguauaugcccugccuggggguggaggaaagugggggauagaggaugagggugugggaagagggugggugagacaggagaagcagggaugggaaugagccuucucaaugcacacuuuuuaugagguuuugauuuucaaaccaugagauuauauuaucuauuuaaaaauagaaauagaaaaaaaaaacaaaacuccuccacacuucccaaaagaauccaaacaggaaaaaaaacccauaaaauuuggccucagagcaagggcuaugcuaaucaaaaggagugacugacucgcaugauacaauuuaggucauuugagauuggccaccagaaagauauuuuaggggcaggugacauuuucaaaauaaaggugacauacucuggcccuccaugagcccaacauucacugcucccuccccacccacuccagccugggugcuaguguuuauucuaccauuuauggaaagacuucauagugcuugccuucuaagagguccuggucaggugauaaucauucccauguugccugaacuuguaaaguauccuuaccguaugagugaggaggagcuuaucccauugaauaagucccucucgacuggagguggaagugugguaggugcagggcagggugacacucuuucccugcgaagcccgaagaacguccugcggaguuuccacagagauggcaucgacggucacccugacuggaaagaaaguaggcaguggaagggaaaaguaagcgacacggacagacauacccacucacugcccacaggaccacugagggaauguccagggcuguucuugcaccuccagccacagcuagagccaucuuggccaccuuggcccuggcaaccagcuucuccuccaagacugcgaugaggacaaacacaugggccuugguccaccugacuccaccccacagcaugaugaauugccuggcccugaaccucagcccuacuucuuaccagcugugucaacuugucugagcgucaguuuucucaucaauaaaauaggagcucuaauacuuauuuccuugauuuauugggaaaauuaauggagauaccauguguaaguauuuuuauuacucccuggcgcauagaaaacucucaauaaacauuaccugccaucguuuugguugugaugaugauguauucucucauuuaacaaguauuuauggaacauuuguaugugguaaagaauuuuaugaauaagauuauaucgagguaaagagauggaccauauuuucacaggaguuuaucucguaugaguuuaucagaacaagguuaggaaaaagaauguggccacacuagcauauuuuaucacacaugcucuugccacgugauguugacucuccucccucaggagguggggucuguguuccuucucuucgagccugggugcaccugugacuccaguguaagggauguuauguggcucugaggccaacucauaaaaggccauucucuucaccuggucccuugcgaugcucacccuggaaaaccaucaacauucugaagggagguaagcagccacauggaaagacaggugucuguguuugggacaccaacugagguccuuugggacagccaacuucaacucccagacaugggagugagcaaacccagccaccuagcuguuggaacugaugcugaggggugcagaguugagcuacccugcagaucccugcccaaauugaagacucaggaguaaaauaaagauuguuauuauuuuaaguacugaguuuuggggugguuuguuauacagaauagaugcuuggcacagagacccauguggaucccaguggugagaacuuuccaggcagaggcuaagcaagggucaggcagggaggcaggagucagcuuagucuacgcacaaggaacagcaagggagauuguguagugggagggaagugagugaggaggagagaugaaauggaaaaguuguggggguggggguggucucagauugcauagagcaauguagcccuuauuuaggacuuuguauuuugcucugaaugaagugaaaaugcccuggagagauuuaagcagagaaaauauauuugacuuacuuuuuuuuuuuuuuuuuuuugagagagagucucgcucuguugccaggcuggagugcaguggcucgaucuugaauugccuccucccgccagguucaagugauucuccugccucagccucccgaguagcugggauuacaggcaugcaccaccacgcccagcuaauuuuguauuuuuaguagagaugggguuucaccauguuggccaggcuggucuugaacuccugaccucaggugauccacccaccucagccucccaaagugcugggauuacaggcaugagccaccaugccuggccugacauacauuguuaaaagaucauucuggcaaauguggggugaacagauagaagugggguggggaacaagaauggaagcaaggaaaucaggcaagaguuggcucaauaguccagaugagggcuaaugucuuagacacaggugauuguggggagguggugagaagugauccaaauuggaauguauuuagaagguagggccaaugggauuugacugcaggcuacauuuggcguguuagaggaaaacaggagucaggaauagacagaaggauuuggccucagcaacuggaagaauggaguugucguuuacugaaaugacaacaguuaaggaaggaggaaguuucagggggcagaucaggaguuuguuugaggacuugcaaaguuugagaugcuccuuagacacccugguggagguggcaaugaggcaguuauguaagucuggagugccacagaggcacggaauggagacacaacuuugggagucaccggcucuccaucaguuaaggucagaggauguugaggaucacuaaggaagugcaugaagacaggaaagacaugugggacugaacccugggacacuccagugcuucaugauggaggaaauuaggaggaaucaguaagggagaaguaggaaaaucuggcuagggagacaggaagagaaccaagagcaggaaaaguuucuugaaagcaaaggaggucagcuacucaaaugcugcugacauguucaaccagggaccugagggcagagagauggucauuggauguggccacauggagguggccuuggcauuaguggaugcaguggggugguggggauggagccugaaaggagugaguucaagagcugaugggacaagaggaagcagacaguguuugcuggaaagggaagagagcagggagacuguagcagcuaaaggaggcuauagggucaagaggaguuuacgcccuuuuucccaaaauauguguaugaugauuuaaaaaauaauacuuuuacacuguuuguugaugaugagaaugagccaagagagaauggggacagaaaugauguccuuguagggcaaauggggcuggggguacgguguuaugggaggacaggccuuagaagagaugccgggcugucuacccacuguaacaggauguggcuaaaggugcaagugggcugguagauuuggugguagaagggugagcaaguucuuacugaauguucccaugaugaggcugcagcauaaagaaggaaaauguccugcugaagaccguccccccgcccagcugggaagacuccacuauccaggcaaauuccagcuggauuaacacacuucucuuucaaaaugcaaaucgcuccugggaaacagggaagcauucggguuguucauacuucauuaagcaguauuucauaaggugaaagucagccacccuccuggaaugggcacuguacagugagggccaugugagcuccuggggugaguuuauaauauccgggaguauuggauauugggaaugagagacaggaagaugucaaaaaaacagguuuccccucuuuggcauuugcauauuuuccucauggugaugccagugccagaagccccugaaaauuuguucaaauguuggcuucccaagucacugaugcugcuccagaaggugauuccaaaguggccaagacuuaucaaaugacccuccaugugacuggugucuuuccaccaccuucgucuaucagaaaacauuugcuggcagggcgcaguggcucgugccuguaaucccagcacuuugggaggccgagguggauggaucaccugaggucaggaguucaagaccagccuggccaacaugguaaaacccugccucuacuaaaaauacaaaaaauuagcgacugugguggugcaugccuguagucccagcuacucaggaggcugaggcaggagaaucacuugaagcugggagguagaggcugcagugagcugagauugcaccacugcacuccaaccugggcaacagagcaagacuccauuuccaaaaaaaaaaaaagagaagaaaacacauuagucaucauuacuaacaagucacccuucaucagaagguuacuugcuucaauggagcccuccagugccgucugcccagcucccagcuauagcagacagcccaucuagauaucauuucucauaugccugguguagucauggcaacugccacugaucuuuacuucaccucuucuguccuugccuggaccagggcauuuucccuggagcgcuguccucacggugaccacucuugggccucuccaugaacuuuacacugauucuguucuugucuaucacccuggccacacacuacacauuaagggacuucugccacuggcagaaccuaaauggcccaugcacaguugguccccaaaacucaagcaaauucuaucugauaguaacaauucucacucucaaaucaaagagaaccaacccacuaagucauuccuuuagacaauggagugucuaauuaccugcucacucaagauuaaaggaauguuaagucaaccaucaauggaugaaaaaugagucacucuauugaguuaaucauucucaauucccuguuaaucucauguuauuuuaauuacaucucaaugguacaggcaccauacagguauuuuacagauauucucucauuuauuuucauacucucuuuaaugauagacauuuguauuuucccuauuuuacuggugacauaauugagguuccaaaagguuaaacccuuugcucuaucuagauaugacagcuugacagcuaacaaauggcagagcugcuggcaaguccuucagauagaggcagcccuggugaggguauagggcugcugcccaacagucagggaaaagugcuaauuuuugccugcagggacaggaggaugguguuuuccuuggcugucaacagaaccuauuuccuauuuuguuccuugaccacaucacaccccucaaucuugucacagaaacucuucugcuuucuucagucaaccaacaaguauuuaauaugugccuagcauauaaaaccagcccccugcucuacucagggagauaagauagaugcccacaaagucaucuucuuacccuggcaaauuaauggacauagacuagcuucacacauacacuuagauccucuuaaccaaaugcuaaguacaguauuugcuuauagaagagaacucagugugaccuuuauguaggaaaagaacuagggcuggcaacugcauagaaacaacacccacuauucucuagcaccucacaguucucaggagccucacauccuugugagaggcgagacucugccaaauggaauggccgaauuggcuguauucagauucucugaacauccccuuccaaggagggcaauauacucccaucaaccacuccuaccacucguucauucugucucccaacucucccuuucuucugguucagaaacaucccuucgauacuuuaaucccggagcguguaccgcucuguaucgcacaacuucuccauggccauuucaggaggcagcauggcauagaauuugaaugcacagauucuagaacuagaaugccccuguuggaacucugguuccuuucuuuacuauacauauaaccaugagcaguuuacuuaagaccucugugccacacaguuuuccuuugagaaacgggccgugugagaauuaagugacaugaaauggguacuuuguuuagaauaguuccuaacucauaaucaauaaaugauaguuacuauuacauauauuuuucauauugagccacuucugcuuccuugucucauacucuguuguggaggugcauccuugguagaaguuaaucacaagaggcagcacucaccaucaccaugggugagcugucaaaaaagaauaguaauugcuaaugauuauaacuaaagaauagaucaauuuuagagaucauuauaacagagaguuaaaauccauuugauguuauuagaccugugaaggaagaaauagaaaugaaugaauaagaaagagcucauaaagaaaaaaaccagcugggcgugguggcucacuccuguaaucccagcacuuugggaggcuaaggcgggcggauugccugagcucaggaauucgagaccagccugaguaacaaggugaaacccugucucuacuaaacuacaaaaauuagccagguguggcagcaugcaccuguaguuacaaaaacucaggagacugagggaggagaauugcuuuaacccaggagguggagguugcagugagccgagaucacaccacagccugggcgacagagcgagacuccgucuccaaaaaaaaaaaaaaaaagaaaaaaaagaaaacuugcacaaauguggaaaauguggagcacucuuucaauguucuuuguaaaccugagaagcaucuuaaaaagcucauccugugcccugaggcacacuuacauuuuccauaauuugagacgagaaguuauuccguguuuaagaacuuuaugccaacagccaucuugggaauccuucauagcuagccuaaauccuuuccacccauucagucaauauccucuuguucugacauuacuggcaaugaagacaucuggcuggacuuuuuaauaauucgccauuguagcuuuagaggcuucugauguuugcaaucaccagcuuuuucaccuccaucuggaauaaauccaguuucuuuuacuuuuuuccacaggcuuuauccuuauuagcacugcaucccucauuuucucuccugggggucuuugcauccguacucagugaaugagaccaaagcaccagguaggacaucuaagcugggauuaggaaguugagaagugaagcucauuuuuagagucuuccagcuaccucacuuuccgcuuccuuguauagguuggcauugaauaucaggucuccaguugcccagagcccacccuccucccaguagcuguggcucucccauccagucacucccuuugcccugugcccgucaugcucuagacauuuucuuucuuccauccucucuccccuacucuccuugucaaggcugagcucuucugaugcucaagaagagcauccaucggauaagcuaauuuacuguaagguguuacuaacuaauaauguaucaauguguuaaccuccagggguauacagguuagaagugcaagcgccuuuaccugcaaggaaggaaucauaacaaucucuugcaugauagcacaugcauuguccuaaagaagaugccccaaccuucccaagaagaauugauaacucuguccuuugugucaccuacuacccauggcuuccugccuccuagugcuucucucucauaaaacuuuauuacacaauacagcagcauggccaagagcacaaacauugcagccaaacuauccggguuggcauccucuuucuuacuuuuccuaacuguguaaccuuaggcaacugaauuaacuucucugggcuucaguuucuucaacugugaagugagcaucaucauauuauccaacuccagguugugagaggguugaaugacuucacauaaagugcauauccuuuacccugggacauaaaggacucuacaggcaaucuagguugucaugucucucuccucugcugcccuguguuuucuucaucuucauaucccuagagcucggcaaagugccuaacauguaaaaggucucaauacguguuuuuugacagcaaaugaaugaauuauagagaacuuaagcuuacaggauggguaggauuuaaaaccagagaaacuugguggaagaaccuauucaaugaauugcuggaaauugaccaaaaguaaaauaaaggaccaaaggagccccagagaugagaaguggagucugcaagauaccucagcuggaaaugggagaggucauuuccccucccuaaggggguccauauggagagccagccugaggucucgaugauugcuuguaaaaaauuaagguuuauuaagaagauaauaaacggucucuugagaacuaaauggaaaauaauacguuggaggauaaugaaaugcuugauggaaccgguggcuugaggcauacauagcacauuaugugagcccuugggaaacuggcaguaaugccuccacuugggaaaaucuauuugcucagagaaaccacguucuuagggaggagauucuggaggccagaaaggacccagccagccccaggaccaaguaccaugugcugguguugagaaagugcuggucucuagggagaagaaggcaguucacacacgcagguugguuuguccuuccucuaugggcagggaggcucucaaacuggcagcugagagaggagagauugagaggcagggagggaggugguuuaggacucaauaaauguugaaccguucauucaacaugauucuuuaugcaucuauaaauucagaucaauccaauaaaauucuaccaauguccuaguuuagugcaaggcaccagaaaaaugaucagagguguguucacacgccaucuuggaagccccaccaggaccaccccagcccuuccugcugccuggcuuucccgagccacuucgggcagauguaucccagguacauguaguucucguguugauaugggcugugcaucaggcuccuucccucaacagauggcaggcucccuggggcagcgucugagucucaggcuucucuuauauccaccacuugccggcuuuaccugccaggugucuacacugagcuggguccuaauaaggccuuguugauugagugguauguggcacaaucccugcucaggaagcagucagagguuacugucagccagcauccuaauagagcccaauuaaguguuaaaguggaaguguuaagggagugagguguguaggggaggagcugaguuaaaaccaggaaaagagauuuaaugggaaggcuuauugaggagguagaacccgagggauucaauucacgguguuggacugcauauauaagggaauaaagcaggaugcaaaacugugcauacaacagugucccaguccuacacaaucacagacagagagagagagagaauauuucuagaagaaaauacaccaaaauacaguauuaauaacaguuaccuguggauucugagaucguggggcaaucugagauuucuucuauguguacuuuuauuucccaaaugcucugcaacaaacauacagcccucuuuuaacaauaaagccaacuaggaggugaaaaaguagagacagugagggcagccuauuuugucaggagcucaccuaacacuggaagaugagaaagcugagaccagaggggcacagaggauccugagcagauuucuuuagccccuuugggauugaagaaggagaaauggagguggguuuguagguuauagggaaggugcugccagcaaggaagagucugaaagugcagcagacaccagauggagcaagaccuuagccugggaggggacccgagaggaggggaagggccagggcacaguuggaaagccagcuuugcucacggcaagugucaccuguuccccaaaugcagauggagauacauugguggacacgugcagggcgugagcucuagccaacagauauacguuuuaugcuccucucccagugaacuuugugacggcccuaaugggaagcgucugucugucgccauguucugcccaugccugguguuuauggcaucccugacucaccagggcagaaaaugaggaagcaguccaaaggucacuggguaggagaggagagggaaacaccucaggaaggaggcggguuccaagcuugacgguuggugccccaggcagaaaggggacagggugaucugggaacagagacaagccccacagagcaggcagagagaagacgauggagggcaaaaccugagugcugccaacccgggguggcuugaggggcaacugaacuuccccccaaguccacuauguccuccaccagcucuugcaauacugaaacuuccaccauugacagaaggcacagaagcuccugcuaaaaugcaggugaugucugagaggcagggaagacacacuaagugacuuucucuaagucacuuuaaccuguggaguaauccaucucccuaacuagcuagugccccuuaucuaucaaacccaggaaaggaaugugagacaggaacauuuugagagaagcaagugagauuaggaacacagagguuggagacaagcaggggcagccuggaggaggaagaaaagcaggaaaggcaggauaggaaauggugaagccagucagccugcugcuaggggagguucagaagggucggcacccauucacuaacaccuauccagcaaacggcugcugggugccuguguccugggcacuaugccagacucuggggauacaacguggggcagggacagaugcaguugcugcucucacggcguucacuguuccagggaagucagaugguaauaaauaaauaaucauagaaauaaauguaaaaccaccauaguaacgagugucaugcauaugaugggaggauauaacagagagggugcccugaggaagggccuuuugagcugagauugaaauauaagcaggagugaaccuugagaaaauaggagaagagaugugagggaagggcaucaugcagaggucaggggguggcagaaggcgaggcauguuccagaaacuaacacaaaccaguguguagcuauggcaccagggagguuucuuggggguguaugauuccccauaugauauccuuuagccucccacugucaauccaaauaaacuuguccaaauacaggacaaguaaaaacagcauccuugucucauccaaguaguugaggacaaauccugcuauccacccuuucagccagauugccugcccccaccaagauccucuuacaagcaacucaaaucacaccauacauggccagugcagccagaaaugugggcugggccuggcgcuuaucggccaugacaacgauuugagucuuuauccuaauagucaugggaaguuauggaagggcuuuaagcagagguggugacauggucaugauuuuauuuuacaagaucauucuggcuccaggguggacagcaguuaggagaagggcaaacaggcucaggagacaagugaggcagcuguggcaguagcuuaggagaggcaguguggagcaugagguggcagaggaaauggagaaaaacgggcagauugaagaaaugcuggagagcuaaaaucaucacacaaagugaugaucugaauuuguaggugggggauaaagagaucaagggugauguggcgguuuuaaaaugugguccccaaauucuuuuaaacugcucucaacaaaagguguucuuauucucuccuuugaguuggguucugugacugcuucucaauagacuauggcagaagugaugcugggucaguuucugggcuuugcccuaagaaacuagcagcuuuaacuucuugucucuuuagauguuuacucuugaauccagccaucauguuaugaggaggcacaagcuugucuguggagaggccccuggagagaggaauuagacuauauaccagcuuguuagccagugagugcaccaccuuggaagugggucuuccaaugccgguuaagccaacccagcauaaagcauaaagcaaagacaagcugucccugccaaacaccauccaaauugcuaauuuaagaggaaaauaaaugauuauuauuguuuuaagucacuaaauguuggagugguuuauuacacagcaauagaaaauguaacagaugacugcuagguuucuggcuuucauuccugaauggacaguuugucauuuauugagagagagcucacugggaaagacccagguuuggggaaaaagaucaugaguuuuguuuucaguuugagaguuuucaguguuccacaaaucuaaguugagaagucaugugggcuguuggacuugugagacaauagcucaggagagauguuggguuugaagacagaaauuuauaagucagcugggaauggguggcaacuaaagcuuuggagguggagguggauguagagugacaauaggagagccugggacugagggugagggacucugacauuucauggcaggacagaggagaaugaggcugcuaaggagacauggaaacaucaaggccagagauguaggaggagaacaaggagaggaagucucaugggaaccaacaggacagaguguuucagaaaugcgggagagauuagccaggucaaacacugccaggauuacaaguacaugcugggccaggcacacuuuccccaggcuuccuggugaccagcaucacaauaggcagcaugguuguauuaccaaaaagcccugagaggggacucuggugggcaaaggcaagaugaggaucacaccugugcccaugaaccaauucuucccuauggccuugcuucucagacucuggucccuggaccaggaguaucauccccugggagcucauuagaaaugcagaaucucaggcccuacccuggacauaccgaaucaucugcauuuuaacaagauccccagaugacuuguaugcacacuaaugugggagaaugcauaccauugagcccccuaaauugagggaauuggacaguaaccggagaagcagcuggaugaugcaaaacugagcuaaaagucacaugcaguguauuagaggcaacuguucauuaaaccaacuuuuccuuaaguuccaauucgucucuacaccuagacugcacaucagaaucaccugaguaacuuuucaaaaaccagagagaaacccagauccuuccccucuggauucugacucagaagguaugggggagacugggcaucuguauuuucacuucccaggugacucugaugggcaaccaggguugagagccacuggccuaaacuauuagucuuccucuuuugaacaccuaaccuucuuagaccgaccauucauaacaucuuuucuccauugaggcugggacugagacuagaguaggacauuuuaauccugauugcgucucugacagggaggcaaugugauucauuccaggugcaugagcucuuccuacaagcacuggcuucugacuugugcucaggugccagcagguggggcccaggccccagcggggagccaggcuaauuuaggauuggaauggcaacaggacccagggccacagagcagauggugggcgggccgcuuaucuugcaguugcauuugcgggcugacaccaccccggcucuggcccaaauacuacccucuugagguccagggucucaucagaagugcacaucugaggcuaagccccuaaaccacauaucuuaggcuaggccacugcacagagcuuagacaugugacacugggcucagauaggccaucgugauagggcagaccccagggaccaacccacaccugugugauccacacgaacauggcacuucagagcagacaaguguagggcaccacauuuaggaaaaaucuuccugcugggauugugccucuaacaaagaugccagggaaggguucuaaaauggcacaaucagccucaaaaugucagcaacuugcaaacuugguucccuucaaaaacucuucauggaucaagcaccuguggguuuucugaaacuuuuuuauauggggggagaaaaaacauuuuuuucuagagagaagaaagcuuuuacaccuuucccagguuaaaguucuccugaguuuuucucauuuaacuuagaaaaacaaggaagcuuccucucauucuaggaaggugggguguguaaguaagugugugugugugugugagagauugggucuucaaagguuucacuggcucugagcagagcuguucagugacuuuugucuccuggagcuugccucuuuaugcaucccuuuucaugcagcggcacauugcagcacaucaaaucuuucaugaagucugguggcugaaaaaaaauccuggaauggaagugccuugauuuugugcacacauuggagcauuuucucuaacagccuuguggagggggcagcgcauggcggcuuuuuuggugauaacuuaggguucauccacagugaccucugacucccuuucuuggcacgugucugccaucucagagcucucggauaauuggucaccaaagucuacuaauuuucuguaacuuacauucccccacaguaauaauaauaacugcacucauaacuggcauuuauugaguuguuauuaugugucaaguccucuucuaagauuuuuacaugugcaaacucauuuaguaccuauaauagcccuguuggggcacagugugaauuuuacaccccuccauuucagacuagaagacugugcaagaagacuuuagcaaagugaagccauuugcccacaccauagucaguuaagaggcacuggggucagcccccuuugguccccugggauggcaguggaguguuaggagggacggguggaacauuucccaggcauggaggucuguuuugucacugacucuguuuagaauugucagcacaugauaaucauaaaaagcagaccaacgguggcucacaccuguaaucccagcacuuugggaggcugaggcgggcuuauugcgaggucaagaguucaagaccagucuggccagcauggugaaacccugucucuacuaaaaauacaaaaaauuagcugggcaugguggugcaugccuguaaucccagcuacuagggaggcugaggcaggagaauuucuugaaccugggaggcggagguugcagugagcugagaucacaccacugcacuccagccugagcaagccagacucugucucacacacacacacacacacacaaagcagaccaacuuuuagucgguuuuaugauugcuuuuaaacucccuacuuuaaaagcacggccuugcguuugugcccccugcauggaaccuuaugaauagcuucugcuuccuccaacaccacuugagucuugaggcccauucaucagugcagugcuucccugcccaggucuuagcagaaucaauuccucggaaaggucagaugggaagagaaagaagagaaaagcccaguaaguccucuggaacccaagucaagcuccaccuccuccaggaagccuuuccuaaugucccugcuccuaacugggucucccuuaccugcgcaaaggaagaggugguauccucucaugaggcaugguggggagggccgccugguugcuuuuggucgaccuuugaaggucuuccuugcucaccugcaguggcaauggcuauuucacuauuugguaaacucuguuuauauaccucaagucgaccaccaagccuggcuucuccugccccacugcucuggccccuucuuccucuuaauguaagauauggaggaagaaaaguuggugggcacgugauucugugcugggcaggcuguggugggagggauggggcggagguagaagacacuucaucagugugucugaaaacaugcccaagacucguucugcugggugaguuccccaggggucacuugccuucucauaggaagaagcaaaauguccugcuccaggcaauucagaguuacggccacuuuucccuccaagcugggugagcaucuuguuuuaagaucguuuuucuaagccaaaauuucuuauuuuuauucaugcaugggucgcagccagucuacaaguguggggauauguguuggggguugggguggugcaggcauggaggagcuucuggcuuaccaggagaagaugggagaaucacuggcccagccagggaaggauggguauuuccuucagccucccucucucaggcccuggagcauccucccugccugaaucugauggcugagauaggcccacuuaugacuaaucauuccagacuccucacuucuauggcaccugcacaaacuaugugcucaguaaagaguuguuuggauaaaggaaugagccaaccaguccaucuugguggaugaugaggggcuuucugccuucagucagaugaacuugagccagccugagagaaugaucuuacccagaucuuccuccaaaccgugugauccagcccuuccccagcagcaggcugcccuucccucgagagccccaaggccagguguugagagaaaagcaugucuagggccugggagaaccagaaugagcuguaggccccguggcccggggcuuuccuguguaugcuaaaaagugagcucuaaaccagucuccugguuuccacuuccccaggcuuggugcuccugaguuuccugguauagcucuucuccuccccguugcagcuggauccuggaagcccucaacagugucugaauugcaaggugauggccaaauacacuaaaccaaagauauuccuaaacuuugccaaacccugcgucucucaacuuccuucucuccauucuauuuccuuccaaugcccagcaaaaugguugguaccuuaaugccaagacuuucauucuaacccuuagacacuccauagguccccacagaacacugugcuauuaagcacuugauguggauucaaccauauacucaugaaugucugauuuuguucugggagguuucccucccagagggaaaugcucagagucccagaauuuucaaugaccagggucccagaaguggcaaggagcuuuggccuuuggaaaagacccaucuaguuuguuguuuguuuuuaggguuugaaucuucucuugcucugugaaugauacgggauaaguugcauugucucuucugccucaguuuccugucucuuucucugguuuuaacacaaacguuaauauacuagauaaugaacauaucuagauccacacauccuggauuuucuaggacaacuccgauuucaaauacuuuguccacauugucaaauccugugucugauccuauaaucuaauuugggauaagaaaauauggucuugagaguacuuugaauucuucauuucagcagugggcuagaauguuauuuacuaauauguaaauaaaaaccauucugauucugggcacugguccggaauguguaauucuggcccagcaggaacgcagcuguguugcuggaggcccuuccugggaaggcucugacagagccucuccuucagcccuagguccccaugucucacccaccccugggcacuggagagaaaaggggccuacucaccugcacagaguguccacaacacaggccacaucuuccccaccauggucuugcuucuucucugcccuaaaccuaaccugucacuggcagccuccagacaggucugagcugucugguuaaagcuacagcagcuucuggccuggcccaacuggaggucccugcaauuuucccucuucucacccaccucugcccagccucagcuggauuggcaggugagcuccucagcuggauuggcaggugagcuggggcugggcucaugugucaccuacuccaaaggucccaagaggagucuucccuacuucccucaaguuccccuuaaaccagccaccuccccugccuucucccuacuuaacaaguguacaaaguccuagacugcucacaaagggg

SEQ ID NO: 12939 - RNA, 3306 nt, Homo sapiens
ggccugaaauuugguaaauguuguuuuugauaauauuuugaaguucuaauuaaaggacuuuagaaaaccaauggauucaguuacauugcaaauagauucaguagauuuauuuuuuaaguacaaugaaauucaauacauuucaaaguuuuauaaauaaauaguugaguuuuuguuuauuuuuuccuuuccagacugugauucugguccuuguucacaagugcuuuugcaaaaagcuacuuaggccacuuuaggaaauuagaaagcugugacuagauacccccauuuguauuuuugggcuggggccagaguauaaguagaggcccacagguauaaguacagcacacccuccucuucuuuccauacuuccaaaaugcuggccuagccacucauggacacauaccccuggaaaacuuuuuugggagaggggaagaggucugcccaagugcuggaaguaggcuuggugcuacuugagcaggaucuuccagguuccuaaaugagcaugggcuaagucaggggguauauggauacuagguacagguuuccccuugacuauucaacuauucuguggacuuccugcucuguggggaggggcacagccaaaggaggccagaaugcagugccucuacagcauauggcaguacuggcucugaagguccaucuuaggacugggccagcaguaaggaagaugcugugaucuauggcuucugucucucuuuuucuguuuuuggcuuaacaugucuaggaucaacacagcucaucacagaauuauaaaggaagaagaaaacauuugaacaaggaugaugauguacuaggaggaggccagcaacagagauccugaguucuggaaagccugccuuaggugcaacaauaacaaacuuguucuccuauuccaagaacagagcauguaggaaccucccucucuguaagcaaguaggcuucaaacuggagccaaugccugcugagcuaagaauacaaacaccacuaguucaggcuuacaacccacccuggacagcaaugaggcaggaguuuccuggagccuagggucucagcccuuaacaggauucucuuccugucuaaaacagaguaacacaaaaagcucuaucaugccugauuuugucccugcagauaacaacaccaucucagaacucagcucccuacaugaggaggacagcaauuuccgccagucuuuccaucagaugagaagcaagcaguucccugugucuggggacuuggagagcaauccugacuauuggucaggugucaugggaggcagcaguggggcaagccgcgggcccucagccauggaguauaacaaagaggaucgagagagcuucaggcacaggugauggcugugaggggcaggucuggucggugugagggggcaggagcuggaaggcaggguagaucggaggcaaggaagaugccauccaguagcaucucugucucccauuccagguuauccugacacaucucucuuucuacaggauauugaacaucucacauuugucaagacagggaacacuugugacaacauguguagaaguaauuauucaagaccuuugaaauggguccccuagacccuuuaaugaacauuaauauaucucugcccuucucauauauuuuauccuauaaccucuacaaaaucccacccaucaucuccaucuuuuuuuuguuuuuuucgguagagacaggguuuugccacguugacagacuggucuugaacuccugagcucaagcgauccacccaccuuggccucccaaagugcugggauuacaggcaugagccaucaugccuggccaucucccucauuuuugaucauuuaguauaugaaagguaaaaugccaaacacuucucuuacauuuaauucucauaacucuaaagggcagcuacuauuaaugccccuauuuuaagcugggaaaauggaaacuucuaggugcuaaggcacuuacccaggugauguggccucccacaacaauugugggaggcuaagauuugcuauucccccuaaauagcaccuucaccacucaucuguccuuuaccuuaaaagacagugaacauugccuuucccuuacaaauugcaaguguccuucuccccuccugccccaguagguaacuuggcccuuggcucugagggaagaaaaggccucucugugugucaccacacauuacagggacuccugggaccauaacuguguguacugacaccugcgcuggcuuugaggguggagacguguggcugucaacccgaggucacaacauaaugaccagaaggcagccccacggugggucaguauuccauaggauacagaauauguucuauccacacaaccccauuuugaugcguggcacacgaguggaauagacucgguugccccuacuugacguucuggggugugagaggagccuggaaugcuucauccagccuggagcggagcugaggcucaggccgaggucuccugagcguggccccaggacacgaugggugcucuugggagcccuaccuggagcuccagggagggaccggccgucugacccccuccuucucugcccgcagccagccgcgcuccaagucggagaugcugucgcggaagaacuucgccacgggggugccggccguuuccauggacgagcuggcggccuucgcugacuccuacggccagcggccccgccgggcagacggcaacagucacgaggcgcggggcgggagccgcuucgagcgcucggagucgcgggcgcacagcggcuucuaccaggacgacuccuuggaggaguacuacggucagcgcagccgcagccgcgagccccugaccgaugcugaccgcggcugggccuucagccccgcgcgccgcagacccgccgaggacgcgcaccugccgcggcuggugagccgcacgccaggcaccgcacccaaauacgaccacucguaccugggcagcgcgcgggagcgccaggcgcggcccgagggcgccagccgcgguggcagccuggagacgccauccaagcggagcgcgcagcucggcccgcgcagcgccuccuacuacgcuuggucgccgcccggcaccuacaaggccggcucgucgcaggacgaccaggaggacgcguccgacgacgcgcugccgcccuacagcgagcuggagcugacccgcggcccguccuaccgcggccgcgaccugcccuaccacagcaacucggagaagaagaggaaaaaggagcccgccaagaaaaccgugagacugcgucugccuccccuccuccgaggggacugagcgggagccuccaggcagggcgagcagugucgcugucug

SEQ ID NO: 12940 - RNA, 3306 nt, Homo sapiens
cagacagcgacacugcucgcccugccuggaggcucccgcucaguccccucggaggaggggaggcagacgcagucucacgguuuucuuggcgggcuccuuuuuccucuucuucuccgaguugcugugguagggcaggucgcggccgcgguaggacgggccgcgggucagcuccagcucgcuguagggcggcagcgcgucgucggacgcguccuccuggucguccugcgacgagccggccuuguaggugccgggcggcgaccaagcguaguaggaggcgcugcgcgggccgagcugcgcgcuccgcuuggauggcgucuccaggcugccaccgcggcuggcgcccucgggccgcgccuggcgcucccgcgcgcugcccagguacgaguggucguauuugggugcggugccuggcgugcggcucaccagccgcggcaggugcgcguccucggcgggucugcggcgcgcggggcugaaggcccagccgcggucagcaucggucaggggcucgcggcugcggcugcgcugaccguaguacuccuccaaggagucguccugguagaagccgcugugcgcccgcgacuccgagcgcucgaagcggcucccgccccgcgccucgugacuguugccgucugcccggcggggccgcuggccguaggagucagcgaaggccgccagcucguccauggaaacggccggcacccccguggcgaaguucuuccgcgacagcaucuccgacuuggagcgcggcuggcugcgggcagagaaggagggggucagacggccggucccucccuggagcuccagguagggcucccaagagcacccaucguguccuggggccacgcucaggagaccucggccugagccucagcuccgcuccaggcuggaugaagcauuccaggcuccucucacaccccagaacgucaaguaggggcaaccgagucuauuccacucgugugccacgcaucaaaaugggguuguguggauagaacauauucuguauccuauggaauacugacccaccguggggcugccuucuggucauuauguugugaccucggguugacagccacacgucuccacccucaaagccagcgcaggugucaguacacacaguuauggucccaggagucccuguaauguguggugacacacagagaggccuuuucuucccucagagccaagggccaaguuaccuacuggggcaggaggggagaaggacacuugcaauuuguaagggaaaggcaauguucacugucuuuuaagguaaaggacagaugaguggugaaggugcuauuuagggggaauagcaaaucuuagccucccacaauuguugugggaggccacaucaccuggguaagugccuuagcaccuagaaguuuccauuuucccagcuuaaaauaggggcauuaauaguagcugcccuuuagaguuaugagaauuaaauguaagagaaguguuuggcauuuuaccuuucauauacuaaaugaucaaaaaugagggagauggccaggcaugauggcucaugccuguaaucccagcacuuugggaggccaagguggguggaucgcuugagcucaggaguucaagaccagucugucaacguggcaaaacccugucucuaccgaaaaaaacaaaaaaaagauggagaugaugggugggauuuuguagagguuauaggauaaaauauaugagaagggcagagauauauuaauguucauuaaagggucuaggggacccauuucaaaggucuugaauaauuacuucuacacauguugucacaaguguucccugucuugacaaaugugagauguucaauauccuguagaaagagagaugugucaggauaaccuggaaugggagacagagaugcuacuggauggcaucuuccuugccuccgaucuacccugccuuccagcuccugcccccucacaccgaccagaccugccccucacagccaucaccugugccugaagcucucucgauccucuuuguuauacuccauggcugagggcccgcggcuugccccacugcugccucccaugacaccugaccaauagucaggauugcucuccaaguccccagacacagggaacugcuugcuucucaucugauggaaagacuggcggaaauugcuguccuccucauguagggagcugaguucugagaugguguuguuaucugcagggacaaaaucaggcaugauagagcuuuuuguguuacucuguuuuagacaggaagagaauccuguuaagggcugagacccuaggcuccaggaaacuccugccucauugcuguccaggguggguuguaagccugaacuagugguguuuguauucuuagcucagcaggcauuggcuccaguuugaagccuacuugcuuacagagagggagguuccuacaugcucuguucuuggaauaggagaacaaguuuguuauuguugcaccuaaggcaggcuuuccagaacucaggaucucuguugcuggccuccuccuaguacaucaucauccuuguucaaauguuuucuucuuccuuuauaauucugugaugagcuguguugauccuagacauguuaagccaaaaacagaaaaagagagacagaagccauagaucacagcaucuuccuuacugcuggcccaguccuaagauggaccuucagagccaguacugccauaugcuguagaggcacugcauucuggccuccuuuggcugugccccuccccacagagcaggaaguccacagaauaguugaauagucaaggggaaaccuguaccuaguauccauauacccccugacuuagcccaugcucauuuaggaaccuggaagauccugcucaaguagcaccaagccuacuuccagcacuugggcagaccucuuccccucucccaaaaaaguuuuccagggguauguguccaugaguggcuaggccagcauuuuggaaguauggaaagaagaggagggugugcuguacuuauaccugugggccucuacuuauacucuggccccagcccaaaaauacaaauggggguaucuagucacagcuuucuaauuuccuaaaguggccuaaguagcuuuuugcaaaagcacuugugaacaaggaccagaaucacagucuggaaaggaaaaaauaaacaaaaacucaacuauuuauuuauaaaacuuugaaauguauugaauuucauuguacuuaaaaaauaaaucuacugaaucuauuugcaauguaacugaauccauugguuuucuaaaguccuuuaauuagaacuucaaaauauuaucaaaaacaacauuuaccaaauuucaggcc

SEQ ID NO: 12941 - RNA, 3339 nt, Homo sapiens
acugaaaauagagcagaggcuucauuaaaguccaucaauaauuauaaauaaaagcugauuaaucaaucaucaaugaguguguuuacaucagcaugaugagguuucacagugcauucacugcauuagugaagccaggacuucuggguucuggcccuggcucugcccuuagcgacagugauucugugagcaagucccuuggcucccugguccaaagugugcucaucuauaaaauuauaugauaugcagggcuccucucugcuuuauggucucuguuuuugugaaaacaaagaccuaugagccauaaguugacuggaagcucaaagccauuagagucuagcaaggaaaaaccaagaagagauuuuuuuuuccuccaauaauuaaggcaggaaggucugcaaaugccuggacaguaauucguggagggccaaggguggaacgugaacucauuagcaggauguugaguaacacucagagaggaagagagggugaugggaagggaguccaacugaagacagaauuuuaaagagaauguaaaauagugcugcuaauuacgucauuuaaaaacugaacaacugaguguaauucuugcugaaguaauaagaaaacagucaggggaugcauaauaguuacaagaauauacgcuaauagacaaaaacaggauccccaacuaacuuaggacaacaaaccccaugugagcuaauagaagucagacggaaaacaguaccugaauuucaacccaaucucacuugaguacauagauuuuaaaguuauauaaaagacauacauaauaaguacucagaaaauauuuguugaauuauauuacauuuuuaaaaccucaggaauacuucacuauuuaaaaagucuaaccugaagaaaaugaaaaauaugacacaucucagaguaguuauuucuuuuaugaaaggauucacuacaaguauauuuuaaacauaaauauuuugccauuaaaaugguucuauuuacaaagauuuuucaccaacaaacauauauaaacaagauagaguuuagaauccaugcuuuauuuagcuuugcaucuauuuggccuaacacaauaucaggcacagacggauaucaggcaccaauggauaguuaaauaacuuucaguaagugaauacauauguuucgguuaucuauugcugcaaagaaaaccaccccacucuaaugacuuaaaaagacauucauguucuuaucucucacaguuccauagguuggcuaggcuccaugggaaguucuucuguagucuuacuuggguucucacauguacuuuccaugaaauggaaacucaaauagcauggagcuucuggaagcucaccugacaugcugggaugacuuggucucucucccucuuuguguauucucaggccucucccccucuauguggacucucuguguggucuuuccuguaggguagauagacuucuuacauucuuaggaaucccaaaaguacagaaucaagacuguacucagagcuugauucugcccagagcuggcuguguuccuucugccaucuuccauugauuaaagcaggccacagggccagcccagacucaguggguaagggagggacaggagggcaugaguaccaggaggcaugguucacugaggcauguuugaggugagccaccacaauuuucucuugcuuugggccccaacuucccacagggcagaaagcaggauuacagauaugcagcuacaaaugugcgccauuucugugacaaaggaaguaugacucagaggcagagcucgaaucccagagggugagaccaaaagcugagcagaaccacuucuaaagaacaaaagugagccuucaucaggaauaucccuugcuucaagucagaaaaauugggacaugugucaggcuggauuucagaauugcuaugaaucagugacugaucaucucuccuuuuuuccccucuuuuugaacaggaaagucaauugucauuuucuugucucauuuucaacuaacuaaauguuagugagugagauauagauacuuguccuuuucuuuccuugguccuugcaacugagaaaaugcacauaaggaacuucaucccaaaagccccauucugggacaugauuuagugcacaauauccuggacuucaagcugauaccauauuggaaugagauuugcaagggugaguguauuuuuuauauaggaaguucacgaaucaugaacagccacaggcaguagcucgucuccaaagauggcucccaaugagccacaccucuccauguucacacuuuuauugugaauucauuaaauuugggcuucccugagauuugauuuaauuaacaaaaauagcagaacugacauggugccaauuagaggcuuauguguuauaagccuggaagcuuccacguuuacauuuuuggagacccugcaccuccacauaagaagucuggcugcccuucugggaagaccacauugaaagaugaccuggagaggccacauggggagacacagguucuaagccuacaggaagagagaaagaggccccacugucccagcaaaccagccaagcuucuuucugacuaucccugccuaaaagaacccaagagagagggcaaaagaacugcccagcugagcccaaucaacucacagaacuauaaaauaagauaguuguguuuagccacuaaauuuuaggauaguuuacuaauguagcuacagauaacuaaaguggcaucaaugaaugaauaugggcaaauuauaucauuuaaggaaguuauauuuucaaacacuauccaaaaguuauuuucucuauucaagaaaugucuguugggccccuaaacuugucagcucagcccucucggguuuggaggaaaaaugguguuucuuuugccccauuuacauguuuucuccugaacaaugaggcuuagacauagaucugagaaaaaaaucuuuaguuggaagcugggagcuuccauaucauuggcucuagccuccucuggccuuaagagaggcugucgugaugcaauagcggcaggaagcaguugcagauucucaggggagacauaacaugaugaaggugguguucaggaagguucauuuggcagcagagcacagauggguuauagggagugugaugcaagcugaccugaguccaaaccagggcagauagaaaagaaaagaacuugaauaacuacagaaaauaaaagagaaagggcugaagauuacucagacugggagaauaacgguaccacuaacauaaauauguaagaaugugagacauuuggaaaaggaguugugugugggaauaauugauccacccagaguuggacuuaugcauuuggacaagaagacaacugaacagaaccaucuu

SEQ ID NO: 12942 - RNA, 36565 nt, Homo sapiens
gaaguccucuucccgccuggagacugugugggguauggcggggugguggggagaauguggugucuugcuccacccuccuggcgaggggagggccuggccuggaccgcagaggaaucgagugacugccccuaaaaucuccuagaaccgaucccgcggccccgccccucccgcggccccgccccucccgcggcccgucagccucugccgcggagcugcguccgccacucauguuucuccgagcaggccuggccgcgcucuccccgcuucuucgcagucuucggcccucuccugucgccgccaugagcacuggcaccuucgucgugucgcagccgcucaauuaccgcggcggggcccgcguggagccggcggacgccuccgguaccgagaaagcuuucgagccagcaaccgguaacugcaacgagccggggaggcuggggcgcccuggggccggaugcgcggauuucccggccagcccccguuuccuguguucugcagcguugacuugagcacaagacagugacaguggagagucuaagguuguguguguaggcaacuagcgauucuggggcaacgcgagugccuccgggcagggauggguagggaggaaaagcaaagcugaugaguugcgugguaggaucgugaguuguuuuacccgggccagaacagaguucgcaaaguacuggugggggaagucgugccucuguuaacuuccuuuuuuguuuguuuuguuuguuuguuuguuuuuuguuuguuuugagacagggucucacucugucgcccaggcuggagugcaggggcaccaucucagagcucacugcgcccucuaccuuacgggcucaagugcuucucccgccucagccucccugguagcugggauuacaggcucccaccaccauguccggcuaauuuuuguauuuuuaguagagacggguuuucagcauguuacucaggcuggucucgaacuccugagcuuaggugauccucccgccucagccucccaaagugcugggauuacagccgugagccaccaagcccagccaacuguucccccuuuuaaaaccaggacugauguauuauugucuucaaaugugugcauaggagaggaauucuaaaagaacggggcgggguuguggggaagauaaucauuugugcugggaaugaaggaacgcucacagauaguuucuaaugacuacgaaugaggacuuugucuccacauucuaauauuaaaauauuucugcacauuaaucagaauugggaaaggaaaaaaccccaccuuuauucaguacuuucuuccccagcuuuauugaaguauaauuaacaaauaaaaauuguauauacuuaagguguaaaacguguuguaauguauguauaccuugcaaaaugguuaccacggucaaucuaauuauccauugcuucugcauaguuaauggcuuuuuuuggauagugaaauauuuaagaucuauucuuuuagcaaauuucaaguauaugaugcaguauugguaaccauagucaccauggucuacgugagcucuccacaauuuauucaucuugcugaaauaaaacuuuuuaauccagugcuuaaugugugcuaagcacugugcuaggcacuggauuuacucugggaacucugaaggucacagagauaaggaagaaggggcuuuuuguuuugguuuuguguuguguuuauuuugcuggguuuuauggaauauauguggggagaaaaauguaaauauuuuguguaaaauguagccagagcaauaaaacugauuugcaggggacuggagaauuuaguauuugaccauccacacuaaaccacagagcagugacuuggcagagccagaaggcauuaucacaucucuucuuuauauaggaggaaacagcuucucuaccccgacuuaauccugauacaaaagaaagaaaaauugcucuuugcuuuaauugccuacagugugugugauccucagccaccgccuuuaccagcuggcuauucaaguuuguaacagaaauugcagauuugugaaaucucccuggaaagagucccaggaguucuugugaagaggauuugcugaguuggcaaacuuaaagaauucuuguugguagaggcaguacaguccuugggcuaugggccuagaaaaacugauuguuucauaauuugcaccagaauagggagagggaauaaagguggaauaagaaaaggaaaucugggaauuuuugagaaaaaaaaaauguuccuuuaggguugccuuauccugauauuacugcuuauuaacuauauuuaucaaguaucaaguaguaugauauaaccuacauagaauauagacaagggauuuacagucagaguuuauaacccaauagacugauuacuuuugacuuucauuuuacaagaccccugagauucugagauaauguuuaggaguguugcaaaacuuaaucagaaguuaauguuaguaaacucaacuguaaaauaguagagggcagggguucuuaacucuaaauccuugaugaguuuagggcaggggacaugacauuccuguaauucuguuauauguuuaaguagauuuuucuggagagaggucugcaacuuuuaucagacuccuaaugucaaugaccgcaaaauacaguuaagaacugcuaggccgggugugguggcucauggcuguaaucccagcacuuggggaggcagaggugggugaaucacuugaggucaggaauguaagaccagccuggccaacaugaugaaaucccgucucuacuaaaaauacaaaaauuagcugugugugguggcaggcgccuguaaucccagcuacucgggaggcugaggcaggagaauugcuggaacccaggaggcaaaaguugcagugagucaagaucgugccauugcacuccagccuggguaacaagagcgagacuccgucuuaaaaaacaaaaaaacaaaacaaaaaaaccugcuaguauagagauggucacuaaaucaaaccauacauaaaaacaagaaguuacgguagcccacgccuguaauuccggcacuucgggaggcugaggcgggugggucacaaggucaggagaucaagaccauccuggucaacauggugaaacccggucucuacuaaaaaauacaaaaaauuagcugggcguaguggcgugcacugguagucccagcuacucaggaggcugaggcaggggaaucgcuugaacucaggaggcagagguugcagugagccgagaucgcgccacugcacuccagccugggugacagagcaagacuccaucucaagaaaaaaaaaaaaaaaaaaaaaaagacuacuacuaagagaauauugauagauaauauuuuauuuaaauauguggcaacaauuugaguuaaaacugauguuuccgcucuuuauaggccgagugauagcuacuuucacauguucaggagaaaaggaaguaaauuuggcuguucaaaaugcaaaggcugcuuuuaaaauauggagucaaaaaucuggcauggagcguugccgaauccuuuuggaggcugccaggauaauaaggguauguuccaauuuauuuccuuccagaacucagacauugcucugagguuucuuugugauguuugcaguucgacuuuguugcaacauuaggccguaacguuuuuauaaaauggaaaaacauuuccacaugcucaccuuaguauauaaaacaaguuuuuguucaauacuucccaucuggauguuggcucuuggacaucuccuuuggcagguuuucauguuuguaaagcuuuguuuugaauuauaaugcacucuuuauagcucaucguccuuuuuuuauuuuuauuuuuuuuuuuuuuugagacggaaucuugcucugucgcccaggcuggagugcaguggagugaucucggcucacugcaaccuucgccucccgggcucaagcaauucuccugccucagcuucccaaguagcugggacuacaggugugugccaccaugccuggcuaauuuuuguauuuuucguagagauggauuucaccauguuggccaggcuggucuugaacuccugaccucaagugauccacccacaucggccucacaaaaugcugggauuacaggcgugagccacugugcccagccuuucuuucuuuuuaaaccaugugguuuacuuguuuccuuuuuauucuuuauuuugaugauucucaagucuaccuuucuuuuucagauuuguuuucagauaggguuuuaaguaucguuacuuuaauugggaagauuucauagauuuguagauguucccuuuaaaaaaaagagaguuaaacuuuuuuuuuacaucauaaauauauacaauuuuuauuugucaacuaaaaaaaauuguaaaaacaaguauuuaauacucaucgcaaaacauaaaaagccugcaaugcaaaggguuucugugguguaguaguuaccacgcuggccuaacacacggaagguccucuguuugaaacuugacggaaacaaaagguuucuuuuguuucccagaaucugaccaggcugccucuuccugggaguccagagcugcgaggaacaagugauaauccugccuccuuuuuuuuuuuuuuuuauacuuaaguucuaggguacauguacacaaugugcagguuugauacauagguauacaagugccauguugguuugcugcacccaucaacucaccauuuacauuagguauuucuccuaaugcuaucccucccccagccccccacccccuacggccccggugugugauguuccccacccuguguccaagugaucucauuguucaauucccaccuaugaaugagaacaugcaguguuugguuuucuguccuugugauaguuugcucagaaugaugguuuccagcuucauccaugucccugcaaaggacaugaacucauccuuuuuaauggcugcauaguauuccaugguauauaugugccacauuuucuuaauccagucuaucauugaugggcauuuggguugguuccaagucuuugcucuugugaauagugcugcaauaaacauacgugugcaugugucuuuauaguagcaugauuuauaauccuuugaguauauacccaguaaugggauggcugggucaaaugguauuucuaguucuagauauuugaggaaucgccacacugucuuccacaaugguugaacuaguuuacagucccaccaacaguguaaaaguguuccuauuucuccacaucaucuccagcaccuguuguuuccugacuuuuuaaugauugccauucuaacuggugugagaugguaucucauuguggguuugauuugcauuucucugauggccagugaugaugagcauuuuuucaugugucuuuuggcugcauaaaugucuuuuuuugagaagugucuguucauauccuuugcccacuuguugaugggguuguuuguuuuuucuuguaaauuuguuuaaguucauuguagauucuggauauuaacccucugucagauggguagauuacaaaaauuuucucccauucuguagguugccuguucacucugaugguaguuucuuuugcugugcagaagcucuuuaguuuacuuagaucccauuugucuauuuuggcuuuuguugccauugcuuuugguguuuuagucaugaaguccuugcccaugccuguguccugaaugguauugccuagguuuucuucuaggguuuuuaugguuuuaggucuaacauuuaagucuuuaauccaucuugaauuaauuuuuguauaagguguaaggaagggauccaguuucagcuuucuacauauggcuagccaguuuucccagcaccauuuauuaaauagggaauccuuuccucauuucuuguuuuucucagguuugucaaagaucagaugguuguagaugugugguauuauuucugagggcuccguucuguuccauuguucuauaucucuguuuugguaccaguaccaugcuguuuugguuacuguagccuuguaguauaguuugaagucagguagcaugaugccuccagcuguguucuuuuggcuuaggauugucuuggcaaugcaggcucuuuuuugguuccauaugaacuuuaaaauaguuuuuuccaauucugugaagaaagucauugguagcuugauggggauggcauuaaaucuauaaauuaccuugggcaguauggccauuuuugcgauauugauucuuccuauccaugagcauggaauguucuuucauuuguuuguguccucuuuuauuucauugagcagugguuuguaguucuccuugaagagguccuucacaucccuuguaaguuggauuccuggguauuuuauucucuuugaagcaauugugaaugggaguucacucaugauuuggcucuguguuugucuguuauugguguauaggaaugcuugugauuuuugcacauugauuuuguaucuugagacuuugcugaaguagcuuaucaccuuaaggagauuuugggcugagacaaugggguuuucuaaauauacaaucaugucaucugcaaacagggacaauuugacuuccuccuaauugaauacacuuuauuuuuuucuccugccugauugccuuggccagaacuuccaacacuauguugaauaggaguggugagagagggcauucaugucuugugccaguuuucaaagggaaugcuuccaguuuuugcccauucaguaugauauuggcuguggguuugucauaaauagcucuuauuauuuugagauaugucccaucaauaccuaguauauugagaguuuuuagcaugaagggcuguugaaauuugucgaaggccuuuucugcgucuguugagauagucgugguuuuugucuuugguucuguuuauaugauggauuacguuuauugauuuguguauguugaaccagccuugcaucccagggaugaagccaacuugaucaugguggauaagcuuuuugaugugcuacuggauucuguuugccaguauuuuauugaggauuuuugcaucgauguucaucagggauauuggucuaaaauucucuuuuuuuguuaugucuugguaucaggcugaugcuggccucauaaaaugaguuagggagguucccucuuuuucuaaugauuggaauaguuucagaaggaauaguaccagcucaucuuuguaucucugguagaauucaggguuuuuagcuucuuugugauggguucaaacaucauccuuuaccucagagaaguuuguuauuaccgaucuucugaagcuuacuucugucacuugucuaagucauucuccgugcagcuuuguuccauugcuggugaggagcugcgauccuuuggaggagaagaggcacucugguuuugagaauuuucagcuuuucuguucugguuucuccccaucuuugugguuuuaucuaccuuugguuuuugaugaugcugaccuacauaugggguuuugguguggauguccuuuuuguugauguugaugcuauuccuuucuguuaguuuuccuucuaauagucaggacccucagcugcaggucuguuggaguuugcuggagguccacuccagacccuguuugccuggguaucaccagcggaggcuguagaacagcaaauauugcagaacagcaaauguugcugccugauccuuccucuagaagcuuugucccagaagggcacccaccuguaugaggugucagucggccucgacugggaggugucucccaguuaggcuacuugggggucagggacccacuugaggaggcagucuguccauucucagaucucaaacuccaugcuggaagaaccacuacucuuuucaaagcugucagacagggacguuuaagucugcagaaguuuccgcugccuuuuguucagcuaugcccugccgccagaggugcaguuuacagaggcaggcaggccuccuugagcuguggugggcuccacucgguucgagcuuccuggcugcuuuguuuaccuagucaagccucaggaauggcagacgccccucccccagcuucacugccaccuucgcaguuccaucuuggacugcuguuauagcagugagcaaagcuccaugggugggggacccgccgagccagcugcaggauauaaucuccuggugugccguuugcuaagacuguuggaaaagcgcaguauuagggugggagugucccgauuucccagguaccaucugucacggcuucccuuggcuaggaaagggaauucccugaccccuugugcuucccaggugaaccaguccuaaugagaugaacccaguaccucuguuggaaaugcagaaaucaccgucuucugcauugaucacgcugggagaugcagaucggagcugcuccuauucggccaucuugauucuggacucugauaguuaaacuuuuuauagucuuaaagaucagaaguaccagauguucauuauagaaagaaaauucagaagagaauacaucaaaauaagaaucauggauagcugagugguaggucuguggugacuuuuugucauaaguauguuacgucagaaacugugacgggucugagaguuucccugcuuucaagaguguguguguauauguguauauauuacauacauauacauauaaaacacauauaauauacauauacauaauuauacacauauaagcuauguuauacacauagaauaauauauaaucuauauaauauacauauauucuauauuauaguuguaaauuacacaauuauguguaauauauguauauuuuauacauauauauauucuagcaagagacaugaggcuuuuuggaucacagagaaggaugguuuauuacagcaaaaugcagcagccauagcaauaccuuagcacuaauuucuguuuauuuauuauuauuuuuuuuuugugauggagucucacucugucacccaggcuggagugcaauggcacaaucuuggcucacugcaaccuccgccuccuggguucaagcgauucuccugccucagacuccugaauagcugggauuacaggcacaugacaccacgccuggcuauuuuuuguauuuuuaguagagacagaguuuccccauguuggccaggcucgucucaaacuccugaccuuaggugauccgccugccuuggccuuccaaagugcugggauuacaggcaugagccacugcauccggccuaguuuuuuuguuuucaaagcaccggucaccacggugagugaggggaugggaugagaaccaggugagaucccugugcaugcaggaaguugcaccaaaggagaagaacccuaaacuucugagauucauuuaaauagaaauuacuggcacaucugcccauccucuucucuggggagagagugagagagauugagauuacuuauuaagcaaaucuccaggguugagagggaagguaucacuaaguuuauuauccuggaguauaagcacauguuucaggaacaggaaguaaagagguuuacauuucuaaauuucuccagauuucuuuaucuuuagggagauacugucucugccuuucaaggccuuugcuauucaaucaacucgucaguguccuuugcuuggaaagcccugaccaugcagaaauaucaaaauauucauauagaauuuucucccaacgaaguauuuuccccguuauuaaaaauuuauuuuuaauucgauaaaccaaagauaacucaaagcagauaauuuauuauuuucauuugcccauuuuuuuuccugugaaugagcagcauuguagggcuguuaagaauuggcuccuuuauuguuaggaaaugacuuuuauugauccuggguaauaucuaauaauauuuuuugcucugaaaucuguugucugauacuaaauuucauuucuuuuuacuuuacccuccccuuuacuuuuccuuugauaccugugugguguuuuauuaaucaaaaacccacugcuuauuauuaaguguuuauuaaucaaaaacacuugucugaugaucgugcucugaaccugccuucaccccaauuuauuccauaacugaauagaucccacucugugaccacaccuacaaucauauuagcccucaguuuucuuuuaagugauuuuucuaguuaaucaagaucugcaguucuuuguucuuuuuugacagggucuugcucugucacccaggcuggagugcaguggcacaaucauggcucacuacagccucaaccuccugggcucaagggauccucuugccucagcuucccguauaugugcaccaccauaccuggcuaauuuuuguuuguauuuuuuguagagaugggguuacgccauguuucccaggcuggaauuuaaaaaaaaguauugcuguaaacaauuauuuuuuaaaauauuuuaagaauaagguaaaauauuucacauuuguccacauauuuaccauuucuggugcucauaagucauuuguguagacccagauaucugucugcugucauuuucucuucugcuagaaggaauuucuucagcauuucuuuucuguuuuguuuuguuuuuugagacaaggucucgcucugucuccccagcugaagcacaguaguggaaucauagcucacuauggccuugaccuucugggcucaaacgauccucccaccucagcguccugaguagcugggacuacagacucaugucaccacacuuggcuaauuuuuguauuuuuuguagagagcggguuuauucauguugcccaggauggucuugaucuccugggcucaagucauccuccugccucagcuucccaaagugcugggacuguacgugugugccacuguacccagccuagaauuaauuaauuucuuuucuuuucuuuucuuucucuuuuuuuuuugagaggagucucucucucucacccaggcuggaguacaguggcaugaucucggcucacugcaaccuccgccucccggguucaagugauucuccugccucagccucccgaguagcugggauuacaaaugugugccaccaugccuggcuaauuuuuguauuuuuaguagagaugggguuucaccauguuggccaggcuggucucaaacugcugaccuccagugauccgcccaccucggcuucccaaagugcugggauuacaggugugagccacugcaccccgccaggcuagcauuucuuauagugcaggucuguugguacucuuucagauucuguaugucuaaaaaagucuuucuuuugcauuaauuuuugaaugaauuguagguaaauaguuuuuucuuucaguacuuuaaagauguugcuccacugucuucugauuuguauuguuucagaagagaaauuuacugucauuuuuauuuuuguaucuuuguauguaauguacucccucuaccccccaccccuggcuguuuuaauauuuuucuccuuaucacugguuuuaagcaauuugauuaugaugucuuuuggugcaguuuucuucauauguauuuuuccugagguuuauugaucuucuuggaucuguaaauuuguuucauuuggaaaaaaaauuuggccaugauuucuuuaguuuuuuuuuuugcccccucuuccaucacuucuccuucagggccuccaauuacacauauauugggcugccugaagcuaucccacgucacugaugcucaguucauuuuccaguuuuuggguguguuuauggguuuuuuucuccuucugagccuucccucccacccccuguguguguguguuuuguuuucagguaauuucuauuguuaugacucaaguucaucggucuucuauaguguuuuaucugcuguuaaucucaucuaguguauuuucaucucuagauuaauuugggucuuuuauauauguguucuguggcucuccuuaacaugcuuauguuuuucugugccuucuugaacauacggaguauagcuaucauaacuuaauguucuugucuacuaguucuguuguguuauuucugaauguguuuuuauugguuaguuucgcuuccugguuaaauguuacgguuuucuacuuuuugcaugccugguaguuuuugaucacuagacauaugaucucuagugaaucacuagggcacauuauauugcugggugcuggauagucuuguacuuuaaaaaauauucuuaagcuuuguucugggacacagugaaguuacuuggaaucaguuugauccuuggaagauuugcuuuuagaucagcaaauuucgccauguuauucaauacccuucugacugcuuaacccugugauccggguguuaaugagguuuucucaccauggcuggugggaacaugaacuauaccuggcccugugugaguucuggggcuuuuuuuuuuaaaaaaaaaaacauuuucuucuuggguaguccuuuucccagucuuggguaguuuucucacacugguacucaaaggggaaucugcagauuucugggguucucuaucugugcagcucuuuucccuuccacacucagucuugaagaacuguagccacucaaaguucccuaaacucccacccuaucuucucaacucaugugucugcugggcgccaccuagcuuccuccucccugcucuguggccugaaaacuuucucuaggcaguagacuccagcaauuguagggcucaccucauugguucccuccuccagggaccacugccuugaguugcuuaaugucugaugucugaaaaugguucauguauuuuaucugguguuuuuaguuguuuaaggugggagaaugaaucuggucccuguuaauccaucuuggcuagaagcucauugauuccuaguggaaaugaacauuuuuuuccauauuuucucauuuuuacuuugaauccuuugguacuuauaccagauuguauagaucuugucugugagacccagucauuuuucaguuggagaccccuugugaaguagcuaucauuuggauuaaaaggggagggagaauguuacuuaaaacaaugacaaaacuaucuaaauaaagaagagauuguguauguagguuaucuucuugccuccagcccuggcccagguugguuugucuuguacagugccaccagagugguccuccuacagaagcacauuugaucaugguacauccuuggguaaaacuggccauggucccccuccuuaacauggcccucaggcccuguuucuccagccucgucuuuucucuucacacaccauaagacccagcucuccugcacuacugguccuuccucguuuaccauguguauacugucacaccucaugcuuuuacaaugccaugacgcugaguuuggugcuguucuuuuguuuuucuugccucuugugcuuacauguuuagcauuuaguggucuguacuguaauuuaucccucccucccuccauuuuuuccuucuggacaaggugauuguuguacauaauuguauuagcaaaagcaucuugagauguauauagcuauuuuaccuauuugagaaaugagaaaaugcucaaaaagguuaaauagcuugucuuagaucauauaacuaguaaguauaagagcuagucuguugggcuucaaagcuagacauuaagcccugcugagggguucgaagugaaagggagaagugagggaccuacucuuggcuucuaaucuuucaucccagugaacaccuggucaagucauauuguaaagcagggugauauagaggaggaacaggguugggaacaacacauguauuuccuaagaaauacuuguagcaguauguuguuauggugaacaauuuuaucuuaugguuacucuugcaauaguagcaggcagaaauuuuugucagagacaucuuugaugauccuuacguacuauaucagaagaucuccuaaugcucuuaguagauaacuuuuuuuuuguaaggauggagaauaauagaauaacacagaaaaaauuucccaaggccaucuaauuaacugaauuuucucugagaguugaaaccccaaaacagcccccaaaaccacuugccuauccauuauuuuaaaagagaaaaaaaucuccagaguaaaaguuucuauucucuuaguaaauguuccagggcuuagcagcgauagaaucacagauuacuuccuauuuguucacucuuacacuaaaguguaagcagaaccguguuucacuauugccaguguaauaucucuucccuguauuugaaauguucuguacugauucaucacuuuauucaaccgauuaaugcacuagccucucuagggccuaguuuccucuugaauucaagaaacaaaauuuaagcuacuuaugguugauuauaccuuuggaaaacuauuuuguguuaauuauacucaacaaacuuaagaauggggaauaauuuaugcuugguguaagaauugauguauguuuuccucuuaggguacccucuuucuagggucagcauacugggaaacaaguuaauugucaaaagguuguuuuguugaguguagagucaggaagggagaagguaaauuguugguuuaaaagagaguuuaauuuagaccagguuugaaugugaacagauuauccuuucugaaggaaaaugucuauucaaaaauugcaauauugauuuaaaaugugcugacuugcccuuuuagaaguaagcucuuaaagggguagacaggacugauacucuuuucccuaguaaugaauguagaaugaaugagucaaagcacuuuauaccucuggccuuuauaagaaauacagcguguccaaaucucacuauccaacuguccuuucuuguauuucauauugguuuucauauuccuacuuucaucuuuucugagcuuuguacuguggauagaugcuugaguuaguuucuguugcacuccauuuugcuucuggccagccuuacugcuuaucaguuuuauaaacagaauguuccuucuugucaguugcuuaaucuuuuauguauguucugauagucacccuauuauuuauuuuaaauuggacccauaauagcaacugccuacuucuuacauauucaauucuuuuauguccuuuagaccaaagaaaggcauuauuuagcuuucuuucuuaggucuaauuuccuaaaccuuuaagcucaucauuggaccaucuauugaauuucuuuauccuuaguaaguuguggagcccagaacuagaaacaguauuugaaaauaguauugauugaaugcuaaguauuagaaaauauuagaagagaauaugcugcaauucuuugggugacuuaaagugacgcauauuacaaccucuuaaaugcaauuguguguuagaauauuuuguauaauuucccuaagaacuguuuucucuuaccauauaugagcaaacauacauauuuacguacauguacguauuacauucauuuuccaaaaugaauuauucuuccacuugugagccauccauuuucucuccauucucuaccccucaccucuucaauaaauauacacuucaaaucagaaugggccugcccugugacuuucagagccucagagggcauggguucauuccugcccggucuugccccuucuuuuacuaacugaucuugaaauaaaguaguggucuuaaaucuuugucgauuaauuaacgagggaagaacagggcugcuguucagcuauaagccuuuaucucucuucuaaauguaacacugccauuucuuuucauuuaaagugaaagcuauuuuuaguuuuaaaaauugagcaguguguucuauuuaagcauuaauuacaucaagacauauuggaauaugucuuaaaucuagucuucugcuuuacccaaaggaacgggaggaugaaauugcuacuauggagugcaucaacaauggcaaguccaucuuugaggcccgcuuggacauugacauuuccuggcagugccuggaguauuaugcgggcuuggcugcauccauggcugguaaguccucaccuggugucugugaccagcugauaaugaggcagaagagcagggccuaguggugaagggcaaagauuuuggaauuaagacaaaccugggugaaagucuuggguuugucacuuucuaccuggguggccugggaauuacuuuaucuuuccuaaucuaaacuggagauaauaauuccuaccuucuuggguuaaggauuaaaugagauagugcauguaaagcaccuagcaugauaccugagcuuuagaccaaauugcugaaaaaccaguuuucauaagaaucgguuugucauauuuaccaguuuuaucuauuuagcaaacuuuuuuuugacaguguauaaaguuuucaacaauugauauuggaagguugguagggccuaggaagguugcaaggaacuuacaugcuuccccugcuguugaguguuccucucauuuccauuuuguuucaucuaagcuaucuaauagaggcucaguaaauucuuagagaguuguaaaaucaaguuagaugaacauguguuugaaggauaggcaggguucucuauguggagagaauacguggaagccaguggaagacugccuggaacaaauagaagaauggagacagggugagccugguguauugggagaaguggggaggcugcguugacuggaguacaagucagacugguacagauguuggugaaaucuuggggagcacagaccugcauccuccuuuacuccuguuuuccccauaggugaacacauccagcucccagguggaucguuugguuauaccagaagagaaccacuugggguaugugugggaauaggagcauggaacuaccccuuucagauugccucuuggaagucggcuccagcauuagccugugguaagaaugaauuaucccuccauuugagagccauucguucauucucucguucguucucuccccauucucuaccuuucaccucucuauaaacacacacuuuaaaucggaaggggccugcucugggauauucaaagccucagaggacauggcucguuccugcccugucuugccccucaaggagcuuauaguuaagguuguacacaaucaugucuagauauucucagguuuuauuuauuuaauuuuguauaugaaaagaaauuuaauuuuuucuuauuaaauugaauuagauuugugcuacuuauaaguucucuuccuuucuggacaagaauuuuaagguaggaguuagcacuuaggaguuugacuucauuuacgaagcagaagauaaacuccuuucuucauuugggucuuaagagaaaugauaagcaaggcuuugauaagcuucuuaucaaagaggagcuuuggcugauugacauaaaauaguuuucuuacaguauuuaaagagaagaaucuuugaggaaagaagacuaauuuuaucuuagaaaaaauuguaauguuagaaagcauuacuguuaggacauuauauugaaaugcagcuuuuguccuguugccauugcauguucuuguuuuagccuauuucucuuugagauacagcugugaaagaggaaaaauagucacuagcuuuaauagucaccagaauuaagucacuagcuuuggggacucucaucaagugaaccauucuggucuucaaugucaacuuuuauaaaauggagcuaaugauaccuacuucauacugcuguugaaaguguuaaaugagauaauauaugugaaaaggccuagauaugcaaaugugagacugggcaacuguaggguuugggaucuguuuaaugagagaaaccaagaugaaaaggacaagaguuguuuacuuauugauaugguuuggcuguguccccacccaaaucucaacuugaauuguaucacccagaauucccauguguugugggagggacccagggggagguaauugaaucaugggggcuggucuuucucaugcuauucuccugauagugaauaagucucaugagaucugauggguuuaucagggguuuccgcuuuugcugcugcuucauuuuucuccugccgccaauguaagaagugacuuucaccucccgccaugauucugaggccucccuagccauguggaacuguaaauccaauuaagccucuuucuguucccaguuucggguaugucuuuaucagcagcaugaaaacaaacuaauaugguuauuaauaacauuuuugauguaggauuugguuggggaagaggaaacaauuggaaucauuuuugaauuguccucuaguccuguuuucaggggaucacuggucuuagaaagucuuuuuauguuugugucuuggguuuaugcagguaaugccauggucuuuaaaccuucucccuuuacaccuguuucugcauugcuacuggcugaaaucuacagugaggcugguguaccuccugggcucuucaauguggugcagggaggggcugccacaggccaguuucugugucagcaucccgauguggccaaagucuccuucacuggaagugugcccacuggcaugaaggugaggacaaaaccaguauuggucaacacacauggcauuuggauguggcaaauccgguccuacccagaguauauuuuggaggcuucucuuuugauuuuaccuagccugaauugggaaugggaaggagauuuuauuaggcagaggugugaaauuuccuguaaaaguaugaagggggaaagggaguacacauggggugauuuguguuaggccagguagggguggaaauuaacagccccagccuaaggagaggaugugucuuaguggacaggggccugggcugccacuuguauuguuuagugacuuaauuucuuguauagaagaaaggauuuuuacucaggcuauuucagauccauuauuuugacauuaauuuguguucugaacucugucagccuuaaacacaguaacaauaacacaaaagaauuucuggcuaugacaauccugugaauugacaauauuuuuuauuuuuauuuuuuugagacagggucucacccuguugcccaggcuggauuauagugguguagucacagcuuacugcagccuucaacuccugggcucaggcaguccuccugcuucagccuccuaagaagcugagacuacagucaugugccacugugccuggcuaaguuucuuauuuuucuguagagauagggucuugcuauguugcccaggcugggacaauauuuuuuaaaugaacucccucuucuaaugucagugcaacucuguggauucucuucaguuuucuggaauagaauauuuuaauagccaaaaggcaaaggauauugacaagaauaaggcuacaggucacaaacaguucaagaugauuuuguagguucagggccuaguugacuuagcaugcaauauaauuuguguuaaaguucugaauaccuuguccuuguucugcaagaucauggagaugucagcuaaaggaaucaaaccuguuaccuuggaacuuggaggcaaaucuccacucaucaucuucucagacugugauaugaacaaugcuguaaagggggcgcugauggccaacuuccucacacaaggccagguauguaccugucccuggaagagguguaaaaggaaucucuacccccucauccaacaguguguuuuaaagcuuuuuguuuuacaauacuuucagacuuacagaaaaguugcacaaauaguacaaagaauucccauguaccuuugaaccagauuucucaaauauuaacauuuuaacagauucacuuuaucaucuucuuuaucugccuguacauacguaggcauauuaaguuuuucugaaccuugagaguaaauuguagacauaaggccccuaaccucuaaauauaaaguuccuaaaaacaagugcauucuuuuacauaagcacgguacacuuaguaaaauuaaaaaauuaacauugauauaguacuguuacugaaucuauagcccuuacucaaucuauagcccuuauucaaauuuugccacuuguuugacuaauguccucauaguaaaauagaacaaaaaugguuuuuuuuccggucuaggauccagucaaggaugaugcauugccuuuaguugucuugucuuuaaucuccuuuagcugagaacaguucuucaguuauucuugucuuucaggacguugacauuuugggagaacaggccauucauuuuguagaauguuccuuaguuugggucugucugauguuuucuguuagauucauauuaugaauuuuuggcaaaaauaccacaaacaugaugucauauccuacucaguggugauuuaacuuugaucacuugcuuuaagguaaguccucacuguaaaguuacuguuuuuuacuuugugguuaauaagaucuuguaggagguauuuugagacuauccuguuccucaucaaacuuucaugcaguaaauacuucuaucaccacugacgauucuugcugaaaacaauuuuuauuaugggguugcaaauggugauuuuccaauuccaucauuucuucuauauuuguucaccuucuacuguaagaaagaacuugcccuucaccccuguuuguuuuccauucauuuauuuauaucaguauggacccauggauucuuauuucauucuauguguuauaauccaauacuaucauuauuuauuuauuuuuuauuuuuauuuauuuacuuacuuauuuuuugagacggagucuagcucugucccccagacgguagugcaguggcacgaucucggcucacugcauccucugccucccagguuuaagcgauucccccgccucagccuccugaguagcugggauuacaggugcccgccaccaugcccagcuaauuuuuguauuuuuaguagagacagaguuucacuguguuggccaggcuggucucaaacuccugacuucacaauccacccacguuggccucccaaagugcugggauuacaagugugagccacuguacccggccuuuauuuuauuuuuuuauugagacggagucucacucugucacccaggcuggagugcaguggcacgaucucagcucacugcaaccuccaccaccuggguucggguucaagugauucuccuguuucagccucccaaauagcugggacuacaggugugugccaccacggcuggcuaauuuuuuuuuuuuuuuuuuuuuugagacagagucuugcucugucgcccaggcuggaguacaguggugcgaucucggcucacugcaagcucugucuccuggguucaugccauucuucugccucagccucccaaguagcugagacuacaggcacccgccaccacgccuggcuaauuuuuuguguuuuuaguagagaugagguuuuaccauguuagccaggauggucuggaucuccugaccucaugauacaccugccuuggccucccaaagugcugggauuacaggcaugagccauuguacccagccucauuauuuauuuugaugcuaaaauaauugcagauggcuggugggaaucccuuuccgugaccuuuugauaugcccucauuauucuuugaauacuucauuacuuucuggcauagcaaaguguuccagacucauacuuccccuggcugugcucuggaaccagccauuucucugaaggaggccugguuccauuauuguuuaucuguuuauuauuaauuuuugagacaggguccugcucuguugcccaggccggagugcaguggugcuuucuuggcucacugcaaucucggccccuccaaggucaaacaauccucccaccucagucuccaguguagcacaccaccacauucagcuaauuuuuguauuuuuuguagagacgggguuucacuguguuggccaggcuggucuugaacuccugggcucaagugauccaaaugccucggccucccaaagugcugggauugcaggcaugugccaccgugcccggccuguuuuuuauuuuuuguaaacuuuuuuuuaugauuuagaaggacuaucuucaaaccaguacaaguauuucauaaauaauaucugauuguuuucuaaccaguugaguaauuuguugcacgauaagccaccucacaucuuucagcaagaaaaauacuaagucugaacaguaaagacauuacacaaugaguuaggacacaauuaaaaucugcuuuaaauauuuuuuugggggagaggacaccacacuucucuacuaaauaaagagaaacaauuuugcaguccagaggucuuuuauuuuuuuauaccuaucaugccaugaauucauagggaauagguuccagcagcucaggcuccuucccguugguucucacacagugggauucccuggguggaguaggcuggugcuucagcugaaaccagguaccuuucucuuuggcuuccuucuuuuucugaucaucuucuuucaugcauuucagaagcuaucuugggucuuagagcgcuuaaugugcucaaugugcacguuaauucucuuggcaagaauuuugcccuuaauuuguuuacagcagugccaacaacaugcuggguaacauuguagacucuuccaguuuuucccagguaaugcuuuugggcauuccuuuuugaauaguacccguucgcuugaugucuacaguauugccuuucuuauagauuugcaugcacguggcccaaggaacaacuccauguuuucuaaaaggccuagagaacauauauuggguaauucuucucuuucccuguguuugucguuuuggugaauuacuggaagacggcaguaccaaccaaaagcccugguuccauuuagugguaaaugguauuuagaaaccaagaucugagugccaggugugcuuguugcuacugguguaucauugcuucuaggcccucucagaggccagugcugggaaauacauguuuguauauaugucugugcacauaucuaguucuguaucugucugucuacauaauaauaaguucauccagauacuuuaauuauagucuaauaccacaggguucauuucugccuucucccuuuccauauuuguauuuguucucugacaguaagaaauuugacucccauuauccacaauguuuaucuaauugcucaucauagaauacacuuaguauucuaauaauaguaguuucagauuuguaaauccauaccucuguggaaaauaaaccuucuaauuagagcucagaauuuuuuuacaguuguuuuuauauucagcgugagaguauagucagaauacuguguucaaaaguuacuugggucaguucuaccuuuccuucacccuccuucagugugguuaugauacucauuuaaaauaacagauucauuuguuuguguuuguauucauuuggguuuuauuucccccauccuugcugauuuuaaaauuuuauuuugauuaggcaaaacacaaacaugguucuaaacaucagaauuuuacaaaaacagauacucagaaguguuacugcuccccauccuguguacucuguuuccagugccuccuucccacccaguuuuguccaucuccuguggguagccagucugauuuguuucugguuuuugcuuccuguguuucuuuuuccacaaaugaauagguacuuguauauuucuuauucuucuuucauacacaaaagguagcacauuagagguacucuuuuguacuuugcuuucuuugcuauguguguguguggaugaauauacacacacaaagaauacauauaguauagaauauauagaauaaauauauagaauauucuacauaaucuguacuauguauacuuuauauauauauagagagagagagagagcacuaaaaauaauugugacguaaugugaauuuauuuuauuauuauuauuuuuucgagauggagucucacucuguagcccaaguuggagugcagugacacgaucuugguucacugcaaccuucgccccuggagcucaagcgauucuccugccucacccucccaaguagcugggacuagaggcaugcgcuaccacacccaguuaauuuuuuuguauuuuuaguagagacaggguuucaccauguuggccaggcuggucuugaacuccugagcucaggcgauccacccgccucagccuuccaaagugugggauuauaggcgugagccaccacgccuggcaugagccaccaugcccagugugauuuuaaauauguaucacaauuuauccguucaucuggcaaugggguuauuuccuuaucuugguuauugugaauaaugcugcacugagcaugggagugcagauaugucuuuaagcuacugauuucauuuccuuugguauauacccagaagaggaauugcugaaucauaggaugguucuauuuuuaauuuuuuuuuuuuuuuuuuuugauucggagucucacuuaguugcccaggcuggagugcaauggcacgaucucagcucacugcaacuuccgccuccuggguucaagugauuuuccugccuuagccuccugaguagcugggauuacaggcaugugccaccacgccugacuaauuuuguauuuuuaguagagacgggguuucuccauguuggccaggcuggucucgaacuccugaccucaggugaucugcccaccucggccucccaaagugcugggauugcaggcaugagccgcuguucccugccaauuuuuaauuuuuuaaagagccccuauccuguuuuccuucauggcuauacuaacuuacauucuuuuuuuuuuuuuuuuuuuuuuuuuuagugaaaggaaguuuauuaagaaaguaaaggaauaaagaaugccuacuccauaggcagagcugccccaggggcugcugguugccccuuuuugugguuauuucuugaucguaugcuaaacaagggguggguuauucaugccuccucauuuuagaccauauaggguaaaaugacguugccauggcauuuguaaacugucauggugcugauggguaugucuuuuagcauguugaugcauuauaauuagcauauaaugagcagcaaugacgaccagcggucacucaucaccaucuugguuuuggugggucuuagcuggcuucuuuaccacagcuuguuuuaucagcaaggucuuuaugaccuguaucuugugcugaucuccuaucuuauccugugacuuagaaugucuaacuucuugggaaugcaguccaguacgucccagccuuauuuuacccagccccuacuuaagaugaaguugcucuaguucaaacaccugugacauuuccccucucccuuuuauaaaagaacccuuaauccuaaggguugcagagggacaaagauccaucuucuguaaacuuuuucaugcugaauaggggcaaugauauuccugucuaauuauuagggucucuuguauucaggauagagaggagcucagucagaaagcgucagggugagggucgcuuauaacucugaguuccgacaaaaggugauauccagaguuggccaaucagugcugcagucuauuucuuuugggucgggaggaucuccucaguauugucccuuccaugguuugccagaaagauguuacugcaaaggggcccugauccagaccccaagagaggguucuuggaucuugugcaagaaagaauucaggacaaguccauaaagugaaaguaaguuuauuaagaaaguaaaggaauaaagaauggcuacuccauaggcagagcagccuauacuaauuuauauucucaccagcaguauaccaagauuuccuuuucuccgcauccucaccaacacuuguuaucuuuuaucuuuuugauaauaaccaugcuaacagauaugaagugauaccucauugugauuuugauuugcauuuuccugaugauuagugauguggagcaucuuuucauaaacuuguuggccauuuguauguuucuggaaauaugucuauccaggucuuuugcccauucguaaucagagguuuuuuuuuuuuuuuuuugcaauugaauagugugaguuccuuauauauugugaugauuuuuuuguguguaugguaaagccuaauguaaaauuuaccaauuuaaccguguguguguguguguguguguguguguguguguguguguguuuguauuuuuuuuauuuuuuauuuuuuuauuuuuuggagacaggaucuuacucuguugcucaggcuggaguacagugacaucaucccagcucacugcagccucaaccucccaagcucaagugauauucccacuucagccuccuggguagcugggacuauaggcauguggcaccaugccuggcuaauuuuuguauuuuuuguagagaugagauuucgccauguugcccaugcuggucuugaacuccugagcucaagcaauucuccugcuucagccucccaaggugcuggaacuacaggcgugagccaccacaccuggccuuuuugaaccauuuuuaaguguagaguucagugacauuuaauacauucacguuguguacaacuaucaucauuauucaucucuagaacuuuuucaucaccccacauugaaaacuguguaccccauuaaauaauaacucuguuucucucuccccucagccucugguaaccacuagucuaauucccgucucuaugaauuugacuauucuacguaccuuuuauaaaugcaaucauacaauauuuauuauuuuaugucuggcucguuucacuuaguauaauaucuucagguucauccauguuguagcaugugucaaaauuucuuuccuuuuuaaggcuaaauaauauuccauuguauguauguauacacacacagcacacauacacacacacacagcacacacauaccacauuuuguuuauccauuuuuuuauuugugaacacuuaggugguuuccacuuuuggcuguugugaauaauguugcuaugaacauugauguacagauaucuauaguagaaguaucugcuuucaguucuuuuggguauauauccagaaguggaauaaguggaucauaugauaauucaguguuuaauuuuuugaggaaccacuguacugugcccuacaauggcagcaccauuuuacauuucuacaagcaaugcacaaaguuuccaauuucucuacauccuugccaacacauguuauuuucuuauuuucuugcuuucucuguuuuugauaauagucauccuauuggguaugaagugguaucucauugugguuuugauuugcauuucccugauuauuagugauauugacugcauauguaauuuuauaagauauugccaaaucccucucuaaaaggaaauguugcauucuuuuuuuuuuguuuguuaguuaagcaauuauuuuauugcucaaguacauagacaaauuuaugcaaccagggcagaggcuguauaugauucauauuuccaguugggagagaggacucacuuggucuuauaauaucgagccaaacagugaauccggcucucuaucagaaucagacagaauuuagcauccucauccuuucucuuccucucaagaagcuuuugaacagcaacugcugccuuaauuaaaugguagagaucuucagggagauuaggagcggucccuuagacuuaagaauucuuaagauuuuauugccugucacaaaucguacuugugcagcaucaugugaaucucucaggaucccaccgauuugugaaggagucaggcccuucuuggccaguuuuuaaaucugcuccuucaugucgucagaugucaacuucagccccuacuucagcaaccccacuucaguggggaugcugcagcgauagagcaaagcugacugagacagacccuucccagaagcgugcaugugacccaugauggcagcugucaggcagcaaaaggaacauucuuacuaacgaugcaugaguaccuauuucuucauagccuuucuuaacagcauauauagucacaauuuuaaauuuuuaucagauagaugagaagugguauuucaguauaguuuuaauuucaguuuguuuguuuguuuauuuauuuauuaucuuugagacggagucucgcucugucgcccaggcuggggugcaaugggacgaucucggcucacugcaaccuccaucucccacguugaacuaguucucccaccuuagccuccuauagcugggacuauaggugugcaccaccacacccagccaauuuuuuguauuuuuaguagagaugacgucuugccauguuggccagguugguuuugaacuacugaccucuagugauccaccugccucagccucccaaggugcugggauuacaggccugagccacuaugcccaaccuuguuuuacaauuaugaaugacauugaacgucuuuuucaaaacucacauauaauaaaauucacauuuuugguauguuauauuaugagauaugauuuuccauuaauuguuaagaguuuuuuaaaauuagugaugauagccuuuuaucugagguaaauguugcaaauaauuuuauuccaauuuuuuaauggucuuggcuuaguuuaagguauuugccaugcauaaaauuuuuauuuuucuauagucaaauuuaucaauuuuuuuucuuuaauugugucuagauuuuggguaauagaaaaccuuuuucuacaccuagguuuuagaggaauuaccaguauugucucuuuuuuuaaaaaaaaaaaagucucgcucucucaugcaggcuggagugcagugacgcagucaggguucacuguguguauccuugaccucuuaggcucaagugacccucccaccuuagccucccaaguagcugggacuacaggugcgugucaccacacccaacuaauuuuuauguuuuuuguagagaugggguuucaucauguugccccagcugauuuuggacuccugagcucaagugauccgcccaccuuguccucccaaagugcugggauuacagaugugagccacugcgcccugauuucuuauuuuauauuuugauuccugauacauuuggaguuuauuuuuauaugugauguaagauauguaucuuauuuuauguuuuccacauuacugaugauuuguucuagcaccauuuauuuaguucaucucuguccuaauaguuuagcuuucacuuuuaucauagacuagauuuccaugagcacuuggcuguguuuuuggacuuuucuguucuguguucuuacagcauuugaacaguuuuuauguuccuuucuauaggagggucuaaauagugauuauuagugauuucagagacaaauuuuuuaacaauuagauuuaagaccacaguucuugauauagguuuacuguuaaguucccuuccauucuuaaaauauacagccagauugagcccugauaugaggaaguaggagaggugcuguggguuauauggaucuaguaauggccuuuaaaaaauuuaaacaagcaaaauaagaacuaacuuuuaccucaaagggcagauuuugcuuguggagugguauguccacaauuacgugugugauccuucuuauucaguauggagacaauuuuuagaaauggaaauauccuuuuaaaaaauguauagugucucuuuucaguuuaaaguuuuuagauuguguucauuuuuccuuuucccuuuuuucuccuuacacacauagaaauugaugucuuguguuuguccuuuagguuugcuguaauggcacaagaguauuugugcagaaagaaauucuugauaaauuuacagaggaaguggugaaacagacccaaaggauuaaaauuggagauccccuucuggaagauacaaggauggguccacucaucaaccgaccacaccuggagcgaguccuuggguuugucaaaguggcaaaggagcagguaagaaauaauuggcaguagggugggguuggggaagauuauacuacuccuaaaucacaugcuuugugcccuuuucauguuaauauucguaugacuauuauucauuggacuauuagcaucccuggcuguguucugcuuuguaccugcacugggaagacuauguguuuguucgggauacaauuaacauuucaggaaugcauuuugggguuauauuuuuaauacaacauaucuuuuuuccuuuucggcagggugcuaaaguguuaugugguggagauauauauguaccugaagaucccaaauuaaaggauggauauuacaugagaccuuguguauuaaguauguccucuuuuuguuugcuuuuagaugauuugaauuaaauacugaauagauagagaugaauauuuauaaaauauguacaugauauaaagcaagggcuggcaaauuaugugguccuacuacccaaguuuaagaaguagaacugcuccauuaucuuugaagccuucugugugccccuccuuuagggcacccauauguauuaguuuauccaggaccacaacuauuguucuggaagcaaggagcucaaaaauaugaaagugcauauuugauuaaaaaaauuaauaaauuuaauuccuugagaaaauaaagaauguuuuucaugugaccuguagaucauuguauuagacauuuugcauugcuaugaaggaauaucuaagacuggguaaguagaaaagauguuuauuuggcucaugguucugcagacuguacaggaagcauggcaccaucaucuccuccuguugaggccucaggaagauuucagucaugguggaaggugaaaggggagcagacgagucacauggugaaagagagagcaagagaggcaccaggcucuuuuaaacagccagcucugugugaacucacagagugagaaugcacucauuaccauggggaggacaucaaaccguucaugagggauuugccccgugacccaaacaccucccacuaggcucuaccuccaacaauggggaucauacuucaacaugagauuuggaggagaaaggcauccagaccauaucagucaucaauauaauaaaaccaguaugucagauaauauacuaaucuuuuuagaaauuacauaauuuaauaauuuuuagcaccuccauucagucuuaaaaaucuaguuuugacagucaagguguauaugggcauccuacucccacccaucuacuucccuccuacuucagagguaacuacuauucucaguguuguuuuuaucauucuuaugcuuuucucuaucauuuuauaguguauguuaguauccccuacaaaaauguugauaguuuuguaggcuuuaaacaauuauauguagguugaaccauguuguauaauuccuuacaucuuauuuggagauaaauuaagcugguuuuugccccuaagguuaauaguggugucaguuuuuaacaacuucauauuugaugcaguauauaaccuuuaauccucacuagaaagaaccauugacauuuaaaagcugaaaaccuaauguccaucccccaugaauuagguugcaguuauuacaugaauauuuaauaaauaggaaaagcuuacaauacauuguuaaauuaaaaauauuggggcuaggugcaguggaacacccccagcacuuugggaggcugaggcaggaggaucgcuggagcccagguguuugagaccagacugggcaacauagugagacccgaucuucaaaaaauuagcugggggugguggugcacacuguggucccagcugcucaggagguuuuauuuuaauguuugcagcuaauugcagagacgacaugaccugugugaaggaagagaucuuugggccuguuauguccauuuuaucauuugacacugaagcugagguucuagaaagagccaaugauaccacuuuuggacuagcagcuggcgucuuuaccagguauguggagugggacacugagagcaguuuugaaggagcggggcugcaguaucugcuuagauauuuaauugauccuauucucucacuuuaguuugcccucauaggagccaucagcacuuucuguuugcuucagguuaagucagaagacaccaaagcagcauuuugcaguuugcuguaaauggccagagaacccugcuauugaguuuuaaauugagcucguuuaauaaacacuuaagauucugaucuauguaaagcauuggguuagaugucuuuugaaaacacacaugucaaggaauuuagaaaccuguaaguauauaaauugugggcaguauucuucaaaaacaugauuuuuaguggcauuauaguaguuccuaauuggaaugcauuauaacucauguagccauuuuuucugugguuggauauuugggauauuguuucuauuuuaaauauuauaguaauaugauuaauaucuuugugcauaaacuuuacuauuacaaguaaaaaugauuugggaguacaauuucuuugaaaccaauugcagauugcuugguuuuauacaaacuuugauuagucuuuggcaguggaaggcaguuugcuaaagcggcuuuacacuugggauuaugcuguuucuuuggugauacauaaaguucacauuuuuuuuuuuauaacuucauggucaagagcuugggaagaaagcccaagucucacuugaggaccugauguaauugcuucucuuugagcuccgaagaaaagauugaggagcugcucuuuugauuuggggagugagcagguuaagugcucuuacuuuacuuugccacccucguacagacaaaguccgguuacaaaggcggguaacuccaaugugcuauucuuuuuuucuuaccagcuuuacugggauaaugcacauacuguacaauucacccacuuaaaguguacaauucagugguuuuaguuuauucauggaguugugcaaccaucaccauaaucuauuuuuaggacacuuucaucaucucaagaagaaaccuugugcccauuaacuguugcucuucauucccacuccccacccccagccccuggcauccacuaaacuacuuucuaucuccauggauuugcccauucugaacauuuuauauaaauggaaucauacaguauauauucuuuugugacuggcuucuuucacuuagcauaauguuuucaagguucauuuguguuguggcauuuaucaguacuuuauucccaaauaauauuccgugguauggauauguaccacuuuuuguucguccauucaucuguuacaggcauuuggguuguuuucauuuuuggcuauuaugaauaaugaugcuaugaacauauguguacaggccuuuguguggacauauauuuucguuucuguuggguguauaucuaguagugaauugcuggguaacaugguaacuuuauguuuaacuuuuugaggaacugcuaaacucuuccaaauucgcagcaccauuuuacauuccuccgaacaacguaugaagguucuaauuuguccacauccucaccagcccuuguuauugucuguccuucugguuuuagccauccuugugggugugaaguaguaucucauugugguuuuuauuugcauuucuguggguuuucuuuucacuuucuugauagucuuauuuguagcacaaaauuuuaaauuuugaccaauucuaauucuguuuuuuuuaucuguuacuuuuggugucauagucuaagaaaucuuucccugacccacggucaugaagauuuauuccucuguuuucuucaaagaguuuuauaguucucagucugacauuuuuaggucugugaugcguuuaaguuaauuuuuguguaugguguaagaaagggcuccaccuuuauuuuuugcauguagauauccacuuguuucagcaccauuuguuaaaaagacuguuuuuccuccauugaauuuugguacccuuauugcuguuacuuauuuuaaagauaccaugugcaugggacuauaaaacccaauccauaucuguuuugccuggaugauaaaagauuuuaaaacauuuugaagaaaugagaauuuaguaagauuugagaacccuagaacuggcaguguaacuuuuccuguuaaaguaguagccuaagaaacucucaauaaugcacacauuuuuuuuuucuucauagggacauccaacgggcucauagagugguagcugagcuucaggcugggacgugcuucauuaacaacuauaacgucagcccaguggaguugcccuuugguggauauaagaagucaggugaggagcugggaggugugaaugcaaacuaggucucuagagcuaggucguaauucagaccuuauaaaccaguauuccuaaaccugucugcauaucugaauuaccuggggaaauacagguuccugguccuuccccagauccacuguagcagucucugggaauggaagucaagcaucuuccccuacccaacacucccuaaaucuuucuggaggguucugauguauagccuggcuugugaacugcugauagauaucucaaaaagguuuaucuuguggguagaauacuuuuucuucacagccugugacuucuguaagcauaaaaucacucccuuagggguucuguaucagggauguccaucaucauccacuguggaguuuuuagauuccauuuagguaaagugucuuucaaguaauagcucaguaacuuuguuuccucuguuaugucaaauuaacaaaaucuuuaaauuuaucauuaagcaaucaauuauaaucguuuucauuacccuugauggcauauaggaguguguuuccuuagccacugcucauucauuucauucauuuuauagucagacauauguuaccacaacauauaaauuuguaagucugguauaucaggagaagguuugaggcaucaggaguauagccagaaccuugagguucuuucuuuggaguuuguugccuguaaauauucauuuacauauuucucaugcuguucuucuagagugaaaauugguuuggacuuugucgaggcaccauucuaagagucugaccucuaguuucuguggcaaauauuuacagccaucacaguguuggcaaauauauaaacucugaugaacacugaugagaugguggguguuaauuugacagucuuauuugucccggugggguacucagaggagucguacacacagacacaagugcaggugggaaccaaggugccaucuuauuaacauguaacauauaacauuacauguuaaguuucugauagucccucagugcagggaauuauuuguuuggaaucagcagcuuaggccuuuggagggccuccuaacuuucccuuuccuuuggaccagaccaugcuauguggaaugagagagcgagaaagauggccagacgugcagagcaacaccuggccuaacaggccugaccagcugugugcuuaggggauuuggaaaggaacaaaagacagagugagguuuucccaggaccuuugugugugauaccauuugaguggugcucccuggaaaugcacauauuugggaccucggccuugcccuuggaaggcagagccuaccuaagucuagcacaggguguacaggcagggccaagggugggauacuacccuuuuagcacaguaaccucacccacuaguaauugggcagugucuugaacucugaguaaucagagggaccuucagugaccccucaccaacaugaguggguagguuaaguuacuagguugcucuuauagguguuuaagaaauggugaauaagccuauuguguaaaguuuuaaauuagcaucagcuuucaagggugucagguugauuauuguagagauugccuuuaacacuugauauaaaauccaagcauuuuucagaccucaacccagaauaguagauaccugaaauuaagauuccuauuggugagaaacaagaucuguauauuucccuaucccuauccccaaaugccagugggucauuuuccccaugccuagcuccauucacagcuaauauguggauugaggcuuuauuccaaaacauuuagguucuauauucuucccuagcccugauuagcagugcucaucuuugaagaucauugugacuuuucagacuauuguagugauggcucaaccugaccccuucuccuccuuucaggauuuggcagagagaacggccgugugacaaucgaauauuauucacagcugaagacuguguguguggagaugggugauguggaaucugcuuuuugaaaaccugcagugaaaccuauugacauggccacgcuguggaaugaugugaauuggcccuguuuacagaggcaguacaacugaauguuauuuuacauccagaauuuuggcguucaguauaagagaaugguucauguuacucuuucucucuccaucagcuuccucacugaaaaugugcauuaagugccuuguagauacuaaucaagaaagcugugauucuccucaaagcguauuuuugugaaaucuuuuaagagccaguaacauacuucuagagaacaggaaaagagacuaggauaauacaucuuccacacauuuggcccacugauaauguuaauucucuggcguauuucaaagaacuuguuccuggcugauccaagugcagugguauuuacaacuaauugaucacaaccaguuuguagauuucuuuguuccuucuccauucccacugcuucacuugccuagucuugaagaaaaaaaacaaaaaacaaaaaaaaaccuuguuccuuuauagguuccugguagaaucaguagagaugauuucagcucauugacauuuuuuuaagcuauauccccuugucauuccauugagaaagcugacaacugggauagggaggggauuagauaauagauggggucaaauucugugugaaugugaacuugccuaguaagcacuuugucucuguucacuacugcgauagaggaaaucuaucucccuaucuuggguccuugaacuacagccugcugucuuacaccaguggagcuacccuuuaaauguacaaauuauuuguaugcuaauguaauauggugaaauuaaaauaaaucacacuguuaa

SEQ ID NO: 12943 - RNA, 4877 nt, Homo sapiens
gcacccauucauuuucauugccauauuaaccugauuuggaggaauauaauaauuuugguuccauugcccuuuaccugcaauggugugguaagauuuaaggaaugcaauaauugauaaauaaguagagaauucaugaguuguuugugaagugcuuugaguuccuguggguuauguaaauaauuaaggcacuguauuuucuauaauaaauuaucucaggauucauaucuuauuucacaggauaucacugcauuucacucuuucaggcuaaaaaaaauguacgucuacuggucuuuaaguaaugggguaaucgaucgucgcucaugaggaaaguucucugguuguaucuuugccccaucugcaucucaaagauggcacuucucggaacuuagcagagugauccccagaggggaaaaaaggugcaggaauagauugucauaagauuauaacaccuaucccccaugauggcagaauaaggucaauagugucuuacccgaaggucuucuuaccucuaacagcucucuuucaaucucucaauuauugguggaaauugagauugcaauggguggaaaauucauccuuuuugguuuagguuguaguuucaacugcaucuucuacugaaacuuuugucauuaaguagguauugggguggguauaccucacacucugugcuaguucuggaccuucuacuaaguaguuauaagaccauagaaaaguugcuuaaauaauuuuaugauaaacuauaauaguagugguuaaggaccuggucuuuaaagccagacucucugaguuuguauccuagaucuuuuacuucuuaacugucuggccuuauucaaguuaaaaaaccucucugugccucauuuuccuuauuuauaaaaugcagaucauaaugguacuuaucuuagagggucgcugugagguuaaauaaggugauagauguaaauuacagugccuggcauagaguaaacagucaauagcugcuagcuguuauuauuucuggacuuguuuucuuauaugaaauagagaggcuuauaccagauggucccuaaagacaaagccaauuccaagacucugauuuuaugcugaaaagagacaaaaauugcugaauuuaagauuugcuuucuuuuuuuccuugcauuuuuuuuuuuuuuuuuuuuuuuuuugucaagagucucacucuaucucccagguuggagugcaguggcgugaucucggcccacugaaaccucuaucccuggguucaagcgauucuccugccucagccuccugaguagcugggauuccaggcauucaccagcuaaauuuuguguuuuacuagagacgagguuucgcccuguuggccaggcuggucucaaacuccugaucucaagugauccgccugccucggccucccagugcugguuuacagccguaagccaccaugccuggcccuguuucccuugcuauucucuuaaagugagaauuagcuauaucuggccaaaagucugggacagauuggaagaagagggggaaaagagaauggguaagaacagaggaaaaguuuuuaagcuacuuuaaaaacuuuuaaacuacaaacuggacaacaaccgcuugaaaagcuagaauugcauauuaaggaugguguuuucuuagcgucagcaacuggaggcauuguguaaucauaguuaaaaacauuucauuuucucucugaagauacauaagccuauccauucaacuugcaaaguuccaaagcaggaaaaguagcacaagugaguuuagggcaaccugaccuuuucuuuuucuuucuuuuuuuaaauuauacuuuaaguucuggaacacguguguggaacgugcagguuuguuacauagguauacacaugccauggugguuugcucuacccaucaacccgucaucuacauuagguguuucucuuaaugcucuccguccccuugucccccacccccugacaggccccagugugugauguuccccucccuguguccaugugcucucauuguccaacucccauuuaugagugagaacaugcgguguuugauuuucuguuccuguguuaauuugccgagagugaugguuuccagcuucauccaugucccugcaaagaacaugaacucauccuuuuuauggcuccauaguauuccaugguguauaugugccacauuuucuuuaugcagucuaucauugaugggcauuuugguugguuccaagucuuugcuauugugaauagugcugcaauaaacauaugugugcaugugucuuuauaguagaaugauuuauaauccuuuguguauauacgcagugaugggauugcugggucaaaugguauuucugguucuagauucuugaggaauugccacacugucuuccacaaugguugaauaauuugcacugucaccaacaguguaaaagaauuccuauuucuccauauccucuccagcaucuguuguuuccugacuuuuuaaggaucgccauucuaacuggugagagaugcuaucucauugugguuuugauuugcauuucucuaaugaccagugaugaugagcuuuuuuucauauauguuuguuggccacauaaaugucuucuuuugagaagugucuguucauauccuucacccacuguuugauagaagacaaccugaccuuuucuugcccuucuaguacauuccuuauuuaggaaaaauguuaucuuugucauaaggacagccuugauucauaguagauuuauucuucauuauuuuuauagcuuucuugaaauauauuucuaacaccaugaaauucacccauuuaaaugauauacaguuagguggcuuuuaguguauugacaaaguugugaacccauuaucacaaucuaauuuuagaacauuuuuaucagccuccuugcccccuaaaaaaacccaguacuuuuuaccaaucaguccauauuucccccuucaccuagucccugguaaccacuaaccuacuugcugucuuugugguuuuugccuauucuggacauuucacauaaauugaaucauaaaauauuugauguuuuuugacucauuucuucuguuuagcacguuuucgagggucauccauacuguagcaucuaucaguacuucauuuuucuuuauggccaaauacuauuccgcuguauggauauaccacauuuugcuuauucauuauucaguugcuacaguaacuuaaggaauggacuucaguuacuguucacuuagguuauuuccauuuuugacuauuaugaauaauacugcuaugaacauuugcuuacagguuuuuauguaugaauauauguuuucauuucucuggauaaggaguggaguugcuggcucgugauaacucuauguuuagauuuugagaaaaugccaaacgguuuuacagaguggcugcaguaggcacauuuuuuaaaaacagcuuuauugaggucuauuugauauacaaaaaucuguacauuguauauauauauauauauauauauauauauauauauauauauaugcuuuuuuuuuuuuuuuuaagauggugugucccaggcaggagugcaguagugcgaucuuggcucaccacaaucucugcuucccagguucaagcgauucuccugccucagccuccugaguagcugggauuacaggcaugggcuaccacacccagcugauuuuuguauuguuaguagagaugggauuucaccauguugaccaggcuggucucgaacuccugaccucaagugauccaccggccuuggucucccaaagugcuggaguuacaggugugaggcaccgcgcccagccugagcuaccacgcccagccugguguauucuuaagucauaguguaaauggcacuaaguuuugucuucagcacucucagcuuuucauucuuuucaaucucuuucuccauucaaugaugucuccucucuauguuuaggacucuacuguguuuauugucauguuuggucaauacacuaagaaaaaaaguuuuugauaaauuuauuugacuugaaguaugcaugaucaggauuuaugugaaaucucuguuagaacuauuugcauuuuaaagaggaaaaaaaguaagacaaaggaaugauucuccaauguuggaauuucagaugucagguuccuggagaggaaggcacuuuugaaaaagauuggagaauuuucugaauaguaaucuagugugacagagggagcauggacuuugagugaaaccauccuagcuuguguuaacauuagugagcuauuggauuuaacagagcuucaguguucucauuucuguggugaagauaauaauauguaugauguaggauggugggcuaaaaaagacacugauguaaagcacauaguucaaugaguaugcucaacuaguggccacuacuguuauuuuucugaaaccacaugacagaguguugaccaccuuucucaucaguuuggccuugucgguucagguugaguuuucuacuaccucuguccgggaguuuuagagguucacuaacaugcuuccugacccugcuuuuauguuaaaugguugucagugugagagaaauaaaagucucgggcaaaacgcagcaaaaggcaucuccacacuuucacaccccccuccccuacuucuagaguucuguggagagaaucucacagaacagugcuuuucagugaacaccuguaauuuuaaauuuaaugauuuacauuuucuaguagccucauuuuuaaaaaguaagaagaagcaggugaaauaaauuuuaauacuucuuauuuaacccaaauauaucuaaaaaucuuucaacauguaaucaauauaaaaauuauugagauauuuugcauucuuuuuuugugcuaaggccuugaaaugguaauguuaaauuuaaugauuuaaauuuuuuaguagccccauuuaaaaa

SEQ ID NO: 12944 - RNA, 2105 nt, Homo sapiens
cugagccgccgccgaggauucagcagccucccccuugagcccccucgcuucccgacguuccguuccccccugcccgccuucucccgccaccgccgccgccgccuuccgcaggccguuuccaccgaggaaaaggaaucguaucguauguccgcuauccagaaccuccacucuuucgguaagcuaugggaaaggucgcgggcccggguggggcagcggggccuuccgggcccggagacguguuccgggaaguugccaagcgcuccgggccuucguaagcucgggcaggggaaacuugaccagggucgcagggcagcgggaucaaggccugggccccggggucggacccugagcgcgaccggaaggagcaggcgguaggucagcccuugggcgggcccggcgucucaguggcgcauuuacuaauggcuccugggccuccucgggccacacccgccccucccgucaccauugcgucacguccguuacgucaccacccguugucacggauccggagggaaaggcggugccagcccuaaguggcaagcgggugcaccaaugggggugggaggcuuagccccgccucgggagcucggguuccggcggguugcaucagcuggguggggcaccgccuggcagcccggacucccccgacaugugaucggcuucccagggagggcgggaggcccgggcguuccccgagccuggggaagcuggccgucccggacugaccugcucggggagagccagcaaaggacacauucggccuggcccaagcccugacgauuucaguguuguuuucugcacgcgcaaaacaccuggggaccgaggggauggcaguggcauccuaucuuugacagcucugaacgagcuuaaccuuuuuuuucagaccccuuugcugaugcaaguaagggugaugaccugcuuccugcuggcacugaggauuauauccauauaagaauucaacagagaaacggcaggaagacccuuacuacuguccaagggaucgcugaugauuacgauaaaaagaaacuagugaaggcguuuaagaaaguaggucuucagugagauuuugggaaagucauaauggauuuguccacaagggggugccagcuguguuguauguauuguuagcggaaggggugauaaaugcguucaugcucuugcuaggccuaauucguuuuccuuugugcuugcagaaguuugccugcaaugguacuguaauugagcauccggaauauggagaaguaauucagcuacagggugaccaacgcaagaacauaugccaguuccucguagaggugaguucagucacuacuugauuugugccucucugcuggcaaaucucagauccugucuguuagcuucugcuggggacauaaaaguuggcuuuguaaggcugagcaaaaccucaguuggguuuuaaaguacauagacuuauuucuguuuuauaggaaaaagcagaagggacuugucuaccuuugguuuacuguuucuguggaucuacuucacagaugcaaauuugaauagcauauagaugcauuguaaaauaagccaaaugcuggguuguuccuguauuuguaaggacaugaguuuuuaaaaaugaauuuccugaguauuaauacuaaaauacuguuacaugaucagcucuugauauaauugaagagauuucagauaccugaugagucucauucucacacuaauucagaaccuuggaaggcacugaguguucaaaaaagguagcucuuaacugaggacccucuguugaaccauugugcgcaccccuggcucuugggcaguguaguagcaggaagacaggguuguugccauuagaaauggaggcuuuaacucucccugucccccauuuaaaacuuugcccuuuugucuuuucagauuggacuggcuaaggacgaucagcugaagguucauggguuuuaagugcuuguggcucacugaagcuuaagugaggauuuccuugcaaugaguagaauuucccuucucucccuugucacagguuuaaaaaccucacagcuuguauaauguaaccauuugggguccgcuuuuaacuuggacuaguguaacuccuucaugcaauaaacugaaaagagcca

SEQ ID NO: 12945 - RNA, 23878 nt, Homo sapiens
ggaggcggggcguggccguacucugauuggugacgggugaggcggcccgaaaucguaggacuuccgaaagcagcggcgguguuugcuucacugcuuggaagugugagugcgcgaagaugcgaaaggugguuuugaucaccggggcuagcaggugaggccuccuuuggguuggcagaggcggcagcggaucagggguccgagagagcaggggucugcgacccuccacgaacggaccccggaagcgcccgccccuggcuuugccuagguuccccggagucugcagcagguguggggcaugucggccucuugaggugcucaguaacuggugcuuuguauuaaacaugacagugaaaaggaaaacuagagcaucaguaagugaugagugucgcagugaugauccugagguuaucaaggcaaugggguacucaggcgggcuccgccccuuuuccaucuuugccuacuguucguauuuaucgucagugcccaauauuuugcuccugaccacgugaucaugucuuauacuccagguguuuugucuguacaagccuuuugccuacaaauuugaacacccaugaacauuaggacgguggagagaaaacaaucccguuucauuuagcucagugcuagagagcuaacauacucuucagaaacccagagaaaauuaaucuuuuccuaugaaggcaugguuggggugcagaauaaccagcucauaauaauuccaggguugcucguuuagucucucagccucuucuguugcuuguuuuaccugucauuugcacuucugugaaaaauguguggaggaugaagccaaucaaaccauuuuucuacuaguugcauuuggcauuuuuaaaugauuaagacagaggacauguuaaacauuuaagauugauccacuuucaauuauuuaaccacaugcguauuaacuaagccagcuugguaggugucugcauuuggcaacuuuuuagcauacccucucaagugacuuuaaccguugauuggugcuucuuauguggaagguacugaguaagucagaauugauuuugucuguuucuuuuacauauauugugacaugugcaauuguauauuaaaugccuacuguucucaugugaggacaaauaaauauuuuugaugcuuuguuguuggugcuaauagauuacugaugguuccaggcucuuuuuggguuuuaacuauuaacauauuugccuggaaucagcuuaagucuugaaagagaacuuauuacccagcuuuucauugcuaucagccaggcuggucugacugcugucaccacuccuaugcgguuuuacaaugcugguuuugaaguucuuuguuuccaagugguguacucaucuaauauuuaguguauuccuaccuucuacuuaaucauguugaguucuuucuuuuucuauuauuuaaucauaguuguugagagggauuuguacauccugccauguuacugaugccucauccugaaagauucaucuguuccuuuaucagagauuucuggugcuccuuaugguguuuacgauaccaguaggugguagagcccuugccccugaggagccuagacagcaaagucaaaaugcacauaggaaacagcuaauaagaugcucuuuugagcccuuacuggugauauauuaaaucauuuucaugagugacauaauagguacaaaaugaaaaccacuggcaggauaaagcccaguaguagaaaaacuaaagaacaauucuuguuuucaguccaguuauuuugucauugaaguuuuucaaaaugagaaaaacacaaacuaggcugugucucaagcaagugacuauuggaguguaggauuccucccuucuuaaauaauuguugagucuuuucuuucuaucugggcuucucauuggaggucaacuugacacaguuuucugaaccagagagaaaugccuguaccugaugccaucccagauaacccacaucuugugucugaauuguccucccaguggcauuggccuggcccucugcaagcggcugcuggcggaagaugaugagcuucaucuguguuuggcgugcaggaacaugagcaaggcagaagcugucugugcugcucugcuggccucucaccccacugcugaggucaccauuguccagguggaugucagcaaccugcagucggucuuccgggccuccaaggaacuuaagcaaagguauaucucuugcugauggauuuuuuuucucaugugauugugcagcauaacacuuaauaaaauaagagaggaaagaaaaaccugaaaagaaacaggugcgguguaagcaguuauguugaggaagucuguauagggugacccauugugucucaguaccacguuuucuuucuuuuuuuuuuuuuuuuuaaagagauggagucuugcucuguugcccaggcuggagugcaauggcgugaucucggcucacuucaaccuccaccuccuggguuccaagugauucuccugccuccaccuccugaguagcugggauuacagacaugcgccaccaugccugguuaauuuuuguauuuuuaguagagacgggguuuuaccauguuggucaggcugguuucgaaccccugaccucgugauccacccgccucggccucccaaagugcugggauuacaggcgugagccauugcgccuggccaguaccacauuuucagucucaaucaugaucauaauuauuucauggagacuaauuuaugaguacauccugaugugugaucaguugguacugggauuacaggcgugagccauugcgcccagccaguaccacauuuucagucucagucaugaucauaauuauuucauggagacuaaguuaugaguacauccugauaugugaucgaucaguuggugcugggauuacaggugugaaccauugcacuuggccaguaccacauuuucaaucucaaucaugaucauaauuauuucauggagacuaauuuguaaguacauccugaugugugaucaguugcacugccuuacguuaagguaacuccuuugacauuugaauucauuuuuuacaucuuucuucacauaaugaauucauuaaguagauaaggcaaguagugagugacauuuaacaagugaagaaacugagacacagaaauaaggguaauaugccugggaaggucauccaaucuuauauuaguuggguggguccaagaccccagggcuucucccugcuuccuaagggguauuuuuuuucccuaggccaguaaagauuuguucacaccuucacaguaauuggcauguaauagacauuugaucaauaguugguauaugaaggaauagaguccucagauguauaacuccccugaaagugaacacaaaauugcauguaggugcacaaugcauuuuucugagcagagagggcuuuuuauuuauuuauuuguuuuuaaauuguaagaggaauuuaugaugaaaaaaguccaagaacccugcacuagucuaugcugcccuagggcuaucuggaauaauuaauuuucaaauauugaggcacuuaagagacaaagaacuaccuuguuuccuuggacaguagaaugaaauggguagaaacaaggaaggcuuucuugaugaagauguuugcugaauaaaaauacuucacauuuuaugugaauugauaaucauuugcauuugccuguuccaaaugcacaaguuacaaagugaaagcuaguuuucuucacuccagcucuucucaguguggccuuaguccuuuguaaaugugguuucucucuccaguacugcugagcuauuagaguuuucuaccgcaucuuaaagaaaaaaaaacaaaaaaccugagauuuucuagguucuguuuucacauaaauuuugauauauuccauauccccuacuccuccauaacuuaagcaucuccagggcugugaaacuguauacugaauguccuuauggagauaaaaaccaugaaguugagagaaguuaugaguuuuaaaucauguuuacaggcauucuuuucccaaacuuucuuagccagcuggcuucuuaccugcuuuguuuagauuuuguuauauuuucuuauuuggaagaaaagaaccuucauuucccaguuaauaauaucccauuccgaugcaguuuacuuuugagacccaaaguuuuaacauuuauaguacugacuauucccaaaugccuucaaagguucaagauauucgguacuuuaucgcgaguucaguaauuuaguauuucguaagauauuuagcaacuuagcacagauucaaggcagugaggcuguggggcagaagggagcacuucaggugauaagugaguugucccagguaccugucaucagcauuuuagugaaguuuugagguauuuaguccgcaaaacagccuuuuuuuugagaugguuggugucaauucaaguuuaggaaaugaaugguuauagugauauucacaaguuuggaauauaugaaaguguccagauagauucuuacuuaugucaagaaacuacacccaguggcucaaauggaucucuucaguucuaagucugaaauaaacuagagcuaaagagagcuugagaaucccuucuaauggcucaaguagcaccaucccugacaccuggucuuuccaucuguagcauucucuucuauuagauagugcagaugaaaacuaguaagaaauagugaugcuguuuuauccauauuagagcaauguaucaauuauuuuauugaugagugguaugucauuuuacugaagccagagcuuaauuugaugucuuuacuaaacauuuccucuccguuccuagccaaauauguuaauauucauagauaaaaguuggcaaauaagguaauagaacaagcaacaauggaugaacucacacuaucuuuguggcacuuacaugaugaacugaugguaauaauaucagcauuuuaaauggucaauuuaauaauuugagucauuugucaauuauuuauaggaugaucaagaaaugguuguaugugaucuguguugaagaccauguauguauuucaggguccuaaguuuagaagcuaugacucuuaauaucuuggguuauucagagacaguuugguacauagaacucuaggagauauucugaauauuuauggugucugugaguaucaugagagcaggcuuuaccugccuugaaccuaguucaaaaugaguacauuuaaaccuauguaagucuuagaugaagagucuuagaugaagacuuacauagguuuaaaacugaaaaugcuuuuucaacucagcauuucauaucccuuccgugacaaguauucaggggggagcccaacaagauuaccuuacccccauuuaucuuuuauaaucucaguguauucuuacgaacuuucaucauuuuaggauacauaggacuuguccaugaacacugaaagguuuccacauggaucuucuguuuuauuauauauuuuggcauucagauuucagcauuaauagaucaggucaggugaauaucaauaguauauaaauuuuacuugucaaccagaggagauguggauuuuuuuuuuaaagcaagacacuuuguaagacgaggagaguggguuuaagagauagaggguugcugcaauuccuuauugagaggacagagcuggaaggaauuauugaucagagguuuuacuuaaagcccacgaugacuccacagauucuguuugaagccacuaccaaagaaagaauucucaaauguuuacuguagcuaaagaaaaacuguugagaaagaaaugcuguaacucuaaugugcuauaaauucuucugaacuugcuguggcuaauauauuaauuuaaaaaguauuuuuugucuuucuuaggccuccuugauucuagucacucuagagauagaauacacaaucuuguccugauguuuuuacuugcaacucacaaucuuguuuggugguuuacuugcagguuucagagauuagacuguauauaucuaaaugcugggaucaugccuaauccacaacuaaauaucaaagcacuuuucuuuggccucuuuucaagguaauuuucguuuuauggaugaacugauuggaaggaauguguucauuuuucugccuaguuuugauggcauguuaaguuggggggaugaaagguaagggguuguugaaaagguugaagacagaaaaaggagaugucgcaaccauaucaugaaagaaaagcaauccucuuuuguggggagugcugaaagucccguuuuuuaugguauucuaagucuccaggacauucuaaaugguuuagaaggucauuuuuuggucugccuggauaugccuauuagcaagaacauuuugaaauuaggcagaguucucagagagucuccaauuuccaggaaaguuacuuugaacuguuucccagcuguaugucaggugcucugaccaguagguuggggaaaugcagacaacuaauguuuccugggagauucucguuacucauuaguguaguggcuuucaaaaauguugaaacacaaccaggagaauucuuauuuauaggaauagaucuuacuuugugacccaauacacuuauucauaaauaggcauucuuacuaugugcugcuuacuauaccaaugcuuuugcuuuacuucuuuuccauuaaaagacagacacacacacacacucucacacucucucugucucucucuccccgcauugauuuugaccuacuaaauugaccucccagcagaacacuauauuaauacguuugaaguauucccaguuaaaaaaacaaucuguuuaacucuuuuuuuugacaguuaaacauacuuugugcacaggaaaacuuuuuuucccuuuggcauagcuuauuauuccuuuagaacaguuuaccuguaaccugauugggaaagaggugaagagaauuuuagcagcagguuuuugagagacucaaguuccuauugguagcgugagcuauaaguauguaaguauuucugugaauuaguggggggaaggagggucuuuggcauuucauuuaauacaauaacccagucugagaaauagguauuuuuauuccugucauuauagaaucaagggagguguaguuuaugggucggggggauggguuggaaaguguuuucaguauuuccaguuaaagaagcuuuaaaaagucaugcaauuaucuucugcuguuucagaaaagugauucauauguucuccacagcugaaggccugcugacccagggugauaagaucacugcugauggacuucaggagguguuugagaccaaugucuuuggccauuuuauccugguaaagaagcugugggcuuaauaagcuaauauuucgugugauaguuucuguaaagcucugggcacagggcauuauuauaguugagcagccaguuaacugauuuaaucucauguuugaguuuucuugauugcauuugccuuguuuauugugagcauggaauacuucuggaagcuuuccuaguagauuuuucuuuaauaaauguacuaauaguuuuugauuuacagaauuacugcaaagauaguacagagacuuucuguaugcccuacacccaguuuccccauuauuaacauuucgcauugguaugaugcauuugucaaaauagaugaaucaauucugcuacauuauuauuaacuaaaguacacacuuuauucagguucuguuuuugccuaaugucuuuuuucaguucuaggaucccauucaagauacuacauuacauuuagcagucaugucuccuuaggcucuucuugguugugacagcuucucagacuuuccuuguuuuugaugaccuugacaguuuugaggaguacugcuuagguguuuuguagacucucucaaucgggauuugucugauguuuuucucauggugagacugaagaaugugguuuuugggaggaaggccacagagguaaagugacauucucaugacaucauaucaaggguguaugcuaucaguaugacuucucaguguugauauuaaccuugaucaccuggcuugaggucauguuugucagguuuuuccauuguuaaguuacuuuuucuuucucccuuuucauacucuacuuuuugaaagaaaguugggccgggcacgguggcuccugccucuaaucccagcacuuugggaggccaaggcgggcagauuaccugaggucgggaguuugagaucagccugaccaacauggagaaaccccaucucuaucaaaaaacaaaauuagccgaguguggugacgcaugccuguaaucccagcugcuugggaggcugaggcagaagaaucgcuugaacccgggaagcggaaguuguggugagccgaggucaugccauuggacuccagccugggcaacaacagugaaacuccgucucaaaaaaaaaaaaaaaagagaaaaagaaagaaaguuacuaugugcagccaaugcauacuggcuagugcucuaccuccuuaagaguggguuaucuacagaaauuauuuggauuuuuuccacaagggagauugucaguucuccuuuauuuaugucuuuaauucagucguuuauuauauccauauggacucauguuuauguauuuucugcuuugaaauuauaaauacuauuuuauuuuccugcucaaauuuuuucaguuuuggccacugggaacgcuuucaguuggcuccuguaucucuuuggcacacccccauuguuaugguuuucucuuuuuguuuuagcuuucguuuugagcaguuucuuacuaucuggcacuacaagauccuucagacucaucuuguguauuuccuuguucaguccuagaaucagcuacuuuucuaaagccauauguuuucuuuuaucagagaaugguuauuagaaaccaagaucugggugcuuauugcugcugagauaucagugucuucuaaacccucucugcugauagacuaagagauauauauguacauacuaacucauguauguauacauaucuauaaauauuuuucuguguaacuaauucaugucucuuuuagauaacuaguuaauacugaugucucugacccuaaucucuuaccauacaguacagugguuucaaaauuuuuaucuguauucugucaguauauuuuaauacuuuuuuuuuuucuuucacccagauucgggaacuggagccucuccucugucacagugacaauccaucucagcucaucuggacaucaucucgcagugcaaggaaaucuaauuucagccucgaggacuuccagcacagcaaaggcaaggaacccuacagcucuuccaaauaugccacugaccuuuugaguguggcuuugaacaggaacuucaaccagcagguaaggccugucucagugauacggaaauggcagaggaggguucucuuaauuaccugcuguugauuuccuaauaagguagcuggcuuuccacuaacucuuauaguuuagauugauauuugguguauaugaaaguguuagggcagagauaauuggcuccugacauuauaguuauagguaguucauucugugguucuucaggaauucuaacuuauguuaacagagugacacuacuaaaagugauaauagcuacuguguugguacuugcuguguuucaggugcuguauucgucuguguaugucauuaaauaccugccucauuacauggaggugggucuaaguauuaccauuuucagaugaggacacuaaaucucggagaacuuaagucauuuaccugauggucacacaacuuguaaaugguagagcucagaauugagcccgaggcugucuugacuuuauagcuuggacuuuucccacuguaccaugcugccgccuaguguuugucauagcagacguuuauaggacagucaaguaguuaugaaaccuucuggauaguggugguuuuagguaagacuccagagcucugucucuaugaggaucucaguuuaugggauguuuuucaggggauggugacccuuguuggucauacugaguccuuguugccacuauggucugcaccuuacugcuucuuuguaugucucuguugcccaggucuaaauucuuaccuggaaaucuccagucuucgccuuggacauuuucuuuuguuugcuuugauugacaguguucuaugaguauggggcuauggagaaguuuaauuucacuaacauuuacaaaagaccuaucauguuuagggcacugggccagguuuaggguugaggaggaaagugaaauaagaugaugaucaagaauuauguuuuaccucaacggagcuucuuggaucaugaauuagacauagaaauauaacucuuaugugauggucuagaccuggcuuauucuggaauugcuaccuuuaucaggugguauucuguguucuggcucuuagaaugaugccccccuuuuuuuuugagacagagucucauucuguugcccaggcuggagugcgguggcacaaucauggcucacugcaaccucuaucuucugaauucaagugauucuuguaccucagcuucucaaguagcugggauuacagggaugugccaccacacccaauuuuuguguuuuuaguagagacaggguuuuacuauguuggccaagcuggucucgaacuccugaccucagguaucugccugccucagccucccaaaaugcugggauuacagcacuugcgcccagccugaaucaugccucuuauaaaguugaagcuaagagcauacuuucgggaacugaauuugaauccugacucuuuguaacccuaggcauauuauuuaaucucccuaugccucaguuuccucaucugaaaaauagggauaguaauagugccugccucacagauuuauugggaagauugacugagggggaucuguaugaagcacucacagcaguguuuuguauucagaaugugaguuugugugugcaugugucuguacaaauauguacauguggauauacaugaguguggguauguauuugugugccuacccauguguagcauguucauauguacauguacggguuuuaugggugugugcacauguguuugugaauguacuuuuugggugugugcauguguguaggugucagugcaugugggcugcacaugcguguacauguucuuguauuggcuguuaauauugcagguuggacucagcauguuggcccaauugugcaccuccuucugaaguuucuugagauguuuaaaaacuugucacaacugcuuccugauacucugagaacucccuuuuagagggauuagcuuuuccuuucauaaaaaggucugggauucuauuuaagucucaauuaucaagugagcuuugggauuuuaucuuuuacgaaggagggagauuuagcuauugcuuguaaaaucuguugagauugguucucagccaaugacuuuuucuucuuggccuuuaugaggaaagaagcagcugagaaagaauaacauuacaggauuccuuuugaagcccuguguuacuggaaauguugucagguucuauauagacugccugauagacuuuaauuauccaugcaugcucccccacucaagcuguagagaaauacucaggaucaucacaauuuaaucccuauaauuaaacaaauggaaggauacagucuugguuaagauugucuucuucuuucuuuuuuguuuaucucucaacaucagaaaauuguauauguuggaaacgcuggauuuuaguuugaagauuucuucguuuaggacagaauaguccccaagugauccuaggaagcuccuagaauaagaacuuuuccuuagcuguuuuaggggcagagcacauuguuuucuuaggaaaaacuuuuggacuaucaugaggauaagucuuagcucuugacuuuuuucuagaggauuguugguaaaucaaggggauucucagggaugguugauccaugucaggcagugccaagccucugcaguaccaaauaaaggaugaaaagccuccagguucuguugcuuagggugcugucuguccauugaacugucuguuaaacuggcacuuccuauuuuuuuauuuaaaagaaaaaaugaguuuaaaaaugauaaaaaugaguuaaaauagucaauaucaaaauaaaguaaaauguauaguauaaauuaaacuaaauaaaauaguaaaacaaaucccaauaagaggcaugaucccagggcuccaggacuuaacuguagaucacauaggacccuuuguauuaacauaagcucuguguuaauuggggcucucuuuguaggguggaacuuucuaaaaugaguucuaggcuaaggaccugauugagagaucuucaguuggagaaaguuuugugauagcacauacagccuaaugccgggagcaccccccucaagcuagagguaugggucuuauguacuugcagggaaacagacacauacuuuagguuuagcugucuauuuauuaggccagaaacuucuugaaggcaaggacuguacuccauacaucuuuuaaucuuaaaugcucauuaugauuaaaaagcugaucuucaguuaagccaauaauaggaaaaacucagauaaccaggcccugcuuuucucccccagcguuaagauugguuauuuuuuauacugcaagguucaugagaauagagacuuugucccacuaauuuuugcauccugggugccucucacaguggguucucuuaauacaugauucuucaacauaaacguucuacccaacuucagagacaacucagaacauaaauucuuuauuaccugacuucuggcucauguacauaccucuuuuauuaacuagcauguagcuggacugagucaauauacacugaguuaaagucucauugcuacaccucucuguuccuagggucucuauuccaauguggccuguccagguacagcauugaccaauuugacauauggaauucugccuccguuuauauggacgcuguugaugccggcaauauugcuaguaagugaugaauauacuucuuuucuuaacucauaaaaaucucuuuuugggaccuagaagauauguuuaaggguugggaaaugauuuaaggaauugaaccugaaugccauuuaacuugagguuuuugaacuuacuuaaugugaaaccucugcuuaauauuucuaaguguuacugccacaccaccauuugagugucuacuucucuuuaaaggaguguuucauugcucaugcaccacagaucccaagaguucuguaaucauauaauuuuagaaaacccauguugaacauuguuaaacuggacuucucuaaguuuucaaacugauccugugcaucaaaaguucccaagaaggggauaauuguguacuauguaacuauacaaccauauuuuuguuuugugauuugaacgucuugcaggaccauuguuucuguggcacaucuugaaaaaugcuacuuuuaggaaaugauucucucuuuagggcucaggaagaagugucuuuuccuuagggcaggcauaaaguaaagaucagaaguaaauaggccuucauguuaaaaguaguggauuuggaauaauggagauuaaaugauguuucuuuuuugacuucuuuauuuuuuguuacuuaaaaaguguucuauaaucagaaaggcaggguuuuaaaaaauauuuaaaugaauaauucuuucgugacucuauucuaaaccaccaaaaaauaacaguuguuuucuuuuccgcagcuucgcuuuuuugcaaaugcauucacuuugacaccauauaauggaacagaagcucugguauguuacugaaguuuuuauaacuuguaugaugacuuagcagaugugaauuacagguucacucguaguagaaauaauuucaacagaaaagauaauaagagaauaagcucugugaauaauugaggucccguuuggaacuaaagcggacuauaaggcuaagcacagaacauuaggagugaaguuugcaaguuuaacaucuaccauggcacugggcaccaugacuguagggaaagcacuucuuuagaggcaagauacaccagcagcuagaggagagacagagcaaugggaagcuggagggacaggcagagcaggacggugacugcacaaucagucugugauuucccguggagaaagagcauuuugugggucaagagccaggacaacaagguugaacaccauuccccucuaugaagauuuucuucccucucuuagaagaucaaguuguuauuuuauuaggaagccaguggaguuaaaucacacguggcaaauggguugcauguguuuccucaucaauggcagacauuacuaaugggcuauaauacuccuuucugcuauacacacgugaugucucugaauauucuucaacccagagcuccagaggcagccucugcuaacgguucagaauuguccuacauaaaaagcccacuguaucugagucaguccuuuacauuugucucccucauuccauugaacuccuucaggauuuuugcuauucacuuuggaaaccugaggaccuagcauuguaguacuuaguagauucuuaaaucuugacuuaauugagauuagcuaaggaaaacauaaauggaauuggcuuugaugcucuuguuuugguaaguguuacagaaauaaaugcauuuauuguaggaauacaaauugguuguagaagcaagugcuuuuaaacuauauuuuaauugguucucaauauauuugccaaaccauucacugaugauauuugagaggauguuuauaauuugucuggggagcucuauaaagugcagauugugaaucuccaccagccucacucaucuugggcagaagaaacaaaucauugacacauccuuccuuuccagguauggcuuuuccaccaaaagccugaaucucucaauccucugaucaaauaucugagugccaccacuggcuuuggaagaaauuacauuaugacccagaagguaaaugugcuuacauuguugcacugauguuugcuguuggguugaugaauuaagccuguguuccugaccagccccucagccccccagcuucgcuucucuggguacucacuguucaccagcaucacacuggccugauuuuauuucauccugcucccuccugcuucucgcacaucuuauucccccgacuugagcugcucucagccucuugaugauugauuugugcucauccuucagaucaguuuaucccauagccuuuagugacccuguagaccgggccugggugccucuguaauaggcuuucuugacaucucguaccuguugcagaucaugcuuguucaccuucggguuccccugucagaauguaagcucuuugaggaggagggucauaccccauuuccuagcaggcugccuuacacaugguagacgcucaguaaauacguugcaaguugaaugaaauaugaaguguuuuucugugugaaguuaacuucccuuugaguauucaauucugcuugugacaauugucagcuuuaauagauugguguuuugaagaggaacagaauaaugugcagaaaaaaaaugucaguacuguguuuuuuagacuugguauaaucuaaaaugaaaucaaacauagaguuacauacuggggaauaagaaaauuuauuuuaaacuaagagaacuacuuuguuguacuuuugucaugcguaagguuuguuucagccccugauuuuccacuguccagccuguugugaggaggcauuagcauaagauaaaaugagauugaggugacuguuaucgcagguaagucaaguaaccggcauugaucuuggccucuguuaguagcgugaguuaaaaggggagccaugcacuuggcuuccugugcuaucuguucacuaaaagugaaccuuccagguuuuucaaaauauguucugugggauacuaguuuccugagaagauuugcaagaagcaguuccucuagcaaguaaaauugaaccaugcuucauauuacauuccccucuuucagagacuuguacagcauacaucagcaaaguaaaggcugugagaaguugaaacaguuaagaaaugugugugaaauauuuuauccugcuguuuucaguacuucaccaugaauauuuuuuaaagcaaauuuuacauaaccuguaacaucccuuuggggaauucuauuguaaacuaauagcuuacuuuaggcuagcaggguguauuugaacuuacuaucuauuaacuuagaaggaaugauuuguuuaucaaggggaaaauguuuaguucuacaaacugacauacucauuagcauuuuauggaaaugcauugaagaaaguauuuuaaccuuugauuaauuuggggaagucagcuuucucuucuguuaaaagaugggguugaacuagaagaguucuguaaugcuucuuccagcuccauuauggaaaaacucuaacuugauugaagauaaauguuauuuucuuucuuuuuuuuaaaauuauuauuauacuuuaaguucuagaguacaugugcacaacgugcagguuuguuacauauguauacaugugccauguuggugugcugcacccauuaacucaucauuuacauuagguauaucuccuaaugcuaucccuccccucuacacccaccccacaacaggccccagugugugagguuccccuuccuguguccaaguguuaucauuguucaguucccaccuaugagugagaacaugcgguguuugguuuuuuguccuugugauaguuugcugagaaugaugguuuccagcuucauccaugucccuacaaaggauaugaacucauccuuuuuuauggcugcauaguauucuaugcuguauaugugccacauuuucuuaauccagucuaucauuguuggacauuuggguugauuccaagucuuugcuacugugaauagugccgcaguaaacauacaugugcaucuguccuuauagcagcaugauuuauaauccuuuggguauauacccaggaaugggauggcugggucaaaugguauuucuaguucuagauccuugaggaaucgccacacugucuuccacaaugguugaacuaguuuacagucccaccaacaguguaaaaguguuccuauuucuccacauccucuccagcaccuguuguuuccugacuuuuuaaugaucgccauucuaacuggugugagaugguaucucauugugguuuugauuugcauuucucugauggccagugaugaugagcauuuuuucaugugucuuuugcuugcauaaaugucuucuuuugagaagugucuguucauauccuuugcccacuuguugaugggguuguuuguuuuuuucuuguaaauuugaguucauuguagauucuggauauuagcccuuugucagauggguagauugcaaaaauuuucucccauucuguagguugccuuccucugaugguaguuucucuugcuuugcagaagcucuuuaguuuaauuagaucccauuugucaauuuuggcuuuuguugccauugcuuuugguguuuuagacaugaaguccuugcccaugccuauguccugaauaguauugccuagguuuucuucuaggguuuuuaugguuuuaggucuaacauuuaagucuuuaauccaucucgaauuaauuuuuguauaagguguaaggaagggaucgaguuucagcuuucuacauauggcuagccaguuuucccagcaccauuuauuaaauagggaauccuuuccccauuucuuguuuuugucagguuugucaaagaucagaugguuguagauaugcagcauuauuucugagggcuguguucuguuccauuggucuauaucucuguuuugguaccaguaccaugcuguuuugguuacuguagccuuguaguauaguuugaagucagguagcgugaugccuccagcuuuguucuuuuggcuuaggauugucuuggcaaugcgggcccuuuuuugguuccauaugaacuugaaaguaguuuuuuccaauucugugaagaaagucauugguagcuugauggggauggcauugaaucuauaaauuaccuuggguaguauggccauuuucaugauauugauucuuccuaucuaugagcauggaauguucuuccauuuguuuguguccucuuuuauuucauugagcagugguuuguaguucuccuugaagagguccuucacaucucuuguaaguugaauuccuagauauuuuauucucuuugaagcaauugugaaugggaguucacucaugauuuggcucucuguuugucuguuauugguguauaagaaugcuugugauuuuugcacauugauuuuguauccugagacuuugcugaaguugcuuaucagcuuaaggagauuuugggcugagacaaugggguuuucuaaauauacaaucauguaauuugcaaacagggacaauuugacuuccuuuuuuccuaauugaauacccuuuauuucuuucuccugccugauugcccuggccagaacuuccaacacuauguugaauaggaguggagagagagggcaucccugucuugugccaguuuucaaagggaaugcuucuaguuuuugcccauucaguaugauauuggcugugaguuugucauaaauagcucuuauuauuuugagauauguccgaucaauaccuaauuuauugagaguuuuuagcaugaagaguuguugaauuuugucaaaggccuuuucugcaucuguugagauaaucauuugguuuuugucuuugguucuguuuauaugcuggauuacguuuauugauuuguguauguugaaucagccuugcaucccagggaugaaacucacuugaucaugguggauaagcuuuuugaugugcugcuggauucgguuugccaguauuuuauugaggauuuuugcaucaguguucaucagggauauuggucuaaaauucucuuuuuuuguugugucucugucaggcuuugguaucaggaugaugcuggccucauaaaaugaguuggggaggauucccucuuuuucuauugauuggaauaguuucagaaggaaugguaccaucuccuuguaccucugguagaauucagcugugaauccaucugguccugggcuuuuuuugguugguaggcuauuaauuauugccucaauuucagauccuguuauuggucuauucagagauuugaccccuuccugguuuagucuugggaggguguaaguguccaggaauuuauccauuucuucuagauuuucuaguuuauuugcguagagguguuuauaguauucucagaugggaucgguggugauaucccuuuuaucauuuuuuauugcgucuauuugauucuucucucucuucuucuuuauuagucuugcuagcagucuaucaauuuuguugaucuuuucaaaaaaccagcuccuggauucauugauuuuuugaaggguuuuuuugugucucuaucuccuucaguucugcucugaucuuaguuauuucuugccuucugcuagcuuuugaauguguuugcuuuugcuucucuaguucuuuuaauugugauguuagggugucaauuuuagaucuuuccugcuuucucuugugggcuuuuagugcuauaaauuucacucuacacacugcuuuaaaugugucccagagauucugguguguugugucuuuguucucauugguuucaaagaacaucuuuacgucugcccucauuucguuauguacccaguagucauucaggagcaaguuguucaguuuccauguaguugagugguuuugagugaguuucuuaauccugaguucuaguuugauugcacuguggucugagagacaguuuguuauaauuucuguucuuccacauuugcugaggaaugcuuuacuuccaacuauguggucaauuuuggaauaagugcuguguggugcugagaagaauguauauucuguggauuugggguggagaguucuguagaugucuauuaggucugauuggugcagagcugaguucaauuccuggauauccuuguuaacuuucugucuuguugaucugucuaauguggacagugggguguuaaagucucccauuauuauuguaugggagucuaagccucuuuguaggucucuaaggacuugcuuuaugaaucugggugcuccuguacugggugcauauauauuuagauaguuaguucuucuuguugaauugaucccuuuaccauuauguaauggccuucuuugucucuuugaucuuuguugguuuaaagucuguuuuaucagagacuaggauugcaaccccugccuuuuuuuguuuuccauuugcuugguagauuucccuccaucccuuuauuuugagccuaugugucucucugcacaugaaaugggucuccugaauauagcacacugaugggucuugacucuuuauccaauuugccagucugugucuuuuaguuggaucauuuagcccauuuacauuuaagguuaauauuguuaugugugaauuugauccugucauuaugauguuagcugguuauuuuguuuguuaguugaugcaguuucuuccuagcaucgcuggucuuuacaauuuggcauguuuuugcaguggcugguaccgguuguuccuuuccauguuuagugcuuccuucaggaguucuuguagggcaggccugguggugacaaaaucucucagcauuugcuugucuguaaaggauuuuauuucuccuucacuuaugaagcuaaguuuggcuggauaugaaauucuggauugaaaauucuuuucuuuaagaauguugaauaucggcccccacucucuucuggcuuguagaguuucugccaagagauccgcuguuagucugaugggcuucccuuuguggguaacccgaccuuucucucuggcugcccuuaaaaauguuauuuucaaaauguucaaaaguuuauuuaauuuuuagccuuucaauuuugugaacaaagaggcuguucuugaaguuuaggcucuguguuggcuugaugaaaggauaucacuauuuaaaagggcugaaaguuugccuguacauacuguugagauuuucugcaugaaacacaagaauguaaaauaacuauagauuaaacuagauagaaucuuaaauuucuugcauguaaaagcauuuaggagagaggcagucucaggcugccauggcaaguccacaaauugucagguacucaaguuccuugcaaucaccaccuggccaucuuuagggcauggcccucaggcuuguggcucgagagugguauggaagaagggaagaaaaaagggaugcuuuauuucucuugaagagacuccagguauuauuuacaucucacuagccagaacauagucucauggcucuggcacccauuguuucaauggaggcugaaguaucgucuuauauccagagggcagugagcccagcuaaaaccagggcucuuuuacuaagccagauugauauuaggaagugaguagccauuaaaaacucacaaaacucuugauuuuucuguuuuguccuuugauaaccaguugguuggugucuucuguuacugggcauauaaaaguugggggagauagcaaaacucagaucuuucagucuugcuguuuaagggaagcaucaguggguuuggugaguguuggaacugagacugagauuuaguaugucuucaggcucucagcuucuuccacgugucugccaccauggcccuuuccugcugccuccuuucuuuuuauuucauauauugaaugccuuuuuuuuauacaaauacuauucaucuuauuuuucauuucuagacaucucuauuuuugcuucuuuuccagauggaccuagaugaagacacugcugaaaaauuuuaucaaaaguuacuggaacuggaaaagcacauuagggucacuauucaaaaaacagauaaucaggccaggcucaguggcucaugccuauaauuccagcacuuugggaggccaaggcagaaggaucacuugagaccaggaguucaagaccagccugagaaacauagugagcccuugucucuacaaaaagaaauaaaaauaauagcugggugugguggcaugcgcauguagucccagcuacucagaaggaugaggugggaggaucucuugaggcugggaggcagagguugcagugagcugagauugugccacugcacuccagccugggugacagcgagacccugucucaaaauauguauauauuuaauauauauauaaaaccagagcugacaaugacacucuggaacauugcauaccuucuguacauucugggguacauggauuucuacugaguuggauaauaugcauuuguaauaaacuaugaacuaugacugucucuuuuccuuccuuuuggaaugaucuccaagacuguguauguguaugcauaugagaaaaagauugggccgggcacgguggcucaagccuguaaucccagcacuuugggagccugaggugggcggaucaugaggucaggaguuugagaccagccuggccaacauggcaaaaacccaucucuacuaaaaauacaaaacuuagccaggugugguggcgugcaccuguaaucucagcuacuugggaggcugagacaggagaaucacuugaacucaggaagcagagguugcagugggccgagaucguggcacugcacugcagccugggugacagagcaagacuccaucucaaaaauaaaaaauugauuaaguaaaaauauuaauuaguuauucucuagagugguaucacaucaaaauuauuagaguucuuuucggaaagauuuuauguaaaaauaaaaauuauuugagucacccaacagaguaucuguuuauauuauucugccaacuggggccuaagcugugcuccaugggacaagagguggacuugaauaauugugacacaggcacgcacugcuccuuucuuuggccugaccccagcaaaaggaaguacugcccacuaucugaguggcagucggaacuuuguugcuuuaugagcaauuuuuuuuagcucuuuugccuuauuucuuccuccauauguugcuucugacaaucuuaagauuguuagaauccuaacaauccucaugugggugcccaugugguuaauaacaaaaaccaaauagauagauguuugggucacuugaauuauuucuuguuuaaaaaauaucuuuuauugauucugagggaguugaugcuaauauugggcccgacccuuaacacuauuugcaaauuuauuagugaccagcccauuuucaugaucauaucuuaauaguuguaaacuugcagcaagaaauuauucacucacauuaaguuucaauaaaauuuucuaacuggguaacugcugguguaagguacacuauagugaggauuuaguuuacauguaucagauaauuaugcaaacuuuauaaauuuucaaagaaccacaccccaggccucauuugauaugaagaaaaaugauaaaaugccguauauuuuuacuuuaaauauaaccaauguaaugccugaaaucuaaagucaguaaaauuuugaaugacuugacaaaaguaaaaaaugauauauaauuuccucacauuuuaaaguaugaagcuguugguucuaguuucucuaauuuuguuguuaaagguuuucuauaaacauucuauaagugaaaaugagagcugcacaccacuguguccaccgucuuugggagagaagggugaaguugaccugaaaucagagcuguuuuucacucuuccauucacucacauuguaaauuuggaagaagcacauuaucuguugugaaucucagguuccucauauguaaaguggagugguuaucuuuuugcugcuucuacucauggguauggagugaagauuuaaugcaauaauauaugugaaugaauaaagagcuuuuuuuggcacauuguaauaauuuuuacuggagauugaauaugccagaauaucaugguucaaaugcuaugguguaaggcacugagugaucacuuccuaucugguagaguugguuaauuuuccaaguuugacccggaaggcagcaucugaucaagugggagggcauggugggaggaguaugggcuuuagggcugggcag

SEQ ID NO: 12946 - RNA, 154494 nt, Homo sapiens
uguggauguaugccuaccaccgggcuccuucaccagcaaaguggaaaaagaagcguuucacaacaaauucuucuuuuuggguuggggaaacgcaguggauuauagcucuguuuucuucuuuccaaaacugugcaccccuggaugaaaguaaguuaugugggucuuuuuucuuuauuauuuuuucuuuuuugaaaaugaaagcuccgcauauacuucuuuugguguuucaggaaaaguuuuaaaaaggaaacagaagggcguuuuaagucagacaaggaagggaacguaaugaggcaccacagacucgagaaaucagaucccauguuuuugggggucuggauuuaugcuaugaagggaagaauaaagagcaguaauaaccaaagaagccugaagcaaaauaaaugaaucuauagcagcugcaagauacaauaaacaguguuagcagaguugaaauuguuggcaggcaagacaggccgauugcagaguuaguuucaggaugaagaaggcagagcaggagagcuaaguuuuuagacauuuaguagugguguuagaagguccugaguuuuggagauaguguagaccaagcacuuuuuguuuuucaggggaguugcugauuuacuugugagaaggguaacuuuggaugagggguggcuucccccugagauuugggguggcuagggggaggcugggugcauggaagauuuuucaguugugacagugaaauacagcuucccagacucaucuccucgcuggcucugggugccuuucccuuuguuauggaaugacuggggcuguuuucauuugggaccucugaguccuggccuagguucaagagucccauccaaagggaaagagaacuguucccaguggcugaaacucucagaccagccauuugaggcaagaguucguacuguucaagccaguaggggguucagcaccauuuugccgaucauuggcuuccuacaacacagaguuaagaguccugaaaagggccuuaggccucucaucuaaccccuucgcuccacagauguaaaaaaugauaggaaggggaccgaccuguucaagucccacagcacaucuguaguggagcugaaaaugaaauugagauucucucuacugcuaguccaguguucuuuccacuccauaccucugcuuucauuuccuuuuuaaggcuuauucuggcugagacaauagaggcaguaugaugagcaagucaccacaaggacguuaauuaucaguaauagagaggacgccaauggcggcucaucagcuaaugaugucuaugguuauauuuguguguguguguaaaauaaaaagaagcuaaauucugaguauuuucuaugcagcaggcucaaaauaauacauaauucaugcucagagcucuucauacauaauuugauugacucucacagcuauguaaggcauuauuucuaucguacauguaaggacauuaacgcuuagagaagcgaaaugaguugcucaaggaaagguagcuaauacauuugaaacucauguauaucugacucuaaaaccuaugcuuggaaucacuauucaaugauacuccccucaucucccuugcauuugguuacuuuuggggucaaauuccauauuucacuggcugaucaggaggugaaggugucaggcuaugggagcaguauggauucucucucagaggccacuucugcacuuggcugaacauuugucuggauaucagaugugggguugauuucugggucuuugguauauacuuaccuuuguuaugcaaagagccugggacuuagagucagaagauucaggauaaguucuggcucuaccuuuuacuacuuagcaaaguugcuuugccuuucugcaccuugacuucuguauuuauuauaugggaacaauugcaguaccuuucagugugauugcugcaagagguauuggacaugcaugcaugcugaaggcuaucaagggcuuacccauaucagcucuuucgauuaggaucgguaaacacagaacgucauaugaggcagccccuguggugcugggucuggcaguuggugcugaugcuggcaggagggcagauggauuuggaugugugugaaacucugaaauggguggccucagucuuagugcccaucuccuuugaauggaagcaggccuuccucccucccgggggaauauuccugagggcucugucuuaaauucugucucuuaaauucuccuccacuggccugguuugauaugauuccuugcccaaagcagugcaggcugaaggacacugugcuuggugaagcauccccugucucugaaaaggaaguguuuagucaggaccaguccccugauugcuccucagacaagacugacauuugaggagcuucguaucuagcugagggcagauccuugacccaggaccuucuugucacuggcaggcacaucucccuucauccuuucccuggcauucccuauucugugccugcagucagaagggaggcugcugcuccugggguggggguggagagccagccugcaguggggaggccucagccucuguuucuggguaagauccauuugcuuuagaaaccuuaaauguaagggaaguggguaagguguuuccggaaugccuuucacuuagauuccucaacagagucuccauguccaagcacaggaccuuaucaccugcuuauucuccccuagccacucugugaacucgcacuuuucuuuccuucuuguauaauugcuccccagucuugaagucaucugaauucucuaucacacacagugaauuuacuucaaaccuuuccauguauuugcauuuuuaauagacacaugaaaaaauuggagcggccaccccccauacauucaugucacaccauuuucaauucgcaugagcucucagauauccuucccaagcucccuuacaagaucugcuuucaggcacuucacaucacccucaccucaaacacacaauccaaacacaugucucgcaggcauccaaaaagcaaacacacgucuaaaaguggaccuccacagacaugcuaacauucuugugccagcucacauaaauggugaccuguccgcaacacagacacacuggacucuuuauaccucuugcccuguuugaagcugugcaacauaugaauugaucgacucugucccaacaaugacuagucaguccagaaauguguccagcauccccaggcaucccagggcuucucugaaugcagcaaccauccauaaugaggacuguucaccaggaaauuagaaaccccagguagaccuuaaaagauuuucagaccaaucaaaucagaauaucugagguuggagauugggaaucaguacuuugaacugcuccccaggugauucugaugugaaacagaauuaaguaccucugcugauaaaucuccaacuguguugucuuuggcaauucaauuuuauuccauuugauuuaguucuauucaucaaagauuuaguaacacugugcuaauaacauaguuuaguaaagaagcugagauguccagauaccugucaaggauauuuauuggaacaucaaucaccucgugucuaaagugaugaucucuguaaauuuuucucucuuuuaauuauauuuguauauguuuaaaugugcuauuauuaagccugcauuauucauguacgauuuggcuaaaaaugguucucuuauuuucuaauuguuuugcauagauauauuugauguuuccuaauuuuauaaaccccagcauuuggcaaauuguguacuuauuagcuggaaucuuacuuuggcuuugaaaugcugaagaaggucaguuuugagccagcccaagaguugcuaaggccuggaagggcaaugcaaagguagaggaauucuaaacauggguuuggacucacuacacagcuccugaguuuagcugggcuucuccuggaaauuggauauugucuguaauggauccacucauuaagucgucuguggcuugugauuugugccuaaaagaaccccacaaaaaucugugaggggcccuuuggaucuauagcuccgagguuagugcuggcuggugcucuguagugugagugagagggagagggcaugugauaaauagaacuucagaugcgugauguagugaaaagaacauguagugaggcucuagucccaccaccaucauuuucuaggguuucgaccucagaggaguuuuuuaacuucauugguccucaauuuccccuugaguuuuuauccccuucauuugaguuuagauaagauaauguauaggaaacuggaaagcacuguaccugugaagaugguagguaaugcaagauaauccuuagggccuuaauagcuuagguagccaaaauaauugagaugggagauggauuaaaaaugagggcaaauaaucuagcauuuuugcauuuuuuccuuuuaaaauuugaaugcucuuaugaauccaaaaaaacaugaaacaauacaaaucucagugaacucucaugucuaagauaguuuuccacugauuuuauuuuucucuugaauaguggugauuuaaaaaaaaaucgcagguauauuuuuuaucuauuaaaaauaucauagcauccugguaaacucugucauaauuuuguuuugcuguauuuauuuauuuacuccucaguaaguaguuauuggaugccuagucucugcuggacacuguucuauguuuuaugaugaacaaaccccaugaaguuacaagcauuuauaagcauucauugcuuuagguucuagggaguauaauaugaauuugacugugugaaacuugauuuagaaaauugguauccacauuggguuaauaaaauuuaguuuuuaaaguuuacugaacuguaauuuaaaaauaauacagaaauaguuauuaaauggugauuuucaguggagcagguguuaugccauaaauaggaccccaaauuuuauauuuuuuauaauuuuuaaaaauuauagagcaacuuuagcuuuacagaaaaacugagaacaaaaugcagaguucucaugaauuccuucuacccuuugcacaauuucucuauuauuacaaccuuguauuaguauuauguuuuauuugcuaucaguuacucaauguguauuuauuaaacauaacaaaauaauaaauaaauuuauuauuuaugcccuauuuguuauuaugaaaagaauacaucauauugcugccucucaagcuguuuauaauguuauguagcuacaguuugagguuucucauuuauuagaaaaauuuuuuuucugugcacuuagugcaugccuuauucagugcuagggcuuaacacauuaucuggacauaguagacauuuaauaaaauaucugcugaguauacagacaaaugaaaugaaggauccagaaguaaaagacgcaauucuuguccuuaggaacuuaggaaacaacagacacacauagcagugacuggagaaaauuucagaaauacauaaaauaugauuaaaucucugauaaaggagacauugguauaggcaaaugaggcauaaagccauuaacaagagccccauccucuuuuuccuccuuuuugggacuguacuuuuuuuuaauuuuuuuuauuuguuugagacggagucucacucugucacccaggcuggagugcaauggugcgaucuuggcucacugcacccucugccuccuggguucaagugauucuccugccucagccuccugaguagcugggauuacagacacccgccaccaagcccagcaaauuuuuguauuuuuaguagaguugggguuucaccagguuggccaggcuggucucaaacuccugaccucaggugauccaccugccucggccucccaaaguguugggauuacaggcaugagccacugcgcccggccugggacuguacuucuuaucaucaccauugucuuuguugccauggucuucauuauuaucaucauaauuauggcuaucguucuaugucuaaauccaagcauuaaagaacaaacucccauauccccaugguaagguuggagaagugcgugcaagugugucuauguguguuuuuggcaauuuuaaaguacagucacaccaauauaugccacuuccauuucuugcuggaaguaaaaugagugacuacuugggcuuuguaaaagaaaaucgcacuuuggaaguccuugugggagccauaccaaaaugccuugcaguacuguaacuucucagaggcauguaaaaguuagaggauuggugaaguuuucaaaagcuacuggcacuuguccuucaggaugaacccucuugagaugcaggggagcaaauugaccucaauaagagaguagugggagcuaaauucacucaagaauagcaaucuguuccucagacagaugcaguuguaauuuuagaauguguacauaacagacaguuuaaaauggacauaauaacgcuaaaauaguaucaauggaaauuaaaaauaaguccuaaucccaaccaaaauucuagcaaguuguuuuguggauaucaacgaacugauucuuuuuuuuuuucuuuuuucuuuuucuaucuuugagacggagucuugcucuguugcccagacuggagugcaguggcgcaaucucggcucagugcaaccuccaccucccagguccaagugauucuccugucucagccuccugaguagcugggauuacagacaugcaccaccaugacuggccucaaccagcugauucuaaaguuuauauagacaguuaaaagaccagauuagcuacugcaauauugaaugagaacaaagucaaaggacugacaguaccugacuucaaggcuuacuguaaagcucugguaaucaauacauugugguacuggugaaaaaauaaacaaauagaucaagaaaacagaauagagagcccagauagacccauauaauguagccaacuguucuuugacaaaggagcaaaggcaaucugauggagaaaagguaguauuuucaacaaauggugcuggaacaauuggacauccacaugcaaaaauaaugaaucuuagguauaaaccuuacauccuucacaaaagcaacucaaaguggaucauagaccaaaauguaaaugcaaaacaaugaaacucauagaaaauaacauaggaaaaaaucucaguaaucuuggauauugugaugacuuuuuaguuacagcaccaaaggcacuaucugugaaagaaaucccugauuagcuggacuucauuaaaauuguaaacuuccacucugugaaagacaaugucaagagaaugagaauacaaaccacagguugagaaaaauacagauggugcugacuuaaaacgguucaacuuacgauuuuucaacuuuacgacagugcaaaagugauacucauucaguagaaauaguacuucgaauucugaauuucauuggacaaaacuauggaaacaguaaaaacuauucguaguugccaggaauuaggggugagggagggauaaauugaacacagaggauuuuuaggguagugaaacuguucugugguuacuacaaugguggauguaugucauuauaccuuugucaaaacccauagaauguacaacacugagagugaacccuaagacaaacaauguacuuugggugaaaugauuuuuuuuuuuuuuugagaugaagucuugcucugucgcccaggcuggagugcaguggugugaucucggcucacugcaaccucugccuccuggguucaagcgauuuuccugccucagccuccugaguagcugggauuacaggcgugugcuaucacgcccaacuaauuuuuguauuuuuaguacagacaggguuucaccauguuggccaggcugguuucgaacuccugaccucaugaucugccccccucagccucccaacgugcugggauugcaagugugagccaccgcgcccagcugaaaaugauguguugauaucacagaccauuagguuuauugauaggcuuauugauuguaauaaaugugccaaugucgugagggaugucaauagugagggagguuuuguagcagaggacaaggguguauaugggaacaaucuguacuuucugcuuaauuuugcugugaaccuacaacugcuuuaaaaagaauuaaaguuuaauuuaaaaaaucugcccaaucuccaaauucuaauacuuugauuccaucuuggcuacuucuuucuuauuugaaggcagucauuguaauauaguuauaaucaugagcaucuguauuuuaaaaugcuuaauuuuguuuuucagauaaguacccuaaacuuaaaugauauuauuuuauuuauuaaagcuaccugaggcagaaauguuucaaaaucuugaaaaagacuaauucaauagguuaauagcagauaaguagguauuuuugugucauacucuucaaauuauaauaacuaucacuuaaagaauagucauuuuuguucguuugugauccuuccaccucagccccucgacuagcugggacuauaugugcguacuaccacaccuggcuaacuguuguuuuuuguagagaugagguuucacuauguucuucaggcaggucucaaacuccugggcucaagcaauccucccaccuuggcuucucaaaaugcuaguauuacaaacaugagccacuggacccacccucauugagcuguuuuaacuacaacuugguaugguagaaagagugaugggccaaggguuaauagggugagauucuaauuuuaacuuugccaccuacaagcagugggacuuugugcaacaauguuuuaaaucuuucugcauuuaaauuuuucucaucuguaaagggcaauauacaauuucuguauucuccaguucaguuaugcuaaucgcuguccugucagcacccacauccccauauucacuuucacagauaagacuugagucgcuaugaucuucacccuaguugucacccuguccccauacucucugaauaugcuccucucuccucucauuuuagccaaauaccacucuucuuugaaggccagcuuaaguuucagauccuccauccaucccagaucuucuuggaaucccuaguucuuuuggucaguaucacuuaguuuagcaaagaccaugucuuaggugauugcucuaacucaccuuauagcauuaacccauaagugaguacuuacugaacucucacuguauauuagauuaagggcuuauuuuauaugccuggcacaguucuuauuuguuguuggaaaaauuuuuagagggcaguaauugaaaugucauauacuauagucuuugaggauggaaaagagcucaguaaguuucuauuaauugguuaugccguuaagaucagcaucuaaagagagcuaggucauggaaaaaauggccuaaguacuggacuuacuaucagaaguacuggacuuaaauuuuaauucuuaugauuugugaacauuguagaaauauacuaaugucuuugugaguacagauaaggaggaacagauaagcuuaugugaaaacucgguuuguauugggucuauauuauauacagggcuauuuuauuuuauuuauauuuauuuauuuauuuuugagacagagucucucccugucgcccaggcuagagugcaguggcgggaucucggaucacugcaaccucugccuccuggguucaagccauucuccauccuccugccucagccuccgaaguagcugggauuacaggcacccacaccacgcccagcuaauuuuuguauuuuuaguagagacaggguuucaccauguuggccaggcuggucuugaacuccugaccucaggugauccacccgccauggcuucccaaaguguugggauuacaggcguaagccaccaugccuggccuauuuuauuuauuuaucuaucuaucuauuuuuugagguggaauuucgcucuuguuucccaggcuggagugcaauggcgccauccuggcucaccacaaccuccaccucccagguucaagcgauuguccugccucagccucccgaguagcugggauuacaggcaugcgucaccaugcccggcuaauuuucuguguuuuuuuuuuuuuuuucuuucaguagagaugggguuuuuucauguugauuaggcuggucuugaauucucgaccucaggugaucuacccgccucagccucccaaaaugcugggauuacaggcgugagccaccgugccuggccuguuuuauuuuauuuuaacaacaaauagaaggugguuauuccaggaggguuucagaauacuaccccagauuugguuucuccugguuugacuacaggcagugcuggugucuuucucuugaucauacuccuuuccucauggguguguucaguccucugaugauagaagugcuuaccuuuauuuaaccuuucccucucucacugaguguucucucuuuccugaaauacuuuucauuuguuaaagcuuuuaagaaauucuuauuugaacauucaguguuauguaaaaaacaaauuaacugcugcuuaauaucauguuuggaggugaaaaauuuucuaagccuuuugcuuagccauuuauuaccaaagggguaucaagcuuggaugucaagcuaggauguaaauucuagaccuauacaauuccuucaagggcggcugaaaaguugcuuucuaauccuuuugcuauauuuugguggcaagcuuuguuuucacaguuuaaagaggauugaugguuuuccuauugucuuuccuucacaacuuucugaaguucacuugccuguuucauuuucaugacuuaagguaccagcuucuucugccccucuccuagauccaccagcgccccccaugcuccagaaaaauugagcuacacugugccuuucccugagcuguagaaaguuccaccucuagguuuccaggugcuucugaucaucauuuuucaauggauugaguugccaacaucuacaaaauauauucuaacaaagaugcucagaaugucugguguugaccuaucuauacagguaaacuucaaugacucugcauuucccuuucacugcugaccucaugccuuuugcagaaguaauauaggaaagaagagcauugaaauagggcagaagaucuaauuuucuuuuucuuucuugagauggagucucgcucugucacccaggcuggagugcagaggcucggucuuggcucacuguaacuccgccuccccggcucaggugauucuccugccucagccuuccgaguagcugggauuacaggcacccaccaccaugcccagcuaauuuuuguauuuuuaguagagacgaagcuuugcccuguuggccagucuggucucgaacuccugaccucaggugauccaccugccucggccucccaaagugcugggauuacaggugugagccacugcacccggccagaagaucuaauuuucuaacuuacaauguacucgaauauugaaaggaauuucauauuuuuagaacuaagcccucauugggguuggguacgguuagggcaaggagaagccugggaaggaguucuuggguaguuaaauuggaaaaagagagucuggcacauucagaauggcuccauauuuguuacccgcagacuguacauaagaaaugagaccuggcuauuaagagauaugaugccugugaaaacccuggauacacuugcaacuugcuuuuucccaaguguuuaggacucuaguagggacaccuccaguuccuuuuggaaauaagcuaauauuugguuuccaaaaauguauugaaguagucuuaaugagacaaauagaaaauagaaauuugauugaauguucuuacauucuuaaaaaugcuacuuuuuagcauuuuuaaaaauaaugaaguacauguuggggugggaguggagaagagacuguaauauuucuguaucugaagccuccauaaggucuuaauccagcccuccauaggaacauaagccauaauugucaucuacaacuuguuccuaaauuuacucagcuacaguuucucagagcuauugagggaaguacuacgaugcuauuuaaaaauacuuucaaauccauccuuaugaugaugaaguuauuauaguuacaaaugcaugauucagcaauaggcauuaggaaaacauauccaccagacagccugaugaucaugguguaugacacuuucuucugaauacaugaggguuagaugaaaguggugacaaacgauugagauaucuagauccacauuauuuaccuuuuuuuuuuuuuugagacagagucucgcucuguugcccaggcuggauugcaaugacacacuuggcuuauugcaaccucugccuccuggguucaagugauucuccugccucagccuccugaauagcugggauuacaggcaugcacuaccacaccuggcuaauuuuguauuuuuagcagacaggggguuucacucuguuggccaggcuggucucgaacuccugaccucagguuaucugcccaccucagccucccaaagugcugggauuacaggcaugagucaccacgcccagccaaccacacuucuuaaggcuagauaaauacauagcuuuaaguguagaguaaauggugucucacuugcaaagaagaggaucucuugguccucuccuuuccccaaccccaaauaauggcuuugcuauuggcaauguaaggugggucggaaaguuugugaagcaauggccaagggccuuauggaacaggcauacugcagggguggcguggucauaaguugcugaugaagcagauucucugucacucaugccuggugaacaggcggggacucccuucuucaagagagacaggugaugauagaagaguagacagcccugaacaaaccuuuccucaggauugucccuuuugguauuacucagaccugaauaauacauggacauguuuuauagggaauuuuuuuucagcuuuuugggugaucuauuauuaggaucuuauuaaaauauguauaauuuuaaaacuagguauacacuucuuaugcuuauaguucuuaugcaacuauagagccaaaacaaauuaauaaaugaaaucaacuauaucugagcagaccucaggauuugagagagagagagaaaaagaaaucaaauauaacuaugaaacccaauaaaauuuaaauuauuuuaaugugauagauaaugugguuuuguugaaacuaaucacuaguguggaacuuaaagauagacacaguagaaccauguauccucagggucuggucuauguuuaaaucuguuauuuaaauguauuaauuucaugcaaagcaugccuguuaguguaaguauguugaacaaauuguuauuaauagcuuugaggguucauaaguucaggaaaauaagaucuuaacccaaacucuguaguaagcaaucaucgaaugucaguuucuaugaggugucauuugauaauuuuuuaaauuguuuacucacuugaagauaggguuagcauuguguugauauuaaaauugguacuaaauggauaucuaauccauuuacuaacagaaucagggacagaaccauucuucuuuguguguuuaugccucaaguuucugcuuauaagcugguauguguuaguauguaaaaagccaaaguccccauagcacaucugcucacagcgugaagauggcaucgaauccuauggcugaguagauugaacugccucaugccaugcaacgacucaguuuucccaacauuuccucuauguccagauugauccuugacuucaucuggcuuucacugggcauuugugcaauuguaaacaccaaugaaaagccaggcagugaaauugcaugaugguuacugcuuguauuaaaauguuaaauuauaaucgaagacagaaaauuuuuuaaauccuagaacucuuguggacugcaagauauuuauccuuugagacaaacugcuuuaaaauuaaauuugggcuccacgguucucaggaaaacuuuucucauuuguggucuuuccuuuaaguuccauuaauaauuaaaaaugacaauugugaggacuucugaguaaugaguguuuauuaugcucuaaaauuuaagauaagcacuuuacauauguaaucucaugaaaaccuuguaauuggugugaggugagugcuuuggcuauuuuacaugugaggacacaugacaccaagaaaaggucaaucacaugacaaguaaguggcagcagcggaauuugaaccuauaucuuucucauugcaacgcccaagccuuacacacuaaagccucuucuuaugucuccauuucacauugugaaaaccuguuuaacugcaacuaggaaccagugcucuacaauuauccucuuacauuccugucuuuuccauugggccagugggucucaaucuuuaauaugcaucagaaucaccuggagugcuuuuugaaaaaugcaggucccagaugccacuccgaauuuacugaauaagaaauugucugugcaaauguccagggggccugaaucuuuuaaaacaaccucccucaggugauucuguugcaggugucugucugaucacauuuuguguaaaacugcauuagacuguggaugccucaagaaccaugacuuuugaaaaaauccauccuuguaccucaaggacucacucacuaaaugcuugucaaauaaguaaaagaaugaaugaaggggcaauugucaagaaagauguguucuugggaagaauacgcuuuuggccagacccuuggaaaauuuagagaugcauguuuaaauaucacuuaauauacucggucuagacucuccuuccuggaggccaagcauggcaaagagccgaugagagggugguagaaaguacaaaucuaucuauaaaaaaaagaaugaaaaugcuccugaccauccaggaugagauagaauaaaucuuccccugcguuucuaaaacuaaagucaauugaacuagaaauauuuaaaugcacuugaggcccagaaagagauucauuuccuuaauguuuuguggacuugacguuuucuacuuaaaucauagcucuaaggucaauauggauuuguuaccggcaaggggucccaaucuacaccccaagagaggguucuuagaccucacgugagaaagaguucugggcaagucuauaaagugaaagcaaguuuauuagagaaggaaagaaacaaaagaauggcuacuccauaggcagagcaguggcaugagcugcucaauuggguauacuuguaguuauuucuugauuauaugcuaaauaaggaguggauaauucgugaguuuucuggaaaaggggcagggauuuccuuuggaacugaggaucccuacccuuuuuagacuauaugagguaacuuccagauguugccauggcauuuguaaacuguuauagcgcuggugggaaugucuuuuagcauguuaaugcauuauaauuagcgucuaaugagcagugaggaugaccacaggucacuuucaucaccaucuugguuuuggugggauuugguagguuucuuuacugcauccugcuuuaucagcagggucuuugugaccuguaugugucuugugccaacguccugucucauccugggacuaagaaugccuuaaccuccugggaaugccacccagcaggucucagucucauuuuacccagucccuauucaagauggaguugcucugguucaaaugccucugacagauucauuccuguauuuagcaagagguuuuuuccuuuuuuuuuuuuuugaguacuuacuaagagucuuguauuuaauaagacauaguccuuucccuuucugaguuuauuuucaguuagaaaauuccgggagcaguaaaagagcaaugcaaguaaauggggggcuaguugcucagaaucugcaaauguaagagugcauggaaggguuuguauagccaggggacuggugcuggaugcugcaaauugaauaagaauuggaauaaauuggauagccagguagcaaagagcaguggaacagacacuuggcagucagauugcuuauggcuggcugguucaguuaacagugaggacaggagccuaggguggugggauauuugccuuggggagcauggggaaauaacauugcauagauggguuuucugacauuaaauagagcuuuggauguuguggaauuuugaacauuuccuuuaucugaaagccggugaaguguugucuuaagaugugacagcaguauguaagcaaauugcaggggauaagaaaucaagucagggagacccauuagagggcugcauucucagaacaaggagcacugaggaaaaaauuaaaaaacaaacaaacaaaaacaaaaaaagaagguugcuuucgguaguccagaugugaagggacaggguuuagaccagggugguggagugcagaaagaaaagccagagggauguggaaggacaagauggcaugaccacgaaugguggcaaaggcagcguggaacaagcacaucagcugauguggaauguaugagaacaaaaacacucauuuucccaccagaacccuuaguaggagaaagugccuuaagcuuacagugaggauuccaaauugaaauugcucaguagcuguuucacccuuuguuacuggcagagcagauggcucuggaagagacuaggacuacuuguugcuucucuuucccaucucucaccacuccccaaccuuaucccauagugaggaccacucacuagugacauuucugcuugagaccuacaaagcaagucuugcuaaugagacuuaggcacuuuuucccaaagugcaauucuuggaaaucuguggguuuuaaguagauuacagggccacaguuccguggucaaauuaguucaaaaaauauuguuagagaauuaagcaaguuucuuuacugcaggaugucccacagucuuuaauaugguaaucaacauuuugacuauccaagagagggcgagcuuagagcacuccacaaacuuuuuggaucauggagcucuuuuuaaaagaagcaccuugagagaagaggauggcacagcauauauuuaaagaaauuagggacuagaaaguuugucucuugcacuagagguugguagugucaugcaaagaaacaagaguugggauuuggguccaggcuuugccacuaacuggugaucuuggguaagucauugaaugucucugagccucaguuuccccagggguuauguucauucuaaaugaacucuucagcuccuuucaaaagucugucuucauauucaaaaaggaaaauaaucugcaauuucucuacucugcaauaacucuggugguggaggcagugguaggaaaagagagaguagagcggacagugacaagaagaugaauaagauacggucugaaccccugcacugauuagacuguugggcacaauuacagugcugggcugauguaacaaagauaaaugaaguuuguaguguguucucaagcuucucugacuccaaccacaucaugugauauacagcaacuaguucaguugcuaagcaacacuaauucccaauggucacuuaauccaucuagucucaguucugcuacuaagaagcugugaggccuuggauaaaucaguuaacccuuuggguuuggguuuucuucauccguaaaauaaggaaguuggguuaggucuggaaccauuuuuaaguugaccugagucuuaccuggaagaagguaaaggaaacacagcuauucuccucucacccaccccaugcagaugagccccaacauucugucuucgcuuuucuucucuuccuuccuccuggaucacuuaaucugucucagacuuuaauuauugcauuuauguaguugaaguucaaauguggaucucuaagaccaacccuucucuugaaugccaaaaucaagaugugucuaccuguuuucauucuaaggaaaccaaauuacuuauguuucaaaccaaacucacaaucuccccuuacaaaccaauuccuccuccacguuaaaaaaaaaauaauaauaauaacaggccaggugugguggcucacgccuguaaucccaacauuuugggaggccaaggaaggcagaucacuugaggucaggaguucgagaacagccuggccaacauggugaaagcccaucucuacuaaaaguacaaaaauuagcaggguaggguggugcgcaccuguaaucucagcuacucaggaggcugaggcaggagaaucgcuugaaccugggaggcagagguugcagugaacuaagacugcaccacugcccuccagccugggcaacagagugagacuccaucucaaaaauaaauacauaaauaaauaaauaacuaugugcuccuggucacaugcagcccagacucccaggcuuuucgacucccuccuucuucccuccugugcuagucauuggucaauucucaauccucuccacauuauuauuauuauuuuuugagacagagucuugcucuguuacccuggcuguagugcaguggcucgaucucagcucacugcagccuaagccuuccagguucaaguaauucucaugucucagccucccaaguagcugagauuacaguggaugugugccaccaugcccagcuaauuuuuguauuuuuaguagagacauguuuucaucauguuggccaagguggucuugaacuccuggccucaagugauccaccugccuuggccucccaaagugcugggauuacaggcaugaaccaccgcacccagccccucuccacauuauuauauguccacauuauuuauuucccuuuccugaugucauuauuguacaucaggcuuucauuggucauccugccccaggucucuccuccaaagcaacccacaugccagguucagccucacagagcuucucugagccugccaucccacucuccaaagccuuucccggcucucuugugcucacuccuugcuggcauuuggagcccugcguuuucccaccucaaucaucuuccagcuuccagcuuugucuucgauuaccuguguguuccuguccucccaccaacuauuuauuaaucuucuuaucccauaacuugcccauucaaauuguucccuuuucuuagacuuuugucugcauucuuucuaucugacaaaauccuagugauauuucaagagucagcucaaauaauggcuccucacuccaacaaaucuuuagggaacacucaacuggcuugauuucuccuucuuuuagcaccuuguucuuuccuuucuuacuaccuuaccaacccagacauauauaucuacuauaucuuguaauauccauuauaucuuuuuugaggccaaggaacauguuuccuucaucuuucuaucaacuauaguacauauuacauacuaggaacucagaaacgugguugaacaaauuacuauuaaauuauuaagcuauuaaaacaauaaucuauugaaauaauguaauaaucuuaaucuccuaacaaaauacuaauaaaauuuaaguaaaauaaauaaucuacaauaauccaaaaaugagucgaaucuugguuuacucuuugguguuuugucauucuacuuucgugucaagcuuagaaauaauuuucugaagaauuuugauuuugauuuuaguuauaacuuugcguuaguaagaccaucagccuacgguuaaggauauuugucucaccugugaaaucucacuaucuccaugaaaccgacuggcuucgcuacaucaugggaaggguguuaucuuuccuaguuggagcaucauaugaugaugugguugaaaacaugcacuuuggcauaagacagacuugguuuggaauucugacucugcccuuguuggggcugcuuggggaauuuaguuagcaucucuaaauauuaguuugcucauuuguaaauggaggauguaauugcaggugcugguucuacucuuggaaggauucaaaaauugucaugcuuacccgaggggcuccuccaaaccugggcgggguuuucuguaugccuuauggaccuacaaaugcaaaccacacugaccauguaauuuugggggcagauuggaaagcugaaacagaagugcagggacuguuggugcccaucuuccuggccugguggggaggaauguaggaaagcagacucgugcuucucaucuugaaucagacagacgacagacacuccaggaaauuccuuuuguuuggaaaagaaaaaugcucugccaucuucucuuaccccaguuuucuacauucccagacuuccuaaaagaguagaccacugggguucccugaaaagccagcuaaguccagcacauacgaucagccccacagcucauuuugguucacagacaauaaggagagaggacuuaacaauuacugagugcugaguacccacuaugugguaggaacauuuuguacauaauuacaauuaugcauccucauaacuuuaucacauaaguaucaucucuauuuuacaaguagacacuaagcaaccucccaagauuguacagcuaguaaaucugagugaggaagugaacucagauggucuacaaaacuuuuagcauuuguggccaggcaugguggcuuacaccucuaaucccagcacuuugggaggcugaggugggaggauugcuugaacucaggaguuagagaucagccugggcuacaauggcaaaaccuugucuguacaaaaaauacaaaaguuagcugggcgugguggcacacaccugcagucccagcuacuugggaggcugagguaggaggaucacuugaaccaagagguggagguugcagugagccaugaucacgccacugcacuccagccugugugacagaacaaggcccugucuuaaaaaacaaacaagcaaacaaacaaacaaagaaacuuuuagcauuugagaccuucagugugaucaaagcaaauuagcuuugugaggugggguuuccuuuagcuucuacgucagcaaaauugugaaccaacaggauuaaccuuuugccgucuuaguacugcagggaacuagcuuucagaaaauuguuugggggccgggcaugguggcuugugccuguaaucccagcacuuugggaggccaaggugaguggauugccugaggucaggaguuugagaccagccugggcaacaugucgaaacccugucucuacuaaaaauauaaaaacuagccaggcaugguggcgagugccuguaaucccagguacuuaggaagcugaggcaugagaaucgcuugaacccgagaggcggagguugcaguggcugagaucauggaucgugccacugcacuccagccuggaugauagaaugagacucugucucaaaaaaaaaaaaauacuguuuggggacauuuggguccuauuuucuucccugaugcugaugugaugcugaugauagugaguguuucaagaaccaggagaggcugguuguuguaaacauuccuauaaacguuggcucagagauuguuaauguaaguuuuucuggagcagugagguaagccccaaguagaaaagggcagaaguauaguaaaauuugguuguuuugucaacuuuguaagacuucagcugcauaccuuguuaggaaacuagaagccggaggaaaguugugcugagauguguagcauuuguucuugcuuuguguggccauuuuauucccauuaaguacuguauccuucacuaaagaaaugggccauucagcagcccgccugaacacuguggcacuguauauuguuauagagaguuauauccauucagagggacacaacagaucagaggaaaggaaagagguaaccauguaugcagacguggaacuguccccaacauguauaauagacaagccaaggugaaauguauagcauacuaauauucaacuuuuuaaauuuaaaaaacuaugcaucucaaggcaugguggcucacaucuauaaucccagcacuuugugaggccgaggugggaggaucgcuugauugccugaagccaggaguuggagaccagcuugggcaacauagcaagaccuggucucuacaaaaaauacaaaaauuagcugggcaugguggugugugccuguaguccuagcuacuuaaaaggccgaggcaaaaggaucacuugagccuggggguucaaggcuguagugagcuaugaucacuccacugcacuccagccugggcaacaaagcaacacccugucuaaagaauacaacagcaaacaaacaaacaaaaaaccaaaaacccucaaacacuauaaauccauaguuuuuauauauguguaaacuauuucuagaaaauuacucaaguaacugauaauuaguuauaucugaaggagggugauggugcgguggaaaugagacucacuuuucaucguguggagcagugauucccaguguguucugggauucuggggaguccuugagacccuuucaggagauccauagaucaaaauuauuuuaauaauaauacuaaguuguuuuuauucucauucucucacgaguguacgguggaguuuuccagaggcucagugacaugugccauugcagcacauugaauccagaagcagauacgauaauccaacugugucuggucaagccaaauauuuaagagauuuuaaaaaauguaaaaugaugucauucuucucauguugaagauaaaguuauuuuuauaacaauuuugaagauaaaguuauuuuuauaacaauuauuauucaacaaaauuacuauuauuuaaugaguuaauacacaauaaauuucaaauucucaguuuuaauuucuuaacugggcaaguaucaguuuagguauaaacaacaucccuccgagauccucugggauacauccaauuccuuuagugccuggugugcuuggaagguuucuguugcacggcgcuggacaggagugccaaagaggaaagaaaugugaauggaaccaaagucuauaauaaaauauugcuuucucuuuuucccagccuccaucaagggagaccugcaaguugccugggguucagugcucuagaaaguuccaagguuuguggcuugaauuauucuaaagaagcugaaauaauugaagagaagcagaggccagcuguuuuugaggauccugcuccacagagaaugcucugcacccguugauguaaguagguccagucacugaggcucuguuaccacaugagauugggagugguguggcucacauugaauccccccacuuauccugccuggugucacagggaaaguugaacacuugguuucugugccuagagcugcuaucagaugagaagacaauguauuugacuauauaggaaaucuguuguggacugucaauuaacucauuuucacuuccguugauuugguugugaccagcccuagauuagagggcaguuuuagaguguccuggccuagaaugucuuccucaguuuugaguaagccaggguaccuggccucuuucugggacuucucugcccuuacaggacccacuggaaucuguaggguuccagcgucaaucuguguuuucuaauauuacaauuuguuuuuauuuuuuauuuuuaacaauuauuuuauaaguuguuuucuucugggaauaauuugaggugauuuagaguaaaacaauacuuaauagaagcacuacaaccaggauaauaguacaagaguccuguaauuauauuuugggggaauuaaauguaagaaaaccuagcccagggauacugauugcagauucauacagcgcuuagcugggacucaaggcaaaaagagaagcaugcuauauugcagaacuuuuauuaggaaaccauuuccacauaucaagguggucugcugcaggugaauuuuggucugaaugggacuucucaguucauccuuuggcaggcuaaaaucccacugaggaucuagaacuguagcaauuucuagauugugucugagaccuucccagccuggagcuccauaucuccuucaugccugugccucuagcaucuagcacagggucugacacauggaggaugcucagcgagagcccucagauucaacuuaggcuuuacuguauucugcacagcuucuggaaugagugcugaaugaaugaaugagugaguaaauaaugugaaugauuauugggauaaggguggggcuaaagugguauuuucuuacauuccccagaagauuucuucucccugucaagaugcuuuuuggauuaucucuuccuuucuguuuauuaucuagggaaugccucgcugcucuuuagcuuccuggugguaauaauucacuucauaguuuaaugucuuagguuuccuucuucccacagauugccuucaaauuugccuuuucuuccucccucccuuucuuccuuccucccuccuuuccuuccucuuuuccuuccuuaugauagacucuugguaugggggaguuaagaggucuuaacuugagccuucacaguguauauuuuagaaugaauaauucauugcuaugcuucaccaccaaccagaaauuauuacaggguuucucuauuacaugagauuuuucaaacauuauuuaucuaugauuuguuccgcuuuaccuuucagaaacuaucacuguggucuuuucuuccccugccacuggaguuuuuuuuuuuuuuuuauuuuuuuuguuaacaggguuuugcucugucacccaggcuggagaguagcaguguaaucuugugcaaucuuggcucacugcaaccucugccuccaggcucaaauuauccucccaccucagccucccaaguagcuggaaauacaggcacacgccaccacuuuguauuuuuuguggagaugagggucucacuauguuguccaggcuggucuugaacuccugagcucaagcaauccuaccaccgugcccuccuaaagugcugggauuacaggcgugagccaccaugccugggcaccaaucuuaaacaaugauuuccauaaauuacuauuagaauauucaaggcauaugcuauauauagccuuguccugugaagccugauuuuggugcacuccuccacccccacugucauauuaucccuggaacuaucucaaacaccuuggcuccuccaggaagaguccuucuggucaccaauucaggcucauucucuuucugggaacgaucagacugaguuuuucaaucuguuuagagauuuacuaaguuuuaguuucuuguguuucuuauuaauagggagaccaaauaauucagcauccaaucuggagaacuaaugaggacaggagaaguuauuaauagguaaucuggaacauaaggcauacucuggauggguagccaccugcuuuucaaagaucuugccucuuuaauggguacugagagcagaaggguaacaacagccuuuggagauugaacuccugaauucuguucaguugucuggggcuagggaacucugacacagauauuguagcacugaguauuucuaacaagcuguggggggccuguccccuaguggauguuagaguucccagagggagaagucaagaccacugcagcaccgacggccccgugcuuaugagauccaguggugguaccccuagucagucuuccuccacccucuccuuccucuuuucccuucuccuccccuucuucccuuccccuccccacuccccagucugcucccuucucuuuuugauccuuauucucucccucucccuuccaacgcccccaccucggcucccucuuguuuuguuuucucuuuccaucgccuucucuuucuccauuuucuucucucccuuugccauucacagugucuuccuuuccuuuucucuucuaaaauggcucuuccaaaaucacuggagggcagcucaaaagagcaacucugccaauauuaauuucuccuugaaagggaaaagccugcauuuccaauuaugacuuagucuucauuaguuagaaacugucuuuuuuccacagcaaguggccuaggaaugguguguuucucgcaagucucuggucggagguccugguuuuauguauucugcugugcacgcuuucuagggcaugaagacagggcaggcugggccauuggagguggggguggcagugaggauggcggucuggcugugacaggaacacaccuggaaaugucugcuugucacagaauggauugcagcugaaguaaacaaaacucugugaucauguugcugcauaaaccucgaugucugaaauuugggacgauggcugugccaggauuauuuuagaaaggcaagcucaggaucaguguucaacuaaccagagaaucuacagcugcuguggaugucccuccaccagagagagagagagccuagcagaaacugaggagagaagcucuucaggccgcucaauggcucacgucuguagucccagcacuuugggaggccgaggaggaaggaucacuugagccagguuggagagcagcuugggcaacguggcaagaccuugucuguacaaaaaaaaaaaaaaaaaaugccagguaugauggggccugccugucguuccagcuacuggggaggcugaggcugaagaaugguuugagccugggagguugaggcaugguaagcccuguucacaucauugcacuccagccugggugacagaaugagacccugucucaaaaaauaaauaaauaaauaaauaaaaguucuucaaagaggaauggaggggaggaaccaagggcugacauggacaauucuagguaaacagggcuccagaaacauucugaaaagcauaagcugagagcagacuucaguaacaugaagaaagaacuggggaggaggggagcggucuagagaauaacaugcucuuauuuguucaugggauucauaaacuguggacaauauuuuuauuuaccaaaaagguaacaaaguuuauugagcaccugugauguguaagggacucuggaaguauuuugaagggauacaaauauaaauaagagauaacuccagccuugguuucucaugggcuaauaggaaaggaaaggaaugaaaaagagaauuacacucaagggagguaagcaugagucaggaccugacaaaugguugaaggaaggaaaggacacuuguagcugggauguucaaggaacacaugcuuugaauauggaggguguggagcuugaccuaagccuugggggcuaggaaggaauuugauaugcagaaggaaagaugugggucauuauccuuggagcugaccuaggcagugaggacccagagugaucuggcgaacacagacugugcugggcauguggaguggaggggagguaggaaacggcugucuacuuggggcagaggauuggguugaggagugguggaagauaauacuggaaaagaggacacuugccagaauguggaaagcccugacuguuggcugggcuaagacaucuggacagucuggacaccauuuuagggauucagcacgugcguuuuacgugcucuagcagggaaggaugacuuuacuguuagagaugcucauuucugaugucccucucgcugagugugagugcaguccugaauaagauuaaaggugucauaacuauaaaccauuuggaaaauguaaaaauauauaugcaugagacacuuggagcaaggauuuucuaaggucucaauuucuuguuuuugcuuugauuguuauagcuuauaagaguagauuuaaggguuagccacaaacucuauuacugucagagcagauuugggcugcuagguagaaucuuauuuucacuguuucaauucucauuucuuuguaauuuuuuguauuauacuacauauuuuagccccaaauugugggcugcaggaacaacguuaaguauuucuugcuggcuguguucacugaauugcuuccugagccugaacuugcucaaacuuccuguuuuuugggcacagaacuccugguuucuccauuuaugauggaugagagggguuuggagucucucuucuagacuuucauagcauguuucaggauuucucacugauaucuaauugucuuauaagagacauuaaauuuuuuucacacucaaaaauccaugauccccucuagguaaggucugagucucugucaaacauuuucgcuuuuguguaacauuuagcacaguauuuaucaggcauuauuuuguuuggggguagaggagguaggcggcggugggcaguugggaccccccguacuuauguucugcuccaauauugucuuguagaaaauggucuaaaauagaucuuuacuaucugaaauaucaucuagugagagcauuggcaucaucaaagagcuuguuaaaaaugcaggaucuaggaccucagacuaaaucagaaucuguaauuugauuggccuuugagacuugcuggucuccagauguaauguauacacaucaccuagggaucauguuaaaugcagguucugacacucaauuacuuagguaaugaucaaacaaccagaucuugaaguuuucuaacaucaaagcagcaacuuccuuucuagaguugucaccggacaccuucccuccugagagugacacuucugcacagaacagaugguuuaugacaggaguuggaaaacuguggccugcugguggcauccagccugccaccucuuuuugcaaagaaaguuuuauuagaucacagugacgcucauguauuuacauauugucuguggcuucuuuugugcuguacugacugaguugaauaguuguaaaggagacugcaugacacacaaagccaaaaguauuuacuaucugggacuuuauagaaaacaguuugcugacccuggcuuaugugagugacucuaaauauuuccuuaaagaaucaaauagcuauacucucuugccccaguggcaaacuucgcaagcccaucugaauccauggcuauucauagagaagcugaaccauaaaccgucauucccaggcaacccacaaagggucuugagccuaaaauuggucuggauaaugguaccacagagccugugacuuuccaaaauccauuuaauaugucccuccucaaagaaaugguuauaauuuuauauaauuuuauugagcugacucccuccuccacaaauugauuucauuaauuguucaacauaagucugacuuuccccaagaauuggaaucaaaaggaaauucugaguaaaaauauaucugggaccaaggaaauaaaaagacuuguacaaguugguuauaauacacauuuuacuccuaaaaagguagcguugguuuuggccccacucuggccuauucacugggcagacuguaugggcuuggaguccuucuuuuaauucccuuggagaaucccaccaccugucucuuauuuggguuuuugaauugugaaaugauggcacacacaagcuccaagaauagcugcguguguacaccaagcauacagagacagaaggcagagacuuaggccaaggaucaggaaauacagaagagaagcuggcauggaggcaucugcuccacaaacacagugaagccggagguuguaggaggagggaggugggacccguguaaucacuggaggaugugggcacucugcucugcucugcaagucuuggagaucuugguuuucuuuccagaaccaaauuucagaggagguggguguaggagaauugagauucuuuuuccucauccagaguuaucuggggccaaagagguuuagggugagauucugugggaaucuuugcuguagcuccagaagcuuuauucuuacuuaguuccuuuucccuuugucugcauaguccaggacacuaaaaggguuugugaagaguccggguagacauaaguggagagucuucuccuuaauucuagagucuaucuugacuucaaccaauuaaagauuguaggagugaauuagagccccuuauguuaaaccuuguuucuuggaagcccuccuggaauucccuaagaugcagagcugauuagcuuagcuggucagaaugugaagguuuuaaagccaaaguuauuauuugggcugauauuuuagacauucucuucauuggaagaaguacaauguauucauucauucauucauucacucauucauucauucacucagugaauauccauugaaaaccuauuguguaacaggaugcaggaaaaaccugaacuggagagucagacacaucugaguucaaauucuaguuucuugaucugugagcuaacuaacaccucauucagcuuuccauccaggugacauaaccaccccagcuuccuucccugaaucugcagguuagguuggacauuuacuucucugcuuuugcagcaacuucuacaccgucuguucucauaccacauuauauggaaauuauccauuugcagucugucucucucuccagauuguaaagucauugauagaaaagagcuucauuucacauacuuuuuuacccuuagugccugacauauauuagaaauuagacauauguuuauugcacugaaaagaaccuaauuguguggcuuaauuucccuaaagcauguguuucucaucuguaaaaugaaggugauaaaaacaugccuugugaguuuuuugugaagaucaaaucagauaauguuugaaugaguguuuuauaaauaugaagugcuugcaaauacuaauaguuguucuaauaucuggauugauugcgauucaguagaaaacaagcagaagagaaucaagaaaguauguggagguguccuaguccacuuuuucuaaacugaauaacugaacgagggggaucuggagacuucagcuucugaggcacaguuugggugugugggguugacacgggacagaggacccuuuccagcaagcucgaugucucugccauuagauuauauacucauaacaguggggauauguuuuauuaauuucauugccccuuuauucacccuaagcauaacuaagaaagugaauauguaauaauuggauuucaaugggcauugcaaggccaaagucuccugccccccaaaucucccaguaucccuggccuguauguaucuuuucuugagaaccugaauaauggaaccauuagauugaaaacauagauuggggagaagagagugaguugaauuugaaaaauguugagugugacaucuggcagucaaauaugcagggcugacucauuucacuuuucaugugucuguuuuagcucacaaacuagacauagagcucauuguacagauuccauagugcuuaaugcacuggcuaccccuuaaaaaaccuauagagcuugcuggaggggguccccuaucucaugucaacucaauaaauaaauauguauggauuuguugcaaaauauuggauuuucuuuuccauguaaguaacaaagaacugcugcagauauuugagcagaguuguaaaaugauaugaauuuugcugugagaaaacuugaucuugcuguaauguaugaaaaagacuagaagggaaagaaguugaggguggagagucuuguuaggagggccaggauaagagcaggugggcggugaaggaggcugcggcagaaccaugccaagcagaauggaguggaggggacuugacuacacaagaggcuggugacucagcuuucugccuaguauuaguccuagagaagucucccugcucugggaagaccggugucuagccucauguggcuucggaacaaaagccagugauugcauccaagggaagauaaugagaaacacacaggccgugaaaaucaggaaagcaccacuaaucuuuuuguugcaaaacuuuacuuuucaaaguccuggggaagggugcagaagccucagcacguggacuugagcccuguacucggaaaugcaaaauggaaacccccuaauagaucacagaacugaaaauauccaagagucugagaggcugggggaggacaggagugagaaaaggaagggggcuggaguacugaucagaagauaggagaaagcaacagugcaaaaugcggggaagggcugaguagacauucaauuuaaucuggacuuuuauuuugcuacaaacuaauuuuaugaagacuuuuuuugcccaaauauuaaauauuuauuaauuaaagauauuaaaacaggaaaaacugcuuucauucaauaaaaacucuaguaauucuuccuaacuccagaauuguauguauauguuuuaccuauuaaauaaucagaaauagaaacaaauuagacaagauacgugaauaaccuuaaaaauuuuccauaauauuugacuuaggaacuuuaguuuuaugaauguacucuaaggaauacccugaaaaggacaaaaucuauacacaaagauuauacacaaauuuauuauagaauuauguacuaaaaaacccuaaaugaccagccuugaguauaugguuaaauauauaaguuauaagccuuuggguuuugagaguuuuagauaacacaagaagguauuuaugauauuauauuaaaucaagauaaaagucacaauguaauauaaagauauacaaucaaugauguaaaaguacauagaagaaaacucuaaugaaaauaugccaaauuguuaacuaugaugacuuuuagguuacggaauuaugggaccauuuuuguuuccuuaugcaauugaaaagucauaaaugagcaugcaucacuuuuucaucagaaaaauaaaugaguuacauauuuuuuuaaagggaagauauuguaaaggaauauuuguugacagaaugcauuaaaaaaccuagguaauuuccuuauuucccugggauucugagaauuuuuuuacucuugggaauaucuuuccuugcucuuaguuauuuucauauguuagucuuguuccuggggauaaaaaaugguaaguuugcuauuugagcucugcucgaacauauggaguaguucucucuuacauauacagaauugguuugacauucaaggucuuucagagucaaaucccaauugaucuucccaauuucacuucccuuaguuuccuacguauauuuucuacacaaaucaaaaaccuuuucagacuuccuauuucuuguacauguccauaaccuccccuuucugaaacucuacuuguuccuggggacagaauguucacagagcaugcguuaaacaucauaaaguggaucgggagccucuuuuaacauaaggcugugugauuuugacaaggcaguuagcucacccucuagaucucagauggaacaccuguaaaacaagggacuauguuguagaugguugccaacauuccuugcagugcuacagcugagugaaccuuguucccucauggcccuaggugugcucauucaucugccugcaccuugucucagguucccacugcaucuuaaguggccccugcccaccccacugucaaauuugacccuuccuagcucauguaccauuuccuuuauaaugccguccucagugauucugauuaacagggacuugcauguaugauuuuuuuuuuuuuuuugccacucauacaggcugccuuuuaucaaaacuauggcacaugucaaugauauaacagauaauaucauuugaauaaaaagucaacuccauggggaggaaaaaaaccuacuuaagugagcuuuagagauaaaggugaacacuucucuaaauccuuuguuuauggucuguuaaucaauaaaguccaaucugugauccccagauacauaagaggagaaggauauguagacuauuuaugauauuucugaaaauccuaagaaaaaucacacacaggcccacaguaagucuauguuucuuuauuuugagucagaggauuucuuuuuuccauuuuuaaccaguauaaauugguuuaaacuucaucucuugaauaacuccuaacaugaccagagcccuuuucuuccuucaaauuuccacaaaugcauugcuccccuuuuuucuuuucaccacccauauguccauguuggacaaaaaccaugaaggaaggagguugagaaacuguguaccaaaacgccaagagcaucuuugccauguuccagcacaaagggcacuguuagaaggaggugaucagagucaucuucugacucaaccucacaagaggagucagguuagaugaacaguucccaacuauuuacucuccucucucucucauucucucucucgcauucuuuuuccuucuguuuuuuauuagcagcacaaaagauuuugaagugcuuaagggcagaaagcuugccuuguucaucuaugcagcucuugcugggaccaaguauggugcuaaacacacgguagacauucaguaaguauuuguggaaugaaugaaugagcaaaugaaggacagguguggcuucgauggcaaugggucagugugaacuccggaaagaguaugcagaguuauagucaaaguggaugauggaucauugcucugacuuacuaguuauguaaucuugaguaaaccccuuuaucacugugggauuaauuuccccagcuguugaaaaaaugugugugggggaaagggggaggguuagugauuaaaaauguguuccauaaggagcauguauguaaaaucaucuggcacaugguugcagcugaauagcuggcauuuauguagcacuuuauuuuuucugcauuuuuuaaaaauuaaaaaccugaaaauuguuaaguuguacuaaccucaaaucucaccacuuaagaauuauauaaaauaagaaguaaaauuucucuucccagccaacuuuucuaauuccccagagauaacuacuuuucuuaacauuuaaguuugauguuuauccuucuugacauuuuucuaaaguuucauauauauauauuuuuuauaauuauuuaauauauauguaaacucaugaauauauauaugcaaacucauaaauauauauauauauaucuccaugcaacuuuggauggagauauauauacacacauaucauuuucaaaauggaacuauucauauaugucuaucuaucuaucuaucuaucaaucaucuaucuaucuccaagucaauuauuuuugaaugauggcagaaucauuuguuguuugaauauaccauauuuugcugccagucacccaguuccaguguuuugugauuacaaacaauaaugcaagggucuuccuuguacaucuauaucuguaagcuuuuguacaguacuuacuuuaguaauaaggcacuugaacacuuauuauucucuuuacucauaaccaccacaagaagaaaggacagaaauuguuauucuguguuacagaugaagaaaaaggagagcuaaagggggcaacuggcuuggccagagacccacacagauagacuauggcagaccccguguuucccaguggcuugaauuuuuguccagagcucuuuuugucacacugcaauaaagcacaagucaacaggaaaccuuuacaaccaggcagagaagcuuggaucagggagcaggcagucacacuaaauuguagaaaagaacaaacacacacacacaaacaagaagcucgaggccaaacacauuuaaaggauauuauuuggaagaaaugcacugguggugagugagggaccagcauaagaagagcuguccuuuaacuaguuaccauguuuuaugcaauguucucaauaugauauccaaaugauuaggauggcuuagauugcauaaaugaggcaggagaaugacaaaggacacccccacaaccccaacaaugacacuaccccucucccucaagggaagugucuagggaaggccagucagcaucugguuaggcuuggccuuaauugucaucuuccucaauuaucugcaggaaauauuagcuguuauuaaaauuugcagaugcagucaauugucagagucacuggagaccaagaauuauuacucagagcauuggagagaggcuggaaagaaaaagaacaauucagccuggaaaaauguaaacuaauggauaaagugagguagggggagugggggaagaauuuagagggauaaggccaguaguagggugaggcagugaagcacuccccuggaguacaaacuuuaaggggaugccaaaaacucagcuaucaagauaaauaaaauuuuaauucaauauugaaaaaaaucaaguuggcaaaugacagccugugggccagcagccuguuuguaaauacaauuuuauuggaaagccacuggaaguaaagguacuguggcaggggagauccaggcuaauucuuugaugugaaaacccugguuaggcuugugaauguuagacacauuagaccuuagcuugugauugaugggaaaaauauuucugaagaaaaggaauaauggaucugacugcuuuuauggguuuccugggguuacuguaacaagugaucacaaacuggguggcuuaggacaacagauauugauugucucacaguucuggaggcuagaaguccaagaucaaggugucagcagggccauauucccucugaagguucuagagaagcaucuuucuuugacaucuaauuuuugauggcucuugcaaucacuccaaucucugccuugauguuuacauacucuucauuguguaugucucucugucuuuguguccgucucucugucuuuguguccacaucuuuuucuccuuucccuuagauccuagucauugggugacaucccaauccagauaaccucauuuuaacuugguaacaucugcaaagacccuaguuucaaauaagauuacauuccuaagauuaccuaugaauauaaccuuaacucuuugguuccuuauuuggaaauagggucuuucuuggacacgauucaacccaccacacuguuaaagauaucuuucuaggacacaauucaacccaccaugcuauuaaauagguagggauguggagagauuugacuuaggcgcagcagaaacauuauccauucacagaaaucuggcagcggagucaggggcagacuccugacaugauuuaaauaccuaagaaaauauuuaaggaaaaguacuuuaguuccuuuggggcgcaaauauuauaaccuuugcucaugucacauggugacaaauacaugcaggauuuuuaaggguaguucugauuucaaacaugcaaacaauagugacuggaaauauuuuuacuaaauuuuauauuccuuuuguuacuauuuuauucuucucaauguaagcaacuuauuaaauuauuacuauaaccgaauauaacaacuuuuagauauuuuucacaaaaauucaccaaccggggaaaaacguuguuuguaaaaugcaguauucugauuuuuaauuuaugaaauauggcuguuaugcuucugaagccuguucaaaggcuaugaaacaauggagaugaucgaauaccauuagaauuuuaaguaaguugaaauguaaaugggaaacaaaucuauuuucucccauuuuccaaacacaucacagucaaguccaaaaauuugaauguuacauggcuuuuuagugaacacuuuuguuauaaacaugcguguguagguauacuuaauuguaucagcaacaauaacauuaguuauuuuaauuauuguaucaccaauccuaaucacuaaucaauaaauguauacucauuaauuaauaauucaauaauaauggcuaauauuuaugaagugcuuaugugcuagacagaagaauugaucccuuuaugugaauuauuuaauuuaugaauacaguaauucuuccuuagaauugguauucuguuuauuugggcuugaaauguucuacauauuauuuuuccugcuuuuggucaggagucaccagcccauuuaaagagagacagcuguaucuuucuguaacugggcuauuuucucuaugagugcauuaauguuaacagagaagcauggccagcaagggcugcuagcacaaagugaagggcccugcugugaugaacagagaaauugggaacuuuaucauugcugcuauagacauuaucaacuaauaacacguuuuuaaaauuccugaaaagaguuugcuuucuaaagguuaaaaagguuuaaguucucccuguaauuuuguuuauauagaugauuugcuuuguaaacauuuguuuuguuuguuuguuuguuuuugagacagagucuugcucugucgcccaggcuggagugcaguggcacgaucucagcucacugcgaccucugccuccuggguucaagcaauucuccugucucagccuccccaguagcugggauuacaggcaugcgccaccaugccuggcuaauuuuuguauuuuuaguagagacgcuucaccauguuggccaggcuggucuggaacuccugaccucgugaucugccugccuuggccucccaagguacugggauuacaggcgugagccauugugccuggcacagcucuccauuuuaaggcuuugcaauugauugaaucaggcucguucagguuaccuaggaugaucuuccucacguaaagucaacccaugauggauucuaaucggucuacagaacuucuucacagcaacaccuagaucaguguuucaguaacuggggucuacagccuagccaagcugacagaucagaagagccaugacaacaaugauaaaagaaacuguugcccucuaguuuccuccugggcauuaauaauuuagcuaauauaaacccaauacuuuggauacgauugacugaauucagcuuugcugaugccucugauuucaguugcuuuaaccaaaugcaaaccccuagugcuucuguugucuguugauacccagaggcucaugugaucuggaaggguaaguggcuucucucugauuugccagaagaaagugguuauguuagcugaggagccagaacacuaauuucagugauuugacucugguacaaguggugggaggcccgagggugggaugcugcuuuuuccuuuggcccugguaaacauuuuaugcuuguuauggugguugaaaugcuguauuuaaccuuuucuucaugugccaggagguucacaguaaaugagggguguggucugugaagggaaaaguggcuguggcuuggccucuuuguacccugucagcacacauacacgcauggucuguaacaugugaaccuaucacgugggaacucauuacugagcugugagggcugccccugaggagcugggggcaguggucgggagaggagaaggucguggggcacaguagaaauggcaccggacugggaaugaguuccuacugccaacuucucaucagcucaguuccuacaguccucuacuuacuccuucguugcccaggacauuuauuuaaugccaggcuaagcacaaggcuuccaggauucagcagugaacaagacagaugcuacccuugcccuuuuggagcugacuguugagcaauuuuaauaaauagcaaugaucauaucauuagcauuucccgaggguuaccaugucccaaaugugugaguuaugauagaggaagaugggguuauucuaggugaaggccgagaagcuucugggaggcagugacuaauaacuacugccuuuuuuacuuuggagucauguccuuucugugacuccccuuuccuucuccucuguguucucucccuuggccuugucaggcugccccuggcuuugguucucucuuccuagucuccuuucuaauuagccuuucuagcccaauaaauuaagcucuugucuggaaucucuagcucccugauggacaccuccucgugaaagcccucaguaucucaaagacacaacaucugugaagaacucaacucuuccauuguauucuuccuucccuuuccugucucugauaauguuaucacaauucguuuugucauuuaggucaaaaacauagucaucuuugaccuaccuucccuaucauaccuaccagucacucagcccuacccugucuauucccaugaugucucucaucucucccuccauuuguuugucacucucaauggucagacugucuuggucacuuuucugggcaauugcuauaguuuaaugcuugcaguuuucccucaacuuuaguucauccucuuuagagcuaccagagcacauacucuugauacaucuucuugcgucacucuguugcucaaaagccuucaguggaccacugcugggcucugcagccaggugcuuguguucuaaaccuggcucugucacuuaccagcuugguaacuggaaaauuauuaaccauucugugcuucuauuauuucaucuauaaaacaauugugucugucucauagaguugugauggggauuaaaugagucaacauguaaguagugcuuauaaaaaaaagucugacauaauuuuagcauuccguccagguagaugcucuggcuccugguccuccacauuuucccucuugugccuugacuuuuugcguuucuaacuuuucccuguuauauuucugaauaguuuuuugcaaaguagugcacaaauuagugccuggaucuacacaaacuacaucauacaugaugcucuugucuuucuucauauucuuuuaaagacuauauguuauauauuuaaacacauaugcauauuuauacuaaacuaaguauauauauguauacacauauauacauauagauucauguauacuuuauuguuucuucauuaauugaccaaauguuuugauggugccucuaaauaaguaguacuuaggcaaaucuccacucauaguauugugguaaaagauuaacuuuugaaaacugcccagagaacagcuuucuaucacauuaaucaugagauacaguuuuguuuuuuccaauguucuggcggccauucucaugaggauggacugugcugacugaucucagugaaaguuaccagugggcauguucucggggccucucuguccccaugaagcauccccacucagagacauggaaaaccugugagaugagcucauacaaaugauuucugggaugaaaauagcaaugugagauagugccaggaacuucagguucacagaguauaauuaagauuuuuccugaaucauugcacacuguaauuucaucacaucauuauguacguucuuuaauuaugggcucuaauugcccauuuuaguucuguaauuagacauaaagacauuaauuuuguagguauaacaaucagcucaaauguacuuccaaauucuuuccccuaccuuucaagaaaaauuaauacaucauuaaaaaguuugugcacagaagagccucuuagagggcagcuuuugggagccaguugguguucucaaagguggggccccaguucagaaaggguaugggaacaucacccucuuauauuccccauaaacuguguugcuucaugucagauagacccuacuggguccagggcagggaagagcuccauuaauucacauagggccgauuucucuuaaucguaaaauuuuaaggugacaucaaugcuuaaugagucaugggagaggaaugaacuaauguuagggcaacucuggcuuuuuauuucucuuguguccuauuaaaagaugagaagaugaagcauuuuaggcucaugggguuuguauuuuucauuugugcauggguagcugauuaucaucugucauuaugugcguguguguguguguaugugugugugugugagagagagagagagagagagagagagagagagagagacagcaagagagagccagaaucuguuuuuuaagaacucucaaugauucagaucuccauuuuuucccuucaccuacagcacuuuaguuaaaacaaaacaaaacaaaacaaaacaaaaaaaccgacgaguuccagcauuuccccccauggaccaugcuauguccauuucagccgacacauuuuacauguguaucuauuugccuccacuuacaaauccaaggaaaaaaaggcagugugguagaguagaaagagccuuaguaaggguccuggccccuuuuucuucccuuuuuacacauacucucucucuagguaaucucucuauucucguccuuaaaggccguuuauaugcuuuugucccuccaauuuauaucucuagcucaggccucaucucugagcuccagauuagauaacaaucagaaugcuuauuucuacuuggaugauuuacagauaauuuaagcuugcuguguucaaagcuggguuuacuuuccuccaaauguauugcuuuucuauucuucccaaacucaauaaauggcaaaaccauccauucaaguacucaagcugagucauccuugauuauucuuucgacauaugagccaucagcaaggcuuguuucacccuccagaaccuaucuucaaucugucuguuucccucucccucaauucaggcugcaaucccaaugcagaguguucaguaaagcaaaagggguggucugcucucaccaaaagcaauuugcaugcucuuaauucacggauggauuaccuagcacuuaacacagacccagauauauuugguacucaguaauauacacugaagaaugaaugagugaguuaaugaauuaaugaaugaauaacagaaacucuaccuccuaggacuuaauaauacagagcaggauuaaccugcuuucauaaguaaucagugaaccugguaaagugugacauuuaucuuuuggugaaagcagcucaccccuuuugcuuuacuguuucaccagcaaucucuguuuuauuuuuaccuguucuuuuggacacacaauuuagucagaaauuugcaccugagucuuacuucugccaccugcuaguauaaagaucaacuggugcagagcacuauacagagauuauuuauuguuugcuacaauguuggauauagaguuuccucucuaggaccucuuuaacugggagggauaaaaauggcacaacuaaauuuucaugauuuggauaagaagagaaacauugggugggcaugguggcucaugccuguaaucccagcacuuugaggggcugaggcggguggaucaccugaggucaggaauuugagaccagccuggccaacauagggaaacccugucucuacuaaaaguacaaaaaaaaacuagccgggcaugguggugggcaccuguaauuucaacuacuagggagccugaggcaggagaaugcuuggacucgggagguggagguugcagugagucaagaucaugcuauugcguuccagccuggccaacaagagugaaacuccaucucaaaaaaaaaaaguagaggagaaacauugcuucauucagaaagugcuuccuaagagauucccaugguccagggaugaugcuggaugguggagauguagaauaauguagagauuacaggguagcagggauggggaugcacuuguaagccaaugaguagaagaaagggguucuggcgguggcacagcagcaaccacaggacgaaagcaacugcagaggacaugugcucaauucugugaggggacgauggcgggacauggaaggguccugaucaugucgauguugauggcaagucuaccagucaaaaggaacaggugagcaagggccuguagccuggagguggcuuggggcuuucaaggaaccacuuuguuagaccugcuaaagcauguguuucaaagagaauguacccagcucgaagacuugcacauuguaggcacuuagcuaauaucuguuuaauaaauggauaagugaauauaaguggcagaaagacagcugaguugcugggacaggugagaucauggaaggccuuguguaucaugcuaggaucaguaaugggaaguagagaaguggucaaugaaguuuuauuuaagcagaaaagagacccuauuggguugaguuuuagaaaaaucccuguggcugcagaaaagaggaugguuuggugggaaugagacugaagucaugagcacagacaggaaggguaacugaacauuuugagagagcugaaaguguagacaggaaggguguucaaagauuguuggaguucagagagaaguccucggccuggccuagcaguguagacagccaaagacagacaaguaguggaaugucacauucuaguaacugauugaaauguguguguguuuauaggcaagugaguugaaaacugugugugugcuuaaguuggaauguacaugugcauauaugaaggugauuugaagugugugugugugugaaugcagugugugguagugcauuggaacguguguguguuuacaugagugcaaguggacagucaagaauggugucuaacacuuaccuauuuggucuaaaggcucauaaaacuucugccuuacuccuggucacaugcuccaagucacaagcagaaaugggcagaacagcucggccuuguaauuccagccugacucacacuaagcuguuuccaaccaagugaauuaauuucucccuccuuaugcccacacagcacuuuccucuacaacaauuguuacaccacuguuguuauuaguuuauauaauacuuuacccccugcuaggcugugaaauccugaaggaggagaaaauauguuauguaucauuuaucuccagagucuagcucauucaggcacaugcuaaguucucagcuaaugucuguugaacgaacuaaaagaauaggcacacuuuuauagcuuauuaagcucaaacauagacuccaaagcaaaaucucaucauugccucuugcacauuuuggaaacaacagcaauaauaguuaccauuucuugagaaccuacugugugcaaggcacagugccaaauacuuugggggagccagugauuuuaugugcaauguuuuuaaaagucccuggaguuaaaaaauuccuaggagguaaauauuauccaccccuuccacagaugacggaagugaggcucacuaaggauaaguaaccugccaaguugcacagcuagaaaguagagagcugaaacaggaacucaaagccugggcuccgaacaagcacgcccugcagacuucccuucccugugaugccccaugcucaguuuucuauuuucuuuauaguggaaaagucaaugcccuuccuaugagaaauaaaaggguuuaaaguggucaaaaggaaacaguguuuccucugugcucacgggguuuuggccaaucacagagggugaaccaaaaacaauauuaugcgagauguggccaguuuggguugauuccagcuuuggaugcugugagcuggaucccaggagcacacgaggaaaaacgauaauagcauacuugagauccaagcccauguuggggugaggauagagguuuugcuuuccucaaacuauugcauuuuucuuuuccucccuaaggguccgggcaggaugcuuccuaccccagggggccacuuccaaaugcugcucugucacuugguggaaaacuucaaauuuacugaggguuuacuguggaagacuuagucaagagggcaaguacccuauaucuccagauugcuuugcacauguuggcauucaauuaauauuuuauuugucaauggauuuaauagcugauuacaguuugcaaugcucuacucauggauaaaucaguugaucuucucaggcuucuuaugccuuuucccaguggauuuuucauugucguggauaaccccaggaaaaagaggaggcacagaggaaccucucuuacaugaauagguggggggaugcaagggaggacuucuagcuuuucuucuccugacuuuucuacauuccccagguugagugacucgucuccaucuuuuaauuuagcaucuuggaacugaacagcaccucccaagcaacccucaccugggaaccaggcagaaacaagugaaaauguggaggagguguuuaugaauuuuugggcagucagugauuucagggauccaggaaguuauucuacuuucuaaaccacuuccccaccugcuggauaugaauguaacucccucagcuuucagcuuucacaucuacuuuauauacaauucuauacugccucucccauuuuauauuauuuauaccuaugugcugggacuugagcaaagguuuuuuuauuuuuuauuuuuuuuuauuuuuuaaacuuuguacaagggaagccauaaagaauuugggcaacuuguagggaagagggagagugaauuuggugaaaccgaaagucaguaaaggucacaugggagaugcugagcucugcagacagaucuuucaacgugaagcagcagugaagaacauggcucuggagucaaacuggcugagcuaaagaguugacuuuguuaccuacuaguuaccuauugguaguuaccuacuaguuaucuacuaguuaccuaccucuguuaccuacuagugugaccuugggcagguuaaguaacuuuuugaacuuaguuuacugauacauaaauuagugauaauaauaauuccugucucauaaaguuaccgugaagauuaagugaggcaauguauguggaguguuaaaacagugcaugacgcagaguaaacacguuaaaaugagcuguuauuaauauuugguugcuaaaggucuguccuaccugaugugucuaucucuuucaaauacauccucugggauuuagcacuagaaacagucuugcagaaaguuagagcagggaggaacccucaagaucaucuaauccaaaguccucuuuuguaaaugaggaaucacuggcccaaggucacggaguaagucacugaguaaucccucuggucuguugcccagaaugcauuccuucccacaaaucuggccaugcuuguccuggagggcagauagacuagccuuccccagguaaccuuguaucuucccguaaaaccgucuguccucacaaaguggcacaauuucuaaggcucccucgggcaacaaaguagguuguguucagagaccagugagguggagaaacugcccagccacugaacuccaggcuggacuuggugaguggcacucaguggagucagaguccuggagaccugcacaucagggagaggguccugaagaggucuugaaauaauuugacauggaaagagaaaauacaaauuuucagagacacagauaagcaucauauuuuuaagccaagaacucaguuauauuuuugacaguguggugucuacaguacuaaggcauguucuuacaagagugacacucacuagcucuuuuuuuuuuuuaacuuucauuuuaguuucagugguaucugugcagguuugucauauaguaauggggauuugguguacagguaauuuugucaccuggguaauaagcacaguacccaauagguuuuuuuuuucugauucucucccuccucccacugaccauccucaaguaggccccagagucuguuguuccacuccuagcauccguguguuuuccuuguuuagcuccuacuuguaagugagaacaugcgauauuugguuuucuguuccuguguuaauuugcuuaggauaaugagaucauguucucugacauggaaagagaaacacacaaauuuucagagacacagaugaccaucauauuuuuaagucaagaacucaguuauauuuuugacaguauggagccuccagcuccauccauguugcugcaaaggacaugaucucauucuuuuuuauggcugcauaguauuccaugguguguauguacuauguuuucuuuauucagucuaccauuaaugggcauuuaguuugauuccaugucuuugcuauuguggauagugcugcaaugaacaugugucuuuaugguagaacaauuuauagcccuuuggguauauacccaauaauaagauugcugggucaaacgguaauucuccuuuuaguucuuugaggaaucaccacacugccuuccacaaucgcugaacuaauuugcacucccaccagcagauuauguguuuuuuuuucaaccuugccaacaucuguuuuguuuuguuuuuuaauaauagcuauucugaugaguaugagaugguaucuuauuaugguuuugauuugcagugcucuaaugauuagugaugucaaguauuuuuuucguaugccuguuggccgcauguacgucuuuuuuugaaaaugucuguucauguucuuugcccacuuuuuaaugggguuguuugguuuuuccuuguaaauuuguucaaguuccuuauagauucuggacauuaagucuuugucuguuguuccccuccuaguuugcaaauauuuucucccauucuguagguuauuuacuguuaauaguaucuuuugcugugcaaaaucuuuuuaauuaguucucauugguaaauuucuguuuuuguugcaauugcuuuuggugucuucaucacgaaaucuuugccaaguccuauguccagaaugguauuuccuagguuaucuuccaaaguuucuaugguuuuagguuuuacauuuaagucuuuaauccaucuugaguugauuuucguaugugguauauaagauagggguccaguuucaaucuucugcauauggcuagccagcuaucucaauaucauuuauugaauggagaguccuuuuccuagugcuugguuuuguugauuuuguugaagaucagaugguuguaaguaugcagcauuauuucugggcucucuauucaauuacauuggucuauaugucuguuucuguaucagcaccaugcuguuuugguuacuacagcccugcaguauacuuugaaguuaagucgaguaacaugauaccuccugguuuguucagcucauuucuuucuuguugaagacuucaguucaauggccuuagucaucuuuggaauggcauuuaggauucaguucaaugaccuuagucaucuuuagaauggcauuuaggaaaauggacuccuuuaccaaaaaggugaaaaagaaaauaauauaacccaaccuuaaagacuauuuuuuuaaggggagagggagaggacuuuauucauaauccuaucagcugaacacauuccagucuucuucuauaaaaacacaauuuuuuauaaaguugaaauuauggagcuaagacauuucuaagaagacuuaauuucaguuagggacuugcugauuaucuuuggguaagucagucuggcuucuuuucugggaggaguguuguguccauagagacgugaacaucgacgucugcuuguuuuugugaggaagcaugguagaaugaagagaacgcugucuggagccaaaagauccagauugaaaccagacuuuaagccugggcucugcuuccccuuuugcuggaugaccuugagacagugucuuaaccuuccuggaucuguuuuuuagcuuuuauaaaauagaucacuggcauaucagcuuguuaacgugcacuguacucagccuugacacacgggagaaagguuuucagggacagggugaagauuucaucuauaugaccuuugacugcaguuugguugguuggguuacacaaucuacaauuguagauugauugagagucuuuugaaauauguuuuucuuuaugcuaguuacccagguccucuccucucuggugacagugguaauuuaccagggcauuguguccucuuuucauuaauuaggccacucaggccuacccgaaucccaagagaccauuuauggaugaugaaggugguaagauaggguuguaguauguuggaccugcugucacaaacuaccauaugcagggugacuuauaauuaagagaaauuuauuuuucacaauucuggaggcugggaaauccuagaucaaagugccagcagauuuggugucugguuaggccugcuugcugguucagagauaacuguuuucuugcuguguugucacauggcagaagggggaagagaacucucugggguccuuaguauaaggguacuagucuuauccacaagagcucuguccucaugaucuaaucaccccacaaaggcuucaacuccaaaugccaugacuuugggggucagauuuaaacauaggaauuuuaaggggacacaaacauucaguuuauagcagagaguguauguucacagcacaggaagguucacagcagaagggagccauuaauuguguauagacuuucaugucucugcucugauucauuguauaaucugcuucauucaaaggaagaagguaaauuuugggucccucuuggaacauuuaggugacucccaccaaauacaggauagcuuugaguuauaaccucaugaagucccuggucaugucuguguguuugcuuuggaccagacccaagggccuguccuguguccugcccgggcuccucccaccucuuuccuggagaaacccacagugagaguggaggguggggguccauguuuaucuuggugggccucacuggagcuggacacugcugcucuguuugcccaggcuuaaguaugcaucuccuuuuuuaacuggccagggacuuucccccagucacuuggccugccauugauuugggacuuuucugccuaaaacuucuaggaugauaaggagagcacuauuacccacugccugcccaaaccuaguagcaacagcagcuagucaugaccagcauucauggcugcaaguacugucaggccaggggccugaccagugaacuggaacuuuacuucucucccaagugggauuagaguucacugaguagguggcccuauuaaaauauguauagccugugcuaaaguuaauucuaggggugagaaugaggcagcucugcuugcuggcuagcccaggcuggcaaagaauaaugggugcaagcaagaauaccagagccagauuggguucaaauuccaauucuauugcuuccuagguauacugacuuaggcaaguacuucuauuucucugugucucaguuucuucacuugugaaauuuucauauuuuaaggauuuugaagauaucauuuugaggcuuaaaacaauguauuuacuuauguuuaacacauguaauuacugauguuuaacuuuuuuggacuuauaaaaaugacaauguuuagcagagugcuuuaaaaacaugacccaacuaugugcuuucuauaagaagccccuuugaauauaaugauauagccauguucaaagaaaaaggaugaagaaagcuauauuauauaaacauuaauugaaugaaagcaggaguagcuauauuaauacaugugaaaauccucuacaagauauuagcaaauugaauacaaccauguacaaaaagaauuacacaucauaucaaauuagauuuauucuaaguaugcaagacugguucaauauuuuaaaaucaugugauuauauuaauugaugcagaaaauuauuugacaaaauucaauauucauucaugacuuaaaaaaaacucucggcaaguuaggaauagaauaauuaccucaauuaaaaaguuuacagcuaacaucauacuuugugaagaaggacuuaauguuuucucccuaagacagggaucaaggcaagaauaucugcuccugccacuccuauucaacauagcacuggaaauucuagccauuauagaaaagaaauuaaaggcauacagauuggaaaggaggaaauaaaacuauauuugaagaugacaugauugccuacagaaaaaaauaccaacacauuuacaaaaaacucuccuagaacuaauaaauucuccuagaacuaauaagagaccacaggauacaggcucaacaagcucaccggauacaaaaaucaauuguacgucuacauaccuauaaugaacaugcugacaccagaauaagaaauauagugcuaauuuuaaucacucaaaaauaauaaguguaaguacauuuaaauauauuauauuuguaauguauauuauguaaguuuaaauauaauaaaacauacauaggacuuguauguugaaggcuacaaagacugaugaaagaaauaaaaagaucuaaauaaacagagagacauacuauguucauggaaguacuugacauaguaaagacacaauauacuaaagauggcaauucuccccaaaucaauauauacauuuaauauaauuccuacccaaaucucagcaacguuguuuuuuuuaaaauagauagaaagaggauuauucuaaaauuuugacuaaaggcugaggaaccauaauagcuagaacaauuuuuaaaacaaacuaagugggaggaaucagucuacccuauuugaagacuuauuauauagcuguaguaaucaaggcugugugguauugacagaaguacagacauagaucaaaggaaugcaauaaagaauucagaaauagacccacacaaauacaccucuguguugccuuauuuuucagaaaagcucuagacucagagucaggaagcccagguuuagguccuuggccuugcacaagugaguucuuccaguuauaaaacuuugauuuucugggucuaaaucacuuaaacuuuucuaucucaguuuucuuuucuguuuaagggaacauccuuccuucuuccuuccaagccucuauuugacaaggaugauaaaauaucuuucuuuuuuaagcauaaggaauucuacaaaccaaaagaauuauuacauugguugaugugaauaacacaucucaacaccaugaggcccugacuccgcaaaccugaagucaaaugccaagaacuuucaugaaauuuauuaauuuauuuuuucuucccaacuaacaccacuaauucuuuauuuggacuccuuaaggagcaugaagaaugggacucauucuugcagaacuguuuuuagaguuugcuacugcucaaagcucagaguuuggccaugugaacuucugagaagucugugaauaagagauuuuacagcaauuuaacagugguucaaagauagaugcucugucucccaguagaauacuugugcuugugugggcagaaaauucuuaaaaugauucaaaccaaccacccaaagaggauuauauguaaauucauauuguguggguccugggagcuuugaaaaccacauacacagagcacagaaacacacaaacacacccaccaacacacacacacacacacacacacacacacacacacacacacauacaugaauagcacccuuagcaccauugcuaccuuaugugauuccuaccaugaaaaucugcacuuuaaaaagcaggaaaauuugaaaucuacagauguggauaacacucaaacuugaauugggacacaagaacuuuucccucucgggcuagugagauaguacggccuaguggcuacaagggugaauucuggagauaaauuuucuggguuuaaaucacaauuuuaccuuucauuaacugugauuuggggcauguuuuuuaacuauugggugccuugguuugcucuucaguaugauuggaauaauuauauacaaaauauacaauaucuaucucacaguauugcugugaggauuugaagaaaucauuuauacuaagcuuuuaugcaugaaauauauuuagaacagagugaagcagaaguaucuguguucuuucauagaauguaugaaugaaaugggacaguggguggucacugccuuaaaauacuauaccauauauuuugucauggugcuauugcaacaauacuccuaacauuauguauuucuuuauuugagucacugaaauacaaauauguucugagaagagucagcagagugauuuacaaacuagcuuuuuagacugggaggcacacuggagauccagguugggggccugggucuaaucucagggcucuacuuuuuuaacaagguauauaauuguggacaagucaacugguguuccugaaccucauucuuaccugcacacugaggaggcugaacugggugaucucggagguccuuucuggcuguaauauccuaagagacuggaugcucccuaggcaaggaaacuguuuuaucgacguacauacuguggaagcuuacuaaugcaagucuuuauuaaguaguuuuucuguagcagccgcuuuucuaagcccuuugaccuauuuaacccuugcagcaauccuaugaagaaggauuuaucauuauccccauuuuacagauaaggaaacugaagcagacagaggcuaagugauuugcccaaagaccauauggcuauuaaguggcagggcugagauucauaauccaguaaguugagguacgcacaccaggcauucuauucagcaucagacagugcuaggcaaagaauaaccgaagaagagggacuguguucuauucacuuuguuuuccccacagaucuguaagagugccuggagcuuuuuauagguucugaauagauauuuaucauucuugcaguggcuugaucuuggcucacugcaaccuccgccucuuggguucaagcgauucuccuacuuuauccucuggaguagcugggauuacaggugcccggcaccaugcccagcuaauuuuuguauuuuuuuuuuaaauuuuauuuuaaguucugggauacaugugcagaacgugcagguuuguugcauaggcaugcaugugccauagugguuugcugcacuuaucaacccaccaucuagguuuuaagcccugcaugcauuagguauuuguccuaaugcucuccuuccccuugccccccaccccgugacaggcccuggugugugauaucccacucccuguguccauguguccucauuguucaacucccacuuaugagugagaauaugcgguguuugguuuuguguuccuguguuaguuugcugagaaugauggcuuccagcuucauccaugccccugcaaaggauaugaacucauuguuuuuuauggcugcguaguauuccaugguauauaugugccacauuuucuuuauccagucuaucauugauggacauuuggguugauuccaaguuuuugcuauuguaaauagugcugcaguaaacauacgugugcaugugccuuuauaguagaaugauuuauaauccuuucgauauauacccaguaaugggaauuuuuuguauuuuuaguagaaaugggguuuugccauauuggccaggcuggucuugaacuccuaaccucagguuaucugcccgccuuggccucccaaaguacugggauuacaggcaugagccaccacgccuggccuaucauucuuguuuuuguugacgacaaaaaguuguuggauuaaauugcuuucagccuucuggguugcuaaguguugcagaguuggcuguguuaaauuucauuuucuuuuguuaauguuacccacacaaggugaagguuuugguuggggcucaggagggcuccugacuggggagaaagugggaagauccagagcaaggagaagacaaugaggcugccaggcuuugggcugcucuggccucucugcugccugccacugucuucauguccagccucgcuguguuucuauaaagguggaguuguaccucucugauuuccccuaaagguggccuggaugugguagaagaaagaggaggcaaggcauuaccugcaccuggaauacugaugagugguuugcucuuucuuguaugcccaguggccuggucuuaagccuaggaauaaauguagucaccauggccauaaaacggccccacugcugggcuugcuuucccuggccucugugaguuccaugcucauuauauggacuccccauagcaacguugagagcuugcuuaucauuuccagaagugaccauggcagauuaggaauauauguuuauuuugaaguggguuuuuuucuuuuuaaauuuuacacauuguuggaugaacauaacaucaagggcugcuuucccaacugucuuaggaaaagagcucuaauguuggagccaguagcccugcguguucucaucccaguuuugauuauaacugacuauaauacuguaaugacacucugaccuguguucuuuuaugacugagauuuccgguggggauggaggaggugucugauguacagaaccagggggaugcugccugagccagguuggggacggagagaagaggcugaauuucaagacacugacaucaucaguacuggcccuagugcaguuacauaccugguccugcaacaaauaaugaguauuuagggcacauaugccaagcauuaauggggucacgagguggaucguucuuuugggugcccuuuuauaugccgcugcaaucagagaagcaggacaccauguaggugagcaucugcuguuuucacagcuauuugaagcugcaacccaguguacuaaaaguuuccaggcugacucaguccaaaggugacuguuuuggaaacuuugaaugagauugguucggcaacuucaguguuauguaaguaaaaggaugagagcaguugaaagagccacugcucuggacauguucuaaguggcuucuaccaaugggaauacgugagcgugcauuaagaauguagcaagugagacugacaugucuccaguacaagcacagcacguacaaggacacaacuucauguuugguucaaugugagacuucucuguggcuccuuucucuucauuugcacagauaucuguaccacccaguauaagugguauacuaaucguagcuagccugugcugcaugccugcuauuuucuggguaauucccauguguuuuacacagguuaacucuacuuccucucauggaaacuacuuguugucgaaauaaugguuauauuuuaccaauauggcaacugaggcacagagauguuaaguguuucagcccagguaaauaagugguucaaucaggauuugaacucaagcagcaccuaccuuggagccuaagcucuuaaccacagcacuucacugaaccuauaaaauacauguuuauugguuuuaagcucugcuaguugaagaacauuuauacaugucucuauuaaaaauucacuuguguguggguuaugaauucacccauaaagaagacugccaugacgcacggaggagggaugucuguggagcuucaggagacgugauaauccacaaacuguccuggguugaacuuagcuauuauucugccaggaaacugucuggagaagguccaggaaaguaccaagaaguaaagaaguaccugagagugcucagcucccagugugucccuuggcaccugccagucacagcuugguugguucuggcuguggggccggccuuccugagacccuugucagggggcucauacccuggugcucuguuuucacugaugaugaagccucagagcccuugguccccucaugauguucugcgggaaaauugugcacacuuuuguugugugacuuagguucuuuaacucaggcugguugacauggagcuugguuccagugaucagugcuggcuuuagauaugauuugcgcaucucugcaggcuagugucacgcugcacuguggaucuggacuguggcucgggugccaguugcaacauagucuucaaggauagccaauggcgagacaacagcacucugucaugcagcugaaguuauggaaacacaugaugucacaugaaugucuauugugugaggugaugguuaauaccuguguuuccaagaaagugccagguacuggcuaguccucaccacaacccuauaugugguaagggcaguuauuaagcuuauuuuauaacugaagaagcauuagcaccaacagagaagauaacuugcccaaggucauacaugaaaaccaauggagaaauuaagguuucaaccuaggcaguuaaggccuaaagucugugcucgugaccaccaagcuaucucaccgguccccugucaggcuuuuuaggggauaaaguacagaguaaaguagaacuuuccucaaagacugucuuauuggucucacuuauuuuuuuuuuuuguuagucuuuggguuuacuuuaaauugaugggcugcuggaaaaaauguaaauugucauuuaaaaagaaggcaucaagguuuugucuuagguuaauuuuucaaagggcuuaccaagaacacagaagacagaaugccagcugggugccguggcucacgccuguaaucccagcacuuugggaggccaaggcaggcagaucacuugaggccaggaguuugagaccagccuggccaacauggugaaaccccaucucuacuuaaaaaaaaaaaaaaaaaaaaaaaaauagccaggugugguggugcaugccuguaacccuagcugcuugggaggcugaguugggaggaucccuugaaccugggaggcagagauugcaguaagcugagaucaugacacugcacuauagccugggugacaaggcaagacaaugucaaaaaaaaaaaaaaagacagaaugcugagcaauuaagaacuacuuuauuuaguccugucuuaucauuuguggccuuuguguauugagcacguccugagagcugggcacuuucuaaauacuuuacauguguuuccucacuuuaugcuuguaacugcuuucuggaagcaggacugugauuauucccauuuuauggaagaaggaaaugagguucacgaauauuacauaaucugcucauagucacaaagcuagcaggugguggggcuggcguagaaacccaggcagucuggcuccagaguccauguucuuaauuaaccacuccucuaggguggaaagcucacugguuuugggguuaggacacucaugccagcucugccaaaaugucaacaugugugacacuggccaagucauaucuccucuuggguucucauucauuuauuuacugauucauucagcagcucuuuccagcauaccuaccaugugcuaggcauuguuaguacuagauacauaacgggugauaagauagauuuccucgaugcuucuguagaguuuacagauggauuuucaguuuccucaucuguaaaagaugagaauuaaaauauaugaauguuucucauccuuuacaaaacccacacaucuuuuuauaaacauaaaaaguuaugccuucccuaauguuauuugaaauuucugaguaaauaaccaugacuaaaaauaaauuaaagcaauuauaauagugaguaauuuuuguuugaaucacacaagcccucaugccuguuccugaggagauucuccugcgcuggcccucugagcccugggcauucuuucgguuaagaaucaugggaauaguauucuugcucuaaaaacggaccuacaguuauauuuuuuaauugcuuugaaaugcuggaguugugucuauuuaauuuguauucauucuuucaccaaguuuuggcucuuggguuuguauggcagauaaaacuuuacucauuccuuuuacugaaaaccucuuucccccccaggguauagucgugagucacgagcucucucaccaacugacauuuccccauccuguuuuuggagggaacaacaaaggacaugccuggugccugacacagcgggcccacaggcugcuccuuuaguggccuugugaguucgaugagcuuuuggcucuaggaagugccugggcugcuauuacucugugaaucucaugagauucacagaccucuuaggagcaccagccagguuguaaagaucucuugaggacugggcucuggaaggacuggccacuccaacacccugccuugcccuuaauugugcauugccugguguucuuuaauugccucacaaaugcccuugaaaacucucagggauggccucacugugcaugacaaaggaaugcaaccuacugucugguuguacugaaggagcagagagcaggauucucauaaugauuguucaaagaauuuauuuauguggaguccuaaaaggagugauaggugugaaaaaaugcaauuuaauucaacaaacauugaugcaaacgcugugcuuggugacagcaauauagagaugaauaagaccagugucuagugacgugcuggcaaguacaacuggcucuguggggaggcgguacccugauuuguaccuuuugcugauuuccauugaguaaauacucuugccauguuugauuucaagcuaccaacauggugucaauuggcucacagaagcccugaaaauuuaauaaucagcucuuaugagccuguacaaacugaacuugcauucugcuaccaauaucuacuuuugaaguugucaguuuagauuggaagauacauaaauugccaugcagucugauaaagacagaaauagaaguauguagaagguagaaagguaucacaagggacacugguucaauucugcggugggcauauccacaugguaggcugcaaacaaagacaggcaaggccuguagguggguggagacagagaccuucagagcauccucagugccuucaggucauggggaaaugccuuggccugccuuaaggucccgugcagucuagccucaccuuaccuggcugaacauucucccacauuuacugacacaaaccuucugcucuagugaguccagcccaguguuuucagucuugagagcacaucccugccuuggcugacacccaccuccucccaccaccguuuagaaagugccuucccuccaccuccacuucccugcucuacucauccuucuuuaugaaugcuuccuacaacagcuccaagccacagaaagcacugacagaaagggaaagauugaucacgugaauuccauuaaagugaagaauuuauguuuaucaaaagucacuguuaagaaaggaaaaggcaaacaauggagucagaggaacuguuuggaacacuuaugaccaaucgaggauuuguauucaggacauguaaggaccucucacaaaucaauaagaaaaagacaagaaaagggaaaagagaccagaacaggaacuucacaagaauggauauccaaaugacaugaaaagaagcuugccuucacuccaccuuuaccucagucacuagggaaaugugaugccacuacauacccacuaaaguggcugaaaccaaauagacuuguauuaccaagcauuguugaagacuugaaagagugggaaauaauguauacugcugguaagaaucagacaugguauaaccuauuugaaaaacaguuuggcaauauuuauuaaaauggaacauuugcauacucuaugacccagcauauaaucugaccauacucuaugacccagcauaugauaugaccuagcuauaauccaaugaaaauguauauccauauguuuaccuaaaaguauguacuggaauguugauacagcaucauuaguuauggcuccaaauuggaaauacccagacauucaucaauaguaaaaaauaaauuauaggcuauuugugaaguggaaucuuuuuaaacuaugaaaaagcaugacauacugcuccauagaacuacauggaugaaccucacaaaccuaauuuugagcgaaaggggccaaacaaaaaagaaaacaaauggaguuauuauauuuauauaaaguucaaaaacagacaaaacuauaugagguuagacaucaguuuaccugauaccuuuggggaagagcaagagguuagugacugggagggcuguguugggggcuucugaguugcugagguuguuauauuucuggcccugaguggugauaacacagguauguucacuuugucauugagcuuuacgugugcaauuuguguacuuuucuguauaucuuacauuuuuauuagcuaaaaagcaaaggagcuucugcaugaaaguauuagaacuagugcuggaaagugagggaguguuucugaaccgccuuuguguuuuucuuuugacguuuucuaucuuuaugaguuuauucaucaaacaaagacauuuugagagugacaaugugccgggaacuauuuuagguacugagagugaaacaaaauagaaacaacugcugcuuucauggagcuuacauucucaaggggacagcaagguccuugaacagacaaauguauaacaagucaggggauaagaaauacucugaagugguauuaggggauaagaggauaaagaauaauggagcugggcugaggguuugggcacugacuagguguuguuuuauaugggguggucgaagaggaccucugaccaggcagccuuggagccagagccuggaugaagugaguaagggaggcugacagguaugugaagaacauuccaggcagagagggcaguaagcgcaaaggcccugcauugggauccuuggccuccgaagcaggaaacucagcaucauucuuggcuucucucucucuucuucaccuucauauuugaaucaaaucaugauccauuugauuucauagcuaaaucucucauaguuugcaaccucugccucccaggcucaagcgcuucuucugccucagccucucgaguagcugggauuacaggaacaugccagcacacccagcuaauuuuuguauuuuuaguagagaugggguuucaccauguuggccaggguggucucaaacuccugguuugucuccauccccuccauuguugccuauuuggguaauaguuucuuaacucugccuucccguuuccauuuuuuucucuucugauuuuaagucacugacuggauaugccacuccucugccuaaaagcccuccaguggcucugcuuugcucucagaguaaaugcccuacaagguuuugguuuuccucacuggucucauaucuuucugcuuugccguacacuccgugcuugagccacaccaaggcgauuccauguuucccacauucccucugaggaaaggcccuuuagucucugggucuuucuuuaugagggugcaucuaccuguggaguucuuucccccaccuccucauuuuauguuuugcacaucccuuagaucucagcuuagauguuguuuagucugggaagcuguuccugucccuuaaaccuuggccaagucccuguguucuccuaucguugccccgucauaucauuuugucauugauuuuucuuuuuuccagccucccaugaaacucuaagacacaugugggaaguaacuauguuacuuauucauagugcuuagcaaaguuucugauguuuagaaauuucucaauaaauauuaaaaaaagaaugcauguugagcuacauuucugugauaugucaaaaaucuagaaguauuuuuauuaguaacugauagaaauaucuuucagucaaaacauuauucaucaacucacaaaaaagcagacuagcuuuguguuugaguuuuguuuuuguuuuuccugguaauuuuguguuccauaauuucucagacacagaaacauuaucuuucaaauuuuaauaccacuuuauuugacucaaucacauguaaaauuuuuguucagagaauuuugaauguauccgugaaaaauauucaaaugucgaaauccaaaugucuugcuuuggcuguggagcaauaucauuacugugacuuaguucuagaauuuagacuuaauugcuaaaaaaaaaauuuugaauucaacuuuauuaauuuugucaaguuuuugaugugcuagguggacauucuuuccaauuuauuacagucccuucauauagacacaaaagcuuuuaacacgaugggaaagcuggugagacaagucagaaaauaaagcagcucuuuuuucuuuuuuuguugagacagagacuaguucuguugcccaggcuagagugcaguggugcgaucuuggcucacuguagccuccaccucccagguucaagcaauucuugugucucaggcaccgaaguagcugggauuacaggcaguagccaccacgccggcuaauuuuuguauuuuuaguagagaugggguuucaccauguuggccaggcuggucucaaacuucugagcucaaguuauccaccugccucggccucccaaagugcugggauuacaggcaugagccaccguccccagccagaaagccgugauuuuuaagcugaugcuuuguaccaucagugugaggagugaugcuauugaucccugcugggcaugagcauuagaagaaaguugagcagggacuuaaaauggggauguggagcacugugccaaugucuuucaaaugggcuuuuaaaaauuauuuuaacaggauuauuuggagaaucauaaauguuugagccucagauacacucauagcuaccauuuacugaguacuugcuauaugccaggcacuauaaaaacugcuuuaaauagacaaucuuguuuaauuguaauaacagucauaugggauuguuaccaucauucccauuuaacagaugagaaaauuaaggcucagagagguugagugguuugcccuaggucauauagcaggucaaagcuaaugcugaacuaugaacacaguuccucugacugaaaaugugcaaggcuacuaacgacuagguccuacuggcuuauguauugaaaaguagaucaaugaacucauucuggagcuaaauguugucuauuacuguggauuauccaugacauaacccacucauuauauuccaguauugguuaaaagguaggagagaagugauaguaaauuucauggguucggcauaucuucugaccgacagaagacauggaaauguuuuaaauguuucuuuuccuuuuuuuuuuuuuuuaaaaaaaaaacaaaaacaaauaacacuaaaaguuucaccaaacaaggguucauaaaaggaucgucucuaaauugugaguguggugagugugcaugcucugagcaaaaagagccuccccuuucugagggaauugugacccuggaaaggaggagagcaggaacagcuggccaucucccccugaaaggccagggccccccucucaggccucugggcuccagcucuggcugaggguguguuuguuuggcugugacucuuucccuucuguuucccucucggugucauauuucaugagcuccaggcuccugccuguuucagcuugagccucuggcuuucaucgcugccuccuuggccaaagcugagugagggcuugaaaaaaacacugauuggaugcacauuuaguggaggcgauugcuggaccagcaccucaccaauccccagccccaaaugcaacugacagcuacacccuccuggcuggagccuaaaccagaggccccuuuccucccuccucuccacccauacccuugcuguuugcccaacucuuccugcugaaaucagaggcagcuugugccucccagccuucuucccugcccccgcugucugcccagccaccagcuuccccugggcuggaaagacccccgcuugucugacugugcuaauccucuguuugagguuccagaacuucccaauuguugggccuggguuccuguacuuagcugcccagaguccacuucucugcugagauuucuauuauacaagagauucaaccagaacccucuccgugggccuccaugccucuuuuugcugaauuccccauucucauucugcguagggggugggaguugguggggguacaugcaccuugagucuaaucaugaucuuacuggggagagcucaguaggaaaguaauaacauauucauuuaaacaacuuuuucucuguuaaucuuuuuauugaacuucauagaauuaauggauaaagacuauugguuagagugcgucuuucuuagacgagauggaguuagagacacuuaaaaaaaaauaaggcuugccacugcaggagugcacagagcaccucaacuauuggagcccaggugaucucuucagugggucauaaaaucugagucauaagaaccucauggcaaagaaaacuugaaacugcaaagucucacauagucauuugcugaaaacugaagugucccaacaaaugucggguuagaccuacuuugagaaacacauuccaauaugagaucgaaccugacaauuuugcaugcuaaccuggacuguuucuuauuagagcaaaggggaugggcuuuuuguuugcuuuggguguauuuguuuuugcugccaaaguguuguaaugucaugauuauuuaauauguaugaggccuaguuguguacuagggagagucaaaauacauuuacuacgaaaugagaccagcuccaguuguuuaaacagcuccaguuguaauaauaagagcuaagacuugaugccaagcacuguuucuagguauuaacuuauugaguccucaugauuacuccucacgaugguccucuuggaaaggauccuauuuuucuaugagaaaacugaggcuugaguguuaaggaacuugcuuaaacucacacaguuaguaaaggucagcuuuuagauuuaaagccaggcacccucauucuagagcuuguggcucaaccacugagcuauacugcuuguuaggguuguugguggagugauaguagaaguagaugggcuagaguuuuucauuucuaacccuaaaaaucuauagcuauuaacacugaagacagcaacugccaauuaaauaaauccucaacaagacugagaagagaaucugcuaaucuguuggucacuaaugucugcaguuuaucugcuuaucuaucugcagcaaaacugucuuagaacacuuugcugaaugaaauugaacauggaaagcugacugaagggaaaacagagaaggugggauaguugagaagggaguaagaucagacaaauggcaaugcucugugggauacugcguccaagcagaacagucaagggauucaguucucagaagcuguucagguagacgcccuccuuaccagagucgguuagccucuugcuguaugcacacuugaggcugcucaaagcgcgagggaggcauggucugugcucauuccaggcauccaaagcaccagggaggcaugaucuguguucauuccaggugucuuaucucgcugccacuuccaggccugcacauuauaggcaauauauuuacuacacucucccuucuccuuuauuuuuuacuucuggaugugccauggugaauauuuuucaggcaaauggggggaaucguuuccauuucaagcuggguugaaaucuagcacuaugauuaggguugugcuaaccucugccugccucuccccuaacuccugcuguguauaggugggcauggcucaagcauccucagggcugggagaagguugcaucaggaauguuucuaccaacagaagcuggccagugggaggcuuguaggcacuuuguaauuuaccauucucuucuugaacuaugcagcagucugaggggcuguacagaggauucuucccagucauucccauugcuagcuuuggaggccuucucccacaauucauagccuccuaguaaugugcuuuauuccuaaagcccaguccuugggguuuuugaagaaaaggaaggcagaucagcaugccuucccuagucugaaauuacccuguuugacucauauaguguggagcuuuauaaucuguaauccaaaauugggauugucuauacuauaaggauauucucugggacuuacgcuuauuuaaccaagguugucugcaaugggaagcucccaugacgggagauucaggagaaggcuggcauaggcuucuaacuuacaccagugcucccugaugccugugaauguggggagagggcaaggagauuuugagaacagauaagagacauuugaauuucucaaugccuucugaaaaccugugugcagaguugaauugaaacuuaccuuguuagcauuauaaaucugaacacuuuccuugcuaggccacaaugacuuaauaauaucgucuaaaggaucuauguucacucugcuugcacugauuuacaucuccuuuuuccaauucugcguagucucuggacacuucuacuuccaaauaucaccuguuuaaggaauagcacuuaccuugucuuguacugugaacccaaauuucugugaaaaauggacuguagcaguuguuccaguuugagauugcugagugucaugaacauugguuuugaagaguauggaguguuguuggaggacagcucgaggcuaaaugugguugugcaauaugguuucuacacacuguccagcaggugguuggauacaguuaugccauucucugcuucuuguuuguugucuucaaaacaugaaaaaauaaaagcaaaauauagaauaucuucgaugaauucagcuucucuuaaucucacuuuuaucuccuuucuguaagacuuagucuauuauuuccgaauaugccaucaauuuuauccaagugaaaauucaguuuuaguuuuaaaacacacagauauaaaaauaagaugcaaaguucuacaguaaaauucuuagacauaaacacugagauuuuuggauucacaaauaaauaguuuagauaacacucagaaagaucuuuuccuccuaauuagcuucuauugucaccucuuccuaaguugauauguagcucaauuuguuaggaaauggauuucccaugcaugcccuaacuauaaucauaagcaucugcaacucuguuuucaaacaaagcaucugcaacucuauuuucaaacaaagguaguuacucaugagagagcuucuuuaaacugcaauggaccacacagagguggaugucuagcacauuuacagugaccaugauccuaucucucaccauuucuucuuuucaauauugcaggauucuaaccauaugacuuucccaccccucaccugauguuuggcgacaauauccuggcuucuacuggcaacaccaucuuuugcuauuuggguaaaugugcuccuuaucagccuuggauccuacccaggcucagggccuugugagugcaaugucuauugggcuauuguggaccccaugacuaugacccagacacucaguuuuguaugccacaucccuuuucagggagcuaggucaaggacaucaugcaacucauuugcaugccauauugaagauucacacuugggggaauauuuuauucucaggcagcuaagaccuugaaacuccagcauaguauggagagugcugagccuucagcauuuuuagcacaugauuucagccuuggaaaucugauguacuugcagaccucuacacaagaggagguauuugcauagaaacaugagcaugcuggggcugggucauccuuuuacuacacauguuaaagcauacauuguaaccaaaauuuuggaagcaaugagaaucucuuacucuacuauugggauuuggggucacagcaagacuuuggaagagguauuacugagaagaugccucuaugagguguuacucaaagucauuaauuacuuacagggcucuacgagaauggcauaguucaugucuuaaaaccgcuuauagcuacugguugagacagaaaaggaaacuaugugcugugugauuaaaccgguguuuucuuuuuugcauucugucuucuacauguguuguggugaaaugaaacuuuaccacauucagcagugcucaggagaaacauugagcaguguugguauauauuucaauggcauucaaaacccugauaaauaauuuaggacuuggggagaucuggguaugggaagaagaacugaaaaaaaaaaaaagcagcgguaauuuacuaauauauguuuguagguuaaaacacuuuuuauagcugaccguaguagauagaaucauucuuuacaacuauuaagugguauuaaauagguugacccaacucccuuggaaaagugauuaauuuugucuuccagaccugacuucugaagcucaaaguugguuuaaacaguucagcuguaguagaggauagccugauauccuaguuuugccacaguaucugggccagauggcauuugcaguaaauggaagguaacaaugaucagcucugguauuuacguguguaggugauauggucaugugggaguguucauaggcuuacaagccauauggcucuuggccauaaacuauugcuagguaaggcuuugacucuguaucaguaugaauaaaguagcucuuucagcucaugaguauccauuugcuuugugucaggcugaugucaaguuaaccugcuuuugcacucuggugaacagacacauagauuauuaaaacugaaagugaucuaaaaaguuaucuaaaccaauauccuacaugaagaaggauccucccuacagccucacaaguaagaugauuagucagccucuacuugaauauuuccaguaguggggagcucauaaccucacaaagaagcacagccuguuuuuggauggcucuaauuuuuaggguguucccucuuauuuuugaugaaaaucugccucucuguaacuuccuuagucaugacuggaguucuguuguaugagcugaauccuuuuauuucagaauagggcaucacauauuugaagaccaacauuaagucccaguguaguuuucuuuuuucugcaugaaacauucgaaggucuuucaguaaauccccuuguuuucuugguagggagucacucaucaccacuuuucucuucccacuggagcuguauuaagcuccuugaaacuuugcauccuggagauacagcuuucuagucacaaagcccaauuuaccuucucugagaagagucuaguucuuuuuauuaguuuuaguuguacaguuugggauucuccuuuuucuccucuuugucuuauuuuucuucccagcuuccuccucacguggcguuguugugcauaaaguucugaaucauauuuuucaucuuuguucguugcaauuauugucacucugucuuccuucuuggauuauuucuuucauucuccuuagaaaauuuuugaauucucccaucagcuggagaaaagguaucuuuuaccuucuccuccaucuuauacugacuaugcaagcagcuuauacuuaggucccaugcaagcagugacuucagaaaaaacaagaauaccaacaauguaucaucuccuauuguuggcucuugguuuugaauagauauucccuacccaacuagauucaugugugcgacucugaguauaggucauucaucgaaugucuguuacugcuagagucuuugaguauguagucuguugaugugaaccuaaauguaauugguguuacaugcaguuuaaaugucacccuauuucaaccucaugauucucaaucuuuaugccaauagcuacaguauauuuauugucuaccauaggaucuaauuacauaagcuuugguacugcucguuguccagaaggaucauaauguuagagaggacaugucuuccucacauuaugaaggacuaagaaacagaggcucagggagaauauuuggcucauccaagauuacaccauuaguucagcagcuggucagaugcuguuuccgauaagccacucagcuagcuaacucccuuggcuucaauagagaaagugacuuaaacuguggcauuucuggucuuuuauacucucucucucucucuguguguguguauauacauuuuuucuucuuuaucaccuagcauauuuucugauauguaauaaguucucaauaaaugcugguuaaugaauauuucaagccauccuuuccuuuuggaaguugggaacauguguaaaggaagaagacuagauugagugauaaagcauaaaauauaacuaggaaagucauagcuugggauagagaguauaugcaguuuguucagaaguauauaaggcauugugcuaugugccacgaugccuauacagaacguauagccuaguuccugauaucagugaguuuauaaugagauaaacguauuauauuuggcauugugaaaaugagauaaaaauagagauaagacugaaucauauggaaaaaauuaguuuccaguucaagagaauguuaucaacaucaaugaggaguucagagaagggaagguaaugaagagccugcuauuaugcuauuguucucaucagaagaggggugagugugagggaggaagagaggauagauggaagaugagaagagggugugugccagagcacuguuguccauuuagugccagcccuguguggcaaauaggacacaaaccuccaauuggcuuaaguuccugagguagaagagauuaagaauguuaaaaagggaacaaaauuuauugagcaccuacuauaggugaauucaugaauauuucuugaucaccugucuguggaaggcacuguguuagguguuagagauaaagagagauacuaucuucaccuucaagggcaggccaagcagugugcuaggaaccucacaaaaggaggugcugaagucacauaagcuccccuuauguaguuauuccaguuccugguuuucacgucuaauggauuuuuccccauagcuucucccccuccacccaaccccagccuuuccagagugugucugucuucccaaaaugaguuugauacuuugugcgcaugccgggauccccaugggauugaugacaucauacgccauuggcuccuauugcacacaagagaggagacagaucugcacauuccugcaguuaaugcugaguagaaucuuggcagaggugguggcauccuucauuugacuuuagaccuucagccucccuuuuaaagcccuggcucacacaguuauugagaagccuuauccugcaaggaaccuacagcuuaggaaagaguugcccaugugucuuugcuaucaaacaaaagauauuggcaaaucuuuuaucgauuuucuauucuggcagagguaccauuuauuaugggguagaugggauauagauaaagcaucucccugccccuaaucccugccuugcugagauaaaugccuguuccauuccccaaucaccagaaaaugccuuggagcaauggagucuaacagccugagaguuguaaaggggcagcaaagccacuucugcaggaagagagugugcaugaaccuuauucauuguccauguguggaguugcuucauguucaugcucuucacccugauuugacacauaccaacaucaaauaacuaucuacucuaccccauuuggauacuauaauaaaaaaaagauaguccaguuaccuuauaaacaacagaaauuuauuucucauuguccuggaggcuaggacguccaagaucaaggugcuggcagauucagggucugguuagggcccacugccugguuuauggauggcauguucucacuguguccucacaugguagaagcagugaggcaucucugcggggucucuuuuaaaaggacccugaaagagggugccacccucaugaccuaaucacuucucaaaggcccuacuuccuaauacuaucacauugaggguuagaauuucaauauaggaauuuugggggaacacacacauccagucuauagcacuaucugauaaggcuucugaauaguccugggccauuuuacauaacggggguuuacuaaggacucucaacagcauagcucuugcuucaagggguuuuccaugcggggccugccagaauccccugaagauuugcccuuuugcuuuugggagaaucauugagagaaaaaggaccuggcuccugugcuuuucgcaugcucacccacuccggcccuucugauuaauguuugcuguucugcuuugcagaugccucccaggacccagagggagacuguagccucauuucuguggagaccuuuggcuggacucuccuggcucucccagaggugagagaccgugguuccuguagccucaggcuuggcaccagcucaucucugguggauccaggauuccagauauccaaucucacuacagccagggccucuuugucccagugugaccuugugggcugucccccugacugcgucuuaacagccccugccauuggugauuuucauuccagcuacgagccaauggaucccugaaagcgacugugugggcuucucucaccaugucgcucuggccucagccuggcggugugcuccucuguggucuggauggggaugaugaacucgggcugcccguuguuuuuguuuugugauauuuaaagcagccgaagcucucauuacuguaauacaguaugugccugggcuaaagggggagcagcauuccuucuggaucagggggcaacucuauucuguugugguacacccgcuggaguguuuagaaccacggcugguagauuuacagugccagggcugacaggggccuuggaacuccuccauuuucauucauuccagccucguuguuggaaugaagagggagcugagcccauucuggguaugggacgauugcuuaggcccuggggugaugaguggcagaucugggacuagaacucaggcccagaggccagcuuacugucaucuggcuaaguuucugcuucuguucucuucacuuguucaagauccuucugaggcccugaaccaaaugaggaaaauucauguaaaucuuagcacacugccugauacauaauaagugcuccauaaacguuuaucagugcucucauaagcccugagacaugcaaaauauucuugcccuucagggacuuacagucuugaggaggagauaaaaauuucacacauacacacuaacacaauuaaggagcaauuuaagucacuaaaugguuaucugcuaaguuuuggggaauaggugcaguggaucacgcaagagaggagacagauuauuguggccuagaagaagugccauggugaagauaagagcauaauguguaugacaucuguguaugacaucuuuucaacuccuggcagugagaugaacaggucagcagccauuccuggacacugcagagcccucaggccauccacucaucuacccagcacauucacugauuaucucccaacucugugcucugcauaagaauguaaggaagaccaugacaagacccuuuccucaagccuagccagggagacagacaugcauaaagauacuaccacugaaaaauucuacauucauauguguucauauccucaaagcaucgucugagcccacagguggguaggcaagucagauaggagcaagaguuugaaggaaagcauacauuuaccuggugaaaaggggcaacucacaagccauaagcucuugugcaaaggggcugguaaaugugagucuucugcaggagagguggaguugcugggagguuagacccaagcaagggcauucugagaaugagauugagaagccucugaggccagcauggggcaagcccuuggugucacacuuggcccuggcaaugugguauuuuuaaccugggccagaaaguggagaggagcgggccugguaggauagagaggagggcucuuuacuuaucaagaguagguaccagaugcuggugacucaaggggaagcuuccugaguggagauggagccuauagguguuuaaucgccuggaacaaacauauuuucugcacugcuugguucagaggcugcaaguuaaaguaacacagaagagaauguccggccagcaaugugaaggaagcaugaaauggaaaggguuagaagcugaacuucucuugaucaaugacuuuauuaucuuggcaaggauugcagaaacuguaggugcugagggacugacuuguuuggaggaagggguagggaccaggaaaagaaucccagacacuuggugcuaauccaacugcugaaugaggcuuucaggcucugggauucaggcaggaacuccugggccauauucuuccuagguauggggcuagagagccuucaaucuuagugucuguaugucccugggccaaucugcuuuguucuaccaugccuaacaucagaaaaaaagggguagauuaaguuuagagccacugcucugugucuccauccugcuucuuuuuccuaaggcaauugagccuuacaaggccuucuaagucccuaugaggucuacagcugucagggauuggugaggauggagaacaaaccagucuguucugaauucaacucuugcuuucuuucucccucucacaauugaaggucuuccugagccuuugccucuuucaacagcuggauguugagacugcaauuuuucaugauugcuuguuuuguauuuuuucuucauggucuuuccuaaagucuguuauucauccagguccacuuauacaucuucuaaucuauugcaccaacccugcagccauggccuggcaugaagcugcuugcucauugucuuguugguuuuuccaaaugcucacaggcgcuagucauguaaaucuccuccuggcaagaaaaaaagacugacuuuuuguuguuguuguguugccccaggugauucagccaguccugggcucacaauagaugcuaaacauacgauugccaccucgacugcugaucuuuuucuuccuauacaccauucuauucauaccgcuauucaaaaauugauauuuauaagcacuuacuauaucccaggaaugguacuguaaguucuuuauaugcauuauuccauuuaauuuuaauagugauaccauuuucuacuuuuaaccagcuuauacuuucuacacugauagaaaagugucccuaaacccacagacuaguuaguaccuggcuguuuuagaaguuccucacucaugacauuucugaaguuaucacuacaggauaugguugcaaaggccugggaggagaaauccuuucugucucugaugguuucagagaaggugagaggucucugucucuuugugguaaaaacaccaggguaggccuugaucuccugagucuugaguauguuaagggaaagacacuaagauugcucugccaaaagggcagacagacccugccuggugucugggaaguugagcccaaguuucucuccaaggagggucuccugcagggaucaggaaggagggucuauuggcaucacacaugaucucuucuggguucaggagggguuccuauagcuagaugagauagaauugauugaugucucagugaugcuucaggccauguugauugggccugcacuaaaaguaagcagcccuucagagccaugugcucucaagaggcagcacagccauaaccgcaagaguaggaugguccugguggaaauggcacaaucaaaacaagcuccugggccuuguggcuuugaguggcugaacuggaagguucuugagguaugagcacucucacucacgguauugaucaagcagcguaaucacaucacugcccccacagaaguggcugccacucaguucuccucagcccaggcugauuucugcucugcugguucauaggaaacugcuugggucuuucaugacugcugaagcccaaggcacuuuccccagaggcagcaucacucacaggauggaccaaaugaaauguccuggucaaaggcaggaaguuuguauuguuguucuugccuauuuuacuaucauguaaauaccugccaaccaaccuacacauauucucugaguacuuacugaguacuuacuauauagguguuaauggauacagaaauaagaguauggcuagggguggcaugcuuuuugccccuaacuugcaaauuuauugagaacaugaugccaggcacagugaaaaccaaagagaaauacaaauaaaugguaacauuuaugagacagguacuagguucuagacacuucuuacauguuaacucauuucauccuuacaacauuccugugggcaggugccauuauuacucccauuuuuacaggugagaagacagaggugccaagguucaagugugugcccaggugcaugacacuggugagaggugggagacaggacucaaacccagcaagccuggucucagacaaggugacucauaaggagcagcaagggagguaggaggcagaacauugagugcaggggcucagaggguggagggaaguaacuucaaucugguuuaaagaaaccaguuaucagagacagacagggccuaaagaagguauggguggcucagaguuuuaggaaggaaaaacaggaaguugggcuaauagggauagcgugauaagagaacaagugcuaggcuggaauaccaggggccuggccuugccugugagcagcugcugccccuggggaggucacuuugcuuuuugggcugccuuauuuuuaucaccuccaauuggagagaauugagaaagaugagcuuucaggucccuucagguuuuuaccguaugguucuaugauuuugagggcuggcauguuuccuugguugcuuccaaaagccucugaccacagucccucaggcugacccucuugugcccaguaauguggaaagaugaccuucugcucaccagcacaugcuuccaagggcugcggagccugggacagaagguacggugggaaagaaaaugagaggagcugguugggaaagauacucacaugcagaaaaguuuccagcaagucagaggugagaguaaaagauccaaaugaaaagcuagagauugcuagggcucaccaagguugaauaacuuguccagggucuuagcagacugagggauacuggaugauaacacuucuaaaauacuguuuuguaucuggaaaaugcucugccuucaguuugcauuuucucuccuucuuccucccaguaaucaaaugaagacguuagauuugacauuuccaguguguacaguacagacaggaaacuaggugaaugaaguaaugcagucaauguucugugacuccauucugccccuggaagagggauguuuucuauaauagucaugugacucaacaucuucuugucuucuuagaaaggagugagagaauaagauagccaucuagcacuuuccccccucaccucuccuacaaacucuagcaucucauuuuacagaaggaaaggcugagauggaggggagcaaaguagucuuauaacaaaggcagaaguggagcuugcuauuucauccagugugggucaccucaggucaccuggggcacauccuaugugcccagauacuuacggaaggggucauucugggccuuuggcuccacacugaggggcugcauuuugagaaucacgagguugggacucccagaggaaaguugagaguuaggaaaacuucaacaaauccucaggaauagaaacagaacaugagaugagaauguuugggacagcucugcuguuuguuucuguguauguguuugagggcccaucucuugccaaaaccaagcucauuucugcauauuuguuugcuuaauaugaaauacuccaaaacugcucuucauauuuguuuaaucugaaaugaaaaugacucagcagagaggaaaaacaagauuuaaaugcccugaauggccccugaauuaaaauacauagcccuaaaucauggggguguucuucuccccaccaaaucuuaaucuucaacacacacaaaugcaagugccacacacagucaugcacacacacacacacacacacacaaacauuguauuugccugccccaacuugaccucagucccuuuaucucuuuuccccuucauacuccagccuuuccaggguccuaccuuuccugcaggggaggugcauuugagcuuagguggagaggccuggccugggcuacaggccacagaugauuuuccuggagggccagcacuuccucuccaguccagaucacaggcucagugucaagaucccugggggaaaucugaauuuucauucuucagcaaagucgaggccaccucagauagucccuagcuuuuggaucuggaaaaauggacuccguggagagaauggcugucuaccaaaucagacaugucuugcuuuuuacacaagcuguauuccugaaaaguuggguauaaacuggaucuugguauguugcaucaauuuugaauguacugaaaagauuugcuauucaaaggaacccagcacuggauucuuuugucaagggaugaauuacuuuguaauggcuacucaucuagugauuuaugaguuugguaaguagauggaauauuuuuauauacugaauguuauuuuaaauguacugugugggauuuuuuauucaaaguuacccggcauugaauccuuuugcgaagaacuauucuguaguguagauaaacauuucaugauuuaugaguuugguaacuuuaggcauuucuuaaagugggauauaccccuaguucugcuucagagaaaaaguuguuuuuugcaaugaucagacuuggagaaaaaagaguucuaccauauuugaguuauggucacuccugaggggcuuaggaagaauggagguacucaaacuuuccauuuuguuggagcaaaagauccaggaguugccugcucuucuuacuuuccauauuaucacugggguggaaaugauggagguauuuuuccaaagaaauguaguucacuauuauagcuacauuucaaagguguuucucuucauaucuauaucauuugaauauauauuuauauauauauacacacacauacauauauacacacacaugcacauauguuuauacacacacaugcacacauguacguauauacauauauaaucuaucauguguauuuagaucuaaagcaaagacauugcaguagggcuuguguuuugaaccacugaagggcugcuguuuccaccaguccagagugcuggggcuugcucugagaucaccagggguauaaaccaggcaagaggagaacuuaacuuccugcucacucuuucucacuuggcaggucaaaaaucauuucagcacuuaucucccaagguuccuagcuguguccccauaccauccuaucugagcacuagugugaagcuuguuuugggaaaugaucugauugcuaaggcaguuggaaaagagaaauauggugucauguguguacaaccaagagcugaucuaggaugcccacauauuccuggcucauccaugagccacauauucauugaaguucuuauagguaggagcaaacccugccuauaagaacccuacauggacuggaacugugucaggcagaauguucagauaacuuacccuuucaccaugauuuggcccugaaugugucucagaaaaaggcuuuuagaagcucacccaaguacagagauaauuugugagacauuuaaccucucagacucuugcuuuuuucuuuccuggagagcugcuaauuucuaguuguggcugccacacuccugucugccugaucuuccauuuuacuuccugguuuccugguggcuuugacacauggccuguccagaucccagugggggcaguccugagauggagagcugguggucuuuugucagaucugggaaguccugagccaugacuuccuuugaaaucaauuuggaauguccauccagcuuggcuagggaagaggauuuugacugugaagagggaaguggguucuuuacuacaaaggacauauucucucugagccacaugcuccuugauguucuuugguaaauauugggcugugguccuagaaacacugaccuuggagucaggcgaacugggauccaguucuuacucuguggucuucuaacuuagugacccaagcaagucaaaauuaaucucauuucgagauagagauaugcaagauccuugaccuucaaugacucauggucaggcuugagagaaagucagguaaagaagccaacucuaauucagcacaaugaaugggaagcaccagccagaccagguaaaacagccucaauugagggugaagugacuuagggccguacuuuucuauugucaaaaggagaugauaauuucucuccacaggauuguggugaggcucaaugauguaaugcaucuauaaguaacugauaaaguucaggaauucuaaaauagaaacaggcaguaauucucaacuguuuucuucuuccacucuauucaugugcaagaugugcuaagacauuucccaauacaacaagugauucuugaaguauaggacguguuccccccacaccuccaacucucggaaaugcacagaaaguguccuugagauucugauagccugcuuccaggaaaaauguuuuguuugguuuugucagaaaagcuaauauaaaugacauuaacaaggaacacauuuuccuuguugaaaaucaaaacauuacaaauaaggcuaaagucucccuuugaucaccauucacaaucuccucugacaaauacagcaguccaucuccuaacucugucuuggagggaaccacugcugucagcaugguguuuaaucuuccagaucuuauauauauauaaauguacaugagugugugucuaucauaaaaauauauagugugcuuuacauaaacuuugcaaccuucuuguucaccuaaaaacaugucauagacuucaaccguuguaacugugaguagcucuaaugcauucauuguuacuauugcauagcauuucacaguaggaauauucuauaguuaauaacauuauccuacugguagacauuuuucuaaguuuuuguuguuaaaaaauauauugcaaagcacuuuuuugugcaugccucauuguguacacacacaagucuuucuuuaggguaaauaagaauaaaugggauauagaaauuaugguauauguauuuuuauugaaauuaucuucuaauuuauauauccagcagcagaguaugagaguaugcauuugccauauuauugccaaaguuuauauuaucacacuuuaaaauuuugccagucugauagguaaaauuggcauucaacuacugcuuuaauguuugucuuugugacuacuugagagguugaauacuuuuagauguuuacagcauuauauugucuccccuguugaaugcuuuuuauuuacuuggcccauuuuucuaguggcuuuuaaaaaaugauuuauagagauuauuaauacuagaaguuauuucauuauacaauuucaaauauuuaucuuagccaguuguuuacauguuauguuuaugaugucuuuuggucuuaaagaaguuuugaauuuugguggaaauuuuuauuauucuuuucauuucuggauuuugcuuuccaugucucauuugugcaggccuuccuuaucuuuagcucauagcaaauuuuucuagauuuuccuugaaauauucuuaugguuccaucuuuacauuuugggcucauuuuugugagguguagauauaccuucauuugcuuuugaaaaggcuacuaaagcaucugaaacuucuucaccaaguuuaaauacccaccuucucauguaguacauuuccauuuauucaugagucuuuucuggguuguucauucucuucaguguucugcuuaucuauuucuauaccaauugcauacucagagaggccuuugcuggccaccuuaccuagaacagcucucauucccuuucuguuacauuacucuauuuuauuuucuucccuguacauauguuucuuuaaaauucuucuucauuuacuuguuuucuuauguacuauaaguuccauguuggcaggaaccuucuuugccuuuuuuacugaugugcuuaucaccuguaauagcaccuaauagauauuuacaaaauaguugcugaaugaaugaaugaaggccaauggcuugaccagggguguuugcauuuugaguuuuauuucuugaggcuuaaauaaauugucaaagggguuuguacuacuaacuaaauaaguggguagagaagggcuuuccuagcagcuccuugacaugcuuccauguauacuuuugaguucuguucacaugucacauuguuuaaauauugaacccuuggaaagacucauucgaaggugcagaaaagggugauucugcucacaauaagcuuuagagauacuuccuuuuaggguauggaauuuagaaugaccagauguagucacugaauauauggcucaaggcaaucauuaauucauucugcaaauacuuaucaggcacucugguaguguugagacuacaacaacgaauaaaaugaacauggagcuuguguguguugggggggaauacaaauuaaacaaucacagcaaugaauauauaaugagaaacuaugaucauuucuauauagaaacauuauguuuuuagagcauguaacaaucaaggggaugagagaauauuuugcugagaaagugaccauuuaguagagauuugaacuaggcaaagagaggagagaaacuucuuggcggagguccuuaggcaaaagaaaauggaagaaaaagaaaagaagcuccagugugacugagguggagaggaugaggagaagggcagcucuggugagguagguggagcccagaucaaaggaugauauagugugaugaugagcaaaaacaaaagaaggaacaacaaaaacaacaaaaacccauguggauuuugaaguaacacaagccuuagguucacauaugaguuuggucaccuaucagguguguaaccugauuagcuuuaaccucuuucuccuuagcuuccuuguuguugaaaacaaaccucauugaguuacugugaauauuguaagagauggucucugauucguaguagaaguacaugguauagguauaauacuucuaggugcuuuacagugcucuguuuguuagcugacagucaucuaauuuuaggcaaaacagaaaaauaauuauugcuuuuggagauucgcagcuugaagcccggcaacaguuucaaaaaguaaauuagucaacauuuuuugaacacuuaguagguuuggcuuaguucaguuaaaaaccauuuuugagcacauacuuugugcacgauguaaaguaauacuuuggcaauauaagaaugaaccauuuugaaguuaaugauuaaauggauaauuuuauaacaauguugugaaggauccaguagaguuaaauuaagcauguguuuuggugaaggaaagaaaggaaaugaugugugggagacauucuuugcagaaggaauuauuggggaagguuauggaggggaggaaguuacggccaguaacccaugagagaggugccacaggagagagagagaauucuaggacuguccugcaaaagacugcuaggagagggcggugagccaagucaguccugggccucagcacuuacuggauggcugcuuacaaagagcucgggucucucuggaaggacauccuggauuauggucaugaguuagugcucaacuauagccaagaccaaugucuccaggauucaccuguguguuucuuucucugggcauguuuauuuagggacuuauuuauggaaauaguguucccguugcuggaaguggcuaggaacacugagacauguauuuuaucuuauccaaaucaauugcuaugaaacuaugcucaucacccuuuguaguuguagaucacauaccccucagccccucacuauggggccauuuaaaucuuccguguuuuauuugcuuuggauccauccucuucagucaaaaccaucugacuacauugcuuuuuuuuuuuuuuaaccccucugggugugucaguauuauacugcuuagaaauugucuuagaaagcuucuguuuccugaaaaagaaaacuccuuacucaugucauccucugauuuacuccaucccuguuauugccuauuaaagucuuguccauccuucaagaaccugaucagauauuuauuucuccaugaagccuuccuuaaucacuccagcuuaagggaauuucuucucucuuuauaauauugugucacauacuauuucuaauauugcauccaaugcuugcuugauuauuaguguuacucagagggaauuuuuuaaaaaucacuuuguauucuagaacaguuuuuuuuuuuuugucucacucugucgcccaggcuggagugcaguggcacaaucucggcucacugcaaccuccaccuccuggguucaagugauucucaugccuuagccucccaaguagcugggauuacaggcacccaccaccaagccucgcuaauuuuuguauuucuaacagagacgggguuucaccaugauggccaggcuggucuugaacuccugaccucaggugauccacccgccucggccuuccaaaguucugggauuacaggcgugagccacugugccuggcuuucuagaacaguuuuauauuuacauaaucauugugaagcuaguacagggaauccuuguauaucccacauccaguuuccccuauuauuaucaucuuauauuaacauaguacauuugucaaaauguaugaacugauauagauacauuauuauuagcuaaaguccauucuuuauucugauuuccucaguuuccccuaauguccuuugucuggauauaacauuacacuuaguuaucauaucuccuuaggcacccugagcugcgauaguuucucagacuuucuuguuuuuaaugaccuugacaguuuugaggauuacucaucaggaacuuuauagaauuucccccaacugagacuuuucuggugauuuuuuuauaaguagacugagguaauagguuuuugggaggaaguccacagagguaaagugucauuuucaucacaucauaucaagaacacauacuaucaauaugacuuaucaauguugauguuaaccuugauuaccugucuugaggaaguguuugucagauuucuccacugaaaagugacccuuuuucuuucucuguuuuuacacuguacuucuugggacaaaguaacuaugugcaacuuacucuuaaggagcuggggaagggagauaguaaugcuucauuuucuuaagagcagauuaucuacauaaauuauuuggaauucuuuugcauuggaaaugugcauauucuccccauuuguuuauucaaucauuaauuuauagcagcaugaacucauggauauuuauuuuauucuuugguuuauaauucaauacugcuguuuuugaggggaggaacucauuaaguuggcuacugugucccuuugucauaccccaucaucuuuuuguguguacauuuucucaauuucuggcacuaaaagauacuccaaguccaucuuguuuauagucugcuccauucccagaaucagccauuuuucugaggaauccugucuccuuuuauugaagaauguuauuagaaaucaagaucugagcacuagguuugcucauugcuacugggaugucauugccucuaggccuuuucagcggauggaacauauguguguauacuaacccaggcauauacacauaucuauaaauauuuccauauguaacuauuuguauccuuauuaagcuaaacauaaguucauacugaugucuccaaaucuaaucuauuaucauagauuagauauuaugaaucauuuuggggaaaccugaaaauacagaaucccagguaucacuccaaagauaaugaaucgggauaaauauugaacuuauauguuuugaaaggcaaacauuaaaaguaaaugcuucucuugguugaauauuggaaucaauaucaagauuaugaaaacaucaguuuacaugauaaauauaaguuuuacuuuaccauuauucaccauuuggguaaguauuuaucuuaggaaaacuucgugugucugacuauacuuuugcuaauuuaaauuucaugagugugcaaucugauagaguuugaaaauuauuauauuaggugauuauuggaugugccauucaacucccaaagucugugauucgaagucccauauauaaaaacaaacacugcaggaacacaaaauuaauugugagaauuguacucauucauguuggcaguaucugccucacucauuuccucuccuucucuuucuguuuucuugcauuauugguugguggcagacuccaguuccaacaccaucuucugagaugauccugauucccagaaugcucuuggugcuguuccugcugcugccuaucuugaguucugcaaaagcucagguuaauccagguaacauggcuauuacucagcuauaugcuagaagaccagcagaauguuuaaacccaucaauguucaauggugggucuaaaagcugccaagagggacuacaaagcucuuucuuuuuaaaucuccauggugaaauaugacuaaaauaggaagaaaaaugaauauacuuuauauauauguauuuuaauacuuacaaccuguugaauauuguaaaauauuuucuuauauagaguaggggugcaguaagagggcauuuuaaaaaaugggagguggcagaagcaaccauuugcuucugcaucuucugagaaaaacaggacagaauuuuuagaugucuuggagaacuucuucagguugguuuaccaguuguuuugggcugucuuagacuuugauuuuacuuggauguccuguuaugcuuuugggauccugguccugugggaucucaggcagguucucuuuccucuaggauguggccaugcuaaaaauagauagguuaggagaaucuuuugagcccaaauuugugggauuauuuuguauuacaugcauuuuuaaaguuuaaauggaaguaaauaauuguauuauuuauuacacaauaaugcugcuuaacaaccuauccaaagcucaaugucuuuaaacgagcauuuauuuggcuccuagcuggacuuguuuggacuguucucuguucuguguugauuuacucaagcauaacuggaagucagcuggcuauuggcucaucuaggauggauguggcacugaugaauggggcaacuuugcuguguucuguuucauccuccugcagacuaaccuggguauguuuuccuggaaauugcacaggaacaagaccagaagccagaauacucaaacauuuuucaagccacugcugaaaucauguuuacuaagucucauuggccaaagcaauucauguggccaagcccagagucagagugggagagcacaaaaaauuagaugguaaaggucugggaugcagguauuggagaagaauuggagucauuuuuuuuuucauuuugcuacaaauaugaacauggaaaaguauacagcuuaaauguucaauuuuaugaauucauaaacugaacacaucuaaacaguaccuggauuaagaaacagaacuauaccagcacuuuagaagcucucuucaugcucccuuccaguaacuuuucucaccaccccgcaaagguagccauuauccugcuuucuagcaacauagauuaguuuugcccauuuuuguacuuuauauaaauggaauuagaugaugcauaaauacucuuugugucuggcuucuuucacucaacauuuuguuuaugaaauucauccuacuguugcaugcaguugucaacuauucauuuucauuguuguauauuacuuuguuugaacauuuuauuuagccaaucuacuguagaugggaauuugaauaauuucuaguuugggcccauuaugaacaaaacuccuauaauuauucuuauauaaaacuuuugguagagauaaguacucaguuccuuugaguauacacuuagaaguggaacuucauauguguagcauaugauauacuauucugcauaauaccaaaaauuuuuucaaguacuuuaccauuuuaccaucccauagcaguauaugcaaguuccaguuguuccaugcuauauuuugauucuugagggugcuuuaauuuuguccucuucauagcauaaggguacauuugugaaaaugcuugcucuccucccuucauaaaaguuccaugugcauggguuuuucuuuauaccuucaauaggaaauaugaucaaacauccuuaaaaucaaagaauuauuggcugaaggagcccagugccuuguuacuuucucguaauaagcucagcuguugcaucucagauccuaacuuggguaccauuuuuuccuuuuucuguucuguauuccucucaaucaauuguugauguuugguugccuccuacuacauucuucaugcucugaguucuaaggaagagugcugugagugcauggaauggugggauguuuuggugguaagcauagucauggagacuggcaugccacgaggacauuuaaaugacuaaccaggagagcugaucuucuguguuagaguccacacuguggcccuggagcaggaaaugggcuauuuggagacagcaaauagucaucuuaauuuuuuuuucuauuucuggugucagguauuuuuguuggcucuuucugacagggaaagagaaauagacuucuugcuuugcaaagaccuuuauaggaaaacaggacauguugaaggacuaauccuucucucugccauuucuuucuauuuuaccaagucaaaccagagaugaguguuugaggcagaugagacauuuucauucauuaucagugauaaagagucuaucaugaauccugaggcucauagaauguuauagcuugcacacugcugagcauaaagucagcauaugauaaaugcauguugauuuaaggaugacucuucaggaguccuuacuggugucaacugaaagacugacuauaacugaaaguauugaaagguaacugaaggcacugaaagacugagugaauucuuggccaguuagguuuuucccacagaauggccacaugauauaacaaauagaacuuaagccaggagaccugaguuauaagcaaauccaauaugcaaccaauuauuaaauuacugaaacauuuuaguugguuauuagcuauaacauauugguugguuaauaguaacugagcuaagcauuaaacucaauaaaauaaaaauaaaauaauaauuaguugaagcucauuguugaagaucuuacaaugacuauuggucaauaagccuucaguauuagcaugauuuaguugauaacaaacauuaaacaugauaugauaugaaauaucaaucuuggugucucagcagauaccaagagaggauaaauaaucuuguuuacauuuaaaaaaacucucuaguauuugaaaucauaaaugucucacaggugucauccauggaggcugcagaguaguggugguaugacagagauaguuggcugaagcacgaaggcagcagaguuuuuggcucacuguucuaaaguaucugaguuuuggcaaagcaggcagucaggcagaugguguuaguggcauuuccaguaauggcaguguuaaagguagcauugucaauggggccuggagcguaggcuacgcaagucuuugugggaaaugcugacaugaagguguauauacauaguccugaauugugggcagaguucucagcuaucuuccagcugcaacagugcaccaggaacuggaaccuaaucaucauuaauccagugggagagguuauuggaagaauuagaggcaguuucuuaugucaaaaucauggcucagaaauaccauuuagcuagugacauccaaaucaaacaaauaaucaucccaauaauuucugaaaaucauuuauacaaaucaacagaugauuggaauguuauuaguucugaugaaugauuuggaguuaacuuagaaaaaaguauuuagcuuaacuuuugaguaacaacccuaauuauaauccugacuuggucauaaauuaauugugugacagugagggaguuguuacgugucucuuuauacuuccuuaauauuuucacuuguaguaagauuaaguuggauuagauaaucuaugggacccuuucugcuacaaaauuacugugauuuuuaugaugugagaacuuuauagcccauacuggaagauuucggcuuggaaguauagccccugaaguugcauggcuguuuuuugcaagaaagacuacuuguuuccaacucccuaccacuucccaggcucagggaugugaagucugaauuucaggagaaucuugccuuuggggcuaagcacacaggaagugacugauaaauacuuaaaaauuuuaaacccuaaaacucugcuuaguggcaggugaaugcagaaacccugccccagccuaaccugcaggagagucauagugcuacaagcuacccugcuccagagcaucuuuugcucuagagguggggccaagagguagcauuucaggcugaagauauagcguaugcaauggcugagaggagggugaggaacauuuggggcuccugguggaggauaaugagugagagagccagcggggcuauguaggagauccauuccccugugggauccuugagucaaguuuucccuuauuuccagcuugggcugggacugccaaacuugauaggagaacuaagggcaucuccaugggaaagagaccccacaaucaugcacaaaaauacggggcugcaguaguuguuugaguggacaucagugucaggcuccccuaggggauauaaaaccacuguuucagugguuaguggggaacuggcaccuuacguuuuuccagguaggaggaugaauagaacuauccugaugauccugaaauucuagcccagcagucugaagcccugggacccacccagccaauuagaggauuguuguguauaaaaaacacaggggugcuuguucuuauuccccugacuuggccugugacaacuguuugugcucaggaaagggagaaacaucucuucuucucagcaggcaaaccaggccuuuaggauccaugguauaaagcugaggcagggcagugcuggaacuucccauuuucaugucacacuuuccccucauaggaagcaggcaacuuacuaccaguucagaguccuggggugggagucccccuuugguauccagaaugcuuccacuuugaaaaagaguggcaaagccauucaggguuugggauuaggagaggacgagcuuuucuccuccuggccccaaauuuauuuuagguucaccacugugguuuuuguucuuuccagcaucaaucccacaugucagugaguucuuagggucaggcaacuagaauucuagacuguucauguuggaauggaccuuagaaauaucuaagucacucuuccucacuuuacagaugaggaaacugggagucaaagcaggugagugauuugcccaugcuccacauuuagcuaauaguuaagcuaggacgaggacccagggcuaccugucucccaaucccaggugacuucuaccugggcccucagggagcaaugugcugaagugaccuuuaucuaaaaaucacauauauccaugcagccucaugcuuuccuuucugcaaccaacuuccaauguauauuuauggggaugagauguaauugagauuugagggacagccugaggccaaagaauggagucagacgaauaggauauacagugcucacaccuagucucaugcuaaaugaggaaggcuggagcuagaagcccugcgggccaacuuacccccacccagaaacugaagcaccagggaugcuuugguucccuucugcaccagguugugccuuuaucaccgcucccuugucuuccaccaagacugcuauguguuaauucaccuacacauauuuccaaauuggaaacucauuuuuguuucccuggcuucucgucauucguguucccagagaugugcugagaagguuuauguggccucaucuguuaacgagaaggugaugcuaguuucagguuugugaaaccaggccugagguacuaguguugugauguguguguauguguguguguagguggguggcgcggggguguaguguguguuagacagccugaacaggccuugagaaaaagauaaaaggccggcaaaagaccucucugguugaauuuaucuuaagugagcaaugcuagaagcugcccagauuggcucuuucuugcuuguguguuuguuuuuuaagucuaggcugacgccugagaguggccuuuggcauccuuccugccaguaaaagagccuuucucuggguaaaacagaaacucaucugccccuugagcccucuugguugugccaaauagggaaaaagagaaugcaaaacucaaagaauauucaaugaacacuuaauauauucuggguaccauuuuaaguggugucaacaaauuuaaucuucacaauaaucuuauuaguauuaguguuauuauauaauaguaguauuauuauuccaguuuuacagaggagaaagugaggccaagaaacauuagguaacucauagcagguuacagagaaagcuaaguggcagaaccggcauucgacucugcuccagcaagcaugcucuuuucuucuacuucuuuuuucuuuaucccguuuuucaaauuuccaacaauguaucaguuaagaguuuuucgcuuguuuuuuuguuuguuuuuggagagggcauguugcucugucacccaggcuggagugcaguggcaugaacaugacucacugcagccucaaccuccugggcucaagccauccuccugccucagcuccccaaguagcugggacuacaggcaugcgccaccacacccaacuaguuuggguacuuuuuguagagaagggguuuugccauguuggccagacuggucuugaacuccugaccucgcccuccuaaagugcugggauuacaggcaugagccaccacacccggccacaagcaugcucuugaccucugugcucuacugccuuuggagugugagacucaaggaaugucagggcagaggaaacccagauucauggaccagccacgaaugggcuacagagacccgugaauccccugaaauugcaucccaaacuuaaugugugaagacaaaaguacauuugcaaaaugaaaaauguuuucuauuaucagaugcucaaaagacucugugaccaguucuagaaaagacuaagaaugguggauuuaaucuaaucuuguacaaaugaggaaacugagguuuagggagauaaagugaugggaggaaacauguuugaaaagacuauuagcagaccuaaccaggcuuugccuacucgcuggacgagcauggucagaguuuuggguucucugaacugcagucuucucaccuaucacugaucgcugccuuaagggcuguuaggaagaguaagagaauauauguaaaguaccuagcauagugucaaacacacagaaugugauuaauaaaugcuggaacuucuguccucuuccucaauuuuguauauugugcugugauaauggcagacuucauuagucuuuccauuauucuauacuguccuuuauauuuuaguuuaaucauuucauuaauuaauuauuuaacuuaauuacuauacuguaaaaauauuucauuuucuuugagggcagacuucaccuaauuccugggcuuuguaucuugggauaaaaggguuccaaauacaucuacugcaucaucaccuuuccauccaaaguagccaggugaauucccgguucauacccuaaaacuuugccuucacccuguuguuuugcauucugaggccuagauuccuaguuguaaaaggcagucagaggagcuaaaaguaaugcaagaaaaaacaaagcuccacuuuuuuucuguugucaguagggauagaggcccagggagaccuagucuccuugagucuaaacuuuggggccaggagcaugaucaugggacuccaggaagagcuucacacaaagucccuuuucuggaccucucaguuuucacaaccaccugcagagcucaguuuugcucagggcucucguguggaaagacuaagagucuacagaagaacaacaguguuggcaggagcagacaaggagacagggacccugcuuaccauggaaacugggcgcacuggggccauuagguccgugcaucacugcugcuucacauauuugcuuauuaauguuuuguucugaaagcugacaagaacucuaggggcuucaagcccauaagaucaagacauacaauauagcgauauaaguauguaagaaacauagauugauacagauauaaaauaggaaaaggauaugaaacaaauauaauauauaugauaaaaauuauaaauauuauaauaaauauauuauaaauauuauaauauuuaauauuauuaauacauuaaaauauaaacauauauuuauauuuuguaaauauaaacauauauuuauauuuuguaaauauaaacauauauuuauauuuuguaaauauaaacauauauuuauauuuuguaaauauaaacauauauuuauauuuuguaaauauaaacauauauuuauauuuuguaaauauaaauauaaauauaaauauauauauaaaauauguauaaaaauaaacauaauaaauauuauaauaaauauacacacauauauaugugaguauauuuauguauguauuuauauauagauauaucuauauuuauguguguauauuuauguaaguauauuuauguauguauuuauguauauauagauauaucuauauguucacauguuacauguuauauagauauaucuaucuauauauagaguuaaaaauaaauaaauaaauaaauaaaaauaaaaauaaaaauaaaaauaaauaaauaaauacagagaagccugggaguuuccuugacuuccuuuuucccccucccucuucuuauucaucaaacauuuguugauugccuauauaagccaagcacuguaauaggugcuggucaugacgacacaacagauuaucacuacaccagagacaaagaccaaagucauaaaaaccucugaagcaggaagaaaaaaaaaguugcauaaauuuuuuuaacaacucaucaccucccacuuaggcucauaaaaaaaccucacugauuuuagugucuuaacuucuacuuuacuguguauguguccaaacuacugaaaaauucugugagggcuaucuugccacauccauacucuucagagacccacaggccaggaccaagagcuaagucgacaaucacacuauauauaucuauauauauauauauagauauaaucacacuauauauaucuauauauauauagauauaaucacacuauauauaucuauauauaucuauauauagauauaaucacacuauauauaucuauauauagauauaaucacacuauauauaucuauauauagauauaaucacacuauauauaucuauauauagauauaucuauauaaauauauagauagauaucucuuuauauauauauagauagauauaucuuuauauauauauagauagauauaucuuuauauauauacauacauaguccauaaauauguacauaaauauguucacauuuuacccaaucaggucaaaucuccaaugucaugcuaguugagauacugaagguaugagaguuagcuggagcugaaagaauuugccaggccagguaaaaagaggaagggaaagcuuuugagcugaagaaaaggcacagaggcacaaauagaaaaacaagagugaggauagugauuauugaggggucaugaaggcaaaggugggguuaggauggcaccaaaaguaggaaccauauaaucuugggauccucaguauaugacaaauguuuuaugaucaaaggccuugucuucaccugguguuaacauaaugcuaugccaugcugucuuucccagagugcagguuccuuuugcuaucacauuucaacaaauccugggacaagcacauucuaaaaauuagacaagcaauaauccucccugggcucucuguccagauucuuccccaacuuggugauucuugacccuagugaucacaugauaaacagggugugugugcugguagcagggugugaugaccacgugauacgguuacuagacagacugugacaauggagaucaagagaucuagauucuaguuccagcucugucacuaucuagcuuugugacuuuagguaaaucucugcaccucacuuugcucauuuauaacaugggguccauaaacuuugcucucugaacuucauaggguuacugcaggggauugaaagagauaauggaaauaaaugggcuuuggaaaauuacaugcaaauaucaaagacugugauuuguuacuuuuggaagaaaagaaaaugaaaauaaacacuaugaaacaacaguuucuaucaagcagaugaugcaggaggaagaaagagaaaaaaacuccauuagugaucauuaaggucccuugugguccccaagaccgacucaaguugcuuuuggggaauggggcuucuaacaguccugaacucuggccacccuaacucuaaagggaugcaggacccugugcucaagccaagcauauccauuuauauauauauauauauauauuuuuuuuuuuuuuuuuuuuccuugggagaauagugugauuguugacuuagcucuugguccuggccugugggucucugaagaguauggauguggcaagauaacccucacagaauuuuucagugguuuggacacauacacaguaaaguagaaguuaagacacuaaaaucagugagguuuuuuuaugagccuaagugggaggugaugaguuguuaaaaaaauuuaugcaacuuuuuuuuucuuccugcuucagagguuuuuaugacuuuggucuuugucucugguguagugauaaucuguugugucgucaugaccagcaccuauuacagugcuuggcuuauauaggcaaucaacaaauguuugaugaauaagaagagggagggggaaaaaggaagucaaggaaacucccaggcuuuucuguauuuauuuauuuauuuuuauuuauauuuauuuauuuauuuuuaaauggaguuucacucuuauuacccaggcuggagugcaauggcgcaaucucggcucacugcaaccuccgccucccagguucuagagauuuuccugccucagccucucgaguagcugggauuacaggcaugcaccaccacgccuggcuaauuuuguauuuuuaguagggacgagguuucuccauguuggucaggcuggucucgaacucccgaccucaggugauccacccaccuuggccucccaaagugcugggauuacggcguaagccaccaugccuggcuuuuuuuuuuuuuuuugcaaaaaaaaaaaaaaaaaucuaaaugaugccaugugagacuugaucucagaaagauguugggaagcugggaaggaacccauaggaauaucaucccuuuaaaugaugagaugcugaguauggugugaguaaauuagaaggaagauaaugaaccgaggccauuucagcugaagcuaccaaagugcagcaccagguccagccuucuaguguuagagaacugggagagcccaucuccuugcagagguagagcagcccgggacugcaggggagggugaggccuucaugcuuguuccuaaaugccuaaggucuucguuuaggcuacaagcggagcauuuugauuguuauacauaaaggaaaaugugguuaaauuuaauucaaauauauguaaauaucuuaugauuggcauuucaagggaggaagucagauucaaucuuuuggcuacuguaaccuauauuaaagauaggaaguaugcaaugauguguacugucuauguacagguauugcuaacuugagaaauguauuggcaugggaggagcccugggcuugcccauaggacaaauccaccucgaaagcagagcagagugucuucauucuggguagcugguaggauguaagccugaauucuuggucuuccagugcuucuuaaaaacucccacgugcucucuuuccucaccagguccugaacucuaaucuguguccuguccgacucucaaaaaaucagcucagcucuucagagggcuucuccuuacauucccccuccacacagccccagcauuuggcacaugugcugagugagauacacugcaugcucgagggauaccaggucucccucaaaaacucugcuaauuuugucccguagagaccgucugcuagugccaaacccggagucggccuccugccccugcuccaaaugggcaaauggcugaaaguggcuacagaaguucccucaccucucugagauucucccuucucugaagucuuggucucugcauucucauugccucagaaacaaucagauuccuucaaguagaugauuuaugaauuuuauuuagcucuuccaguuacuuuuagagggagcacuaauuacugcacacuacuccaucccaccuagaaacagagauauuaauaaaaagugaauuuauacuuuauugccacugugauucauguuaacuaaucauguuuuacuuuuugacuugacuucuaggaagcucagagccaaaguugaaacccaucaucagccagugguauagaaccaaauguaauacucuuucuguauuaaccuuagcucuagcuuaucuaauuguuccuauuuucuuuuuccuuuauccaaauuucuucacuuauuuauuuauuuauuuuuaucuuaugcaacuuuggaagccgacuccaaacuuuacugagugagucaaaguaaaaauaauuaaaaauaaauaauaccuaacuuuauugaauauuagugcucuaagugcuugacauaauuaacucauauauuccuuauggcauuccuauaaacaagugcaauuacuaccaugaaauugagaggcugaaagcuuaaguaaccuuucuaaggucauaaaaccuuuuaauuguuuaaggaagagugaauguacuauuuuaaacaaauaguucucucuucuccucuuagauaucauuuauugagccccauuacauucuauaaaguaugcuaacuucuuuguauacauuauguuaaccuuggcuuggcaggauuaugaaagaugaagaaaccgaaguucauagagguuugguaacugguaguggggucccauaauucagaaguggcagagccaagucuuaauauaaacuuuccaugauuccaaaccguggccucaguuuucuucuucacuccugaucugcauagcuacccaguuuccucuucagcuuaccuucuuguuggggaaaggagauacuauuuacuaugaaaguuucacugucuuuguuaaccaggaagaagaauucauuaucugaucccuauguuaguauccugaaacccacuacagcuuggggacugcucuccuggggcucugcaagaauuguuucuggaaaguauuuugggcuuccaggaaaacugcaauccuaaaggucuauuccuaaggggaauuucaacuugugcaagaggucugggugaccauuauacccaaagaauagcccuguaggcugaagaaagaaacccaaauaaucuuucuuggccccccuguggaaucccauugugucaauauuuaucugcacaaaggaccagucugaaacagccugcucugugaagcuugugggaagcagggccucagugacaguuucuuuaaguggacuaccuuguccuuucagaaacuggaagaacuagaccaugguagccuaggguuggaggaggaagaaccagggaucaggagaccugaauuucaguccugguuacccuagcccucugugugaacuugaguaagucacuucaccuuucugggccucagagguucugauauuuaacacggagacauuagagggauuggcuucuuaaauuugcuucugggcuccaacguuuuaugauugcagaugucccuuuagauuguagacuggcuugagaccgcugaccccaauaaugccccucagucagucuugucugggcccagagaggcccaggugucaggucucugcaccucaggccucaugugggccauguguguguuuuccuggaagcugcauauaggacacucauugacggggagcccguggucuggagcuaguagugagaugguaaacauuauggaacaagcagcccuuucaggcucucagccuuggcaggauaguaugaaaaauaauucuugggaagcuggggacugguggcagcugcuucuccucagccugccugccaggcccuaccagagcuuggagggcuggagcucccugcugggccugccacagccugugcugguaguuuuccacucugggaaacuggaaaagugaauuggcuucucuguccgggagauugguggguagcggaagcaucagaaaaccgcuaagacaacucagcaggaaaaaccaggagacacuucuuugcugcagggucucuugcuucccuugccauucccagcuuuuucaugcuucuuuacaguucaugauagaacaaagacagacuggugggauuugaugaacgaggaaguggaacugggggaaagcaaggagaccugacauuuagggcuugggccaacuuggcaguucugagucuugacuauuggcugagaucccuuccacagaaggaguuuacccaaaauaggcacauucaaugggaaaaccacacugguacagcucagaagugccacguugguugcccugggcuuuuccugguuccaaagauucaguaggaugagaaaggucauccaagaucaucuuguccauuuuccugugccuuuucucuaaggcccuugggcauacugagucacugagaaacuuugccuauuuucuuaaugugacuauugcugauuuacuaaguucuuaucucugaauugucuauccucauccuuauauuacuuugucacaauuucuagaccuccauccuaacuuucguugucuggagauugugugcaauacuuguagcccucucugccuuuucaucuacuuauuuauuugccaaacguguguuaagcaucucaugggugcuguguguuggcagguacugagggggaaaaggaagaaucugacaugauuacuauucucaaaguugcucacaauuucaacaaggagguaaccaagcacaagaguaacagaaaaucuccguuggaguuuguuacuuaauagagcucgccuacacaccaucaucacuuuaaucccauaccacguuuuaguauuuuccauagcuucgucacauuaucugaauagaaagagccaguaauagcuacugucaaauacauaaucaaauugugccuauuugauuaugaaaaaucuauuuucuuuuuucugucuccccuaccggaauguaagauccaugagacaaauuauuuuaucugucuugcuuacuacuguaucuucagaagaacacccgauacacagcaaaaacuuauuuauuaaauaaauacauacacauuuguaaaagaaauacauuugugaacucaauacaugcagguaaagauagguugcaauaaaauaugucaugacucagacuuacaaggaaguuuccuguaucuccugucugcuaaaacaccauuagccaaggcuacccuugaccaaacucccaggacuuuguuuuuaagccuuguaaagugaugaacaacagaaaacacuuccuuuaucacuuuucaauagacguuuauugagcacuugguuaaugccagacauccuacuagaaauuggagauacaacagaggaagauagauaugauccuugcccucauaacacaugcuguuuagugggcagaccaaaauuaaacaauuauuuacauuacaagucuaaaaacuguuaugaacgaaaaccaguuuguuauaagagcauauaauagaaauuccuaacuuagcuggggacuugggggaauuccuugggggagugacuggcugacagcugaaggaugagcaggagcuagugagugaaggagggaggaugcacaucccagguaaagggagcaucaugcacagagaccuugaggcuggaagauacuuugugcauucaggaacugaaauaaggucagcgugcuugguagagagcaaagaacagggaauagccagagaugaggccagagaguaggcugagacccaaucguguggaccucaagggucacauuuucuuaagaagaaugaaaaccuguuagaagguucaugacagaauaaaguuuuaggaagcuaauuugggcuauuguguggagaagggaugauagaggaacaacgaagaagagcuagaaggcauuauaguggcucagaugggaggucauggagguugcgcacugcaugggaagaauagaggagagaaacagcuggacucaacugcaggagguaggauuuguagaacuugcuaauggacuggaugguucucaaaggccaagcuuacuucucauuccuugacugccgccuguugagaguaacaucuuaccuaucauuccuggacucuuccucuccaagaauucuauuuuggucuccaggcagagguugacucagggagagccuuuccaguuuucaucaaugucauugccacucugcuguccaccacacaguugaccuaaacccucuguaugcuggaagagcuggacgagucgaggaagaggggagcgcugacauguguaacaaguuauuuacaugaaaugaagccucauguccuccccuacuuccucuaguucucaagcuugagucugcauuagggucaucuagaguagugguuaauacacuguuugcuacccccucccagcaaccccaccagaguuucugauucauuaggucaaauggagacugauaauuagcguugcuaaugaguuuccaggugaugcugaugcugcugguccuggaagcauauuuugaggaucacagcucuaaaugguaacugaaaugcaaucacaauacauagaucaaagagcuuucaggaaggaaacuggcacuccuuugacaccacauagcagaguauccuauauggaucuaccuccacaucuguuauauaggaaaauuccugaauggguucaguuaggacacaaaauauaaaggguuucuaugccuaggaaauauaauuuaacugaaaugugucauaaaagcagcugcagcagcaguagcucugauaaaacuccuuaguugccauucucagaaugagcaguacguuagaaggaaaguuauuugcaacaauaucaugauucaccucaugugacccacauucccuauuucugcuuuacuuuagauauuccaagaagcagaggcucucauugcauucauggccuaguguuuagagaugcauuaaagccagggaugaaagcccagugggacggucaguguggcuuucucuggugcccagcaugguccuagagaaucauuacacguccaggcugaagggaccugggagcaguggcuccagagccuggcuacacagcacagucaccugguggacuguaaaaauaugcagguuacugggcucagcuucagguauaccaaagcaaaaucucuaacaggaggcucacaaacauguauucuaaaaccucuccaggcuuuucuaaugcuauugguccauggacuggcuuugggaaucacugccuuacagaaagccuaauagaacucucuugcuuuccacaugaagaaacagaccgaaagagagccaggagcuugcucagaucccacaugguauaagugguagaaccgggaguggaugcgaagucuugauuuucaaggguugugugcucaguggaauuacaggcuuuagagccaaguucuaagaugaguuaguauuuacucaaggaauggccuuugcaguuaaaacuuaccuguagaaugugugauuagugggaaacaugaaauauuggguggaaaaugcuuaucauauugccugacacuugguaaaugcuucuaaauggaugucaucauuacugcauuuuacugaauuuaagcaacucacgacucuaagaugcaucauuacuuuaugugccucuaagaaagaaagaaaaacuacugccaguuaaacuaugacacuauuugcuugcgaagugcauccagauuucagagaugucaguacgugaaagaaugggcagugugguauuucacuucucuuuucucaacucuaugaagauucuuacuuuacugaauuagacacuuaacaguacaugaaaauuccugaaggagaaguauacuuaguguguuugaggaacaacaaggaggccaguguggcugauggggaaagugggguaaggacaagguccaagacagccaggggaugucugauuccaugucuucacuauugugaauagugugaacagaagaguuucaugauaugacuuucauuucuuuuaugacuacauaguauuccaugcuguauauguaccacauuuucuuuucuuuucuccuuugcuuuuucuuucuuucuuuuuuuucguuucuuuuuuuuuauuacaguuuuauuuuuuauuuauuuuuuuuggaauaauuuuuuuuuuuauuauacuuuaaguuuuaggguacaugugcacauugugcagguuaguuacauauguauacaugugccaugcuggugcgcugcacccacuaacgugucaucuagcauuagguaucucucccaaugcuaucccuccccccucccccgaccccaccacaguccccagagugugauauuccccuuccuguguccaugugaucucauuguucaauucccaccuaugagugagaauaugcgguguuuggguuuuuguucuugcaauaguuuacugagaaugauguuuuccaauuucauccaugucccuacaaaggacaugaacucaucauuuuuuauggcugcauaguauuccaugguguauaugugccacauuuucuuaauccagucuaacauuguuggacauuuggguugguuccaagucuuugcuauugugaauaaugccgcaauaaacauacgugugcaugugucuuuauagcagcaugauuuauagucauuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugauaucucauagugguuuugauuugcauuucucugauggccagugauaaugagcauuuuuucauguguuuuuuggcugcauaaaugucuucuuuugagaaguguccguucaugacaaacccacagccaauaucauacugaaugggcaaaaacuggaagcauucccuuugaaaacuggcacaagacagggaugcccucucucaccgcuccuauucaacauuguguuggaaguucuggccagggcaaucaggcaggagaaggaaauaaaggguauucaauuaggaaaagaggaagucaaauugucccuguuugcagacgacaugauuguuuaucuagaaaaccccauugucucagcccaaaaucuccuuaagcugauaagcaacuucagcaaagucucaggauacaaaaucaauguacaaaaaucacaagcauucuuauacaccaacaacagacaaacagagagccaaaucaugagugaacucccauucacaauugcuucaaagagaauaaaauaccuaggaauccaacuuacaagggaugugaaggaccucuucaaggagaacuacaaaccacugcucaaggaaauaaaagaggacacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuucaaguucauauggaaccaaaaaagagcccgcaucgccaagucaauccuaagucaaaagaacaaagcuggaggcaucacacuaccugacuucaaacuauacuacaaggcuacaguaaccaaaacagcaugguacugguaccaaaacagagauauagaucaauggaacagaacagagcccucagaaauaaugccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuagaccuaaaaccauaaaaacccuagaagaaaaccuaggcauuaccauucaggacauaggcgugggcaagggcuucauguccaaaacaccaaaagcaauggcaacaaaagccaaaauugacaaaugggaucuaauuaaacuaaagagcuucugcacagcaaaagaaacuaccaucagagugaacaggcaaccuacaacaugggagaaaauuuucgcaaccuacucaucugacaaagggcuaauauccagaaucuacgaugaacucaaacaaauuuacaagaaaaaaacaaacaaccccaucaaaaagugggcaaaggacaugaacagacacuucucguuucuuuuuuuuugagauggagucucucucugucgcccaggcuggagugcaguggugugaucacugcaccuccgccucccagauucaagcaauuuuccugcuucagccuccugaguaacugggauuacaugggcacaccaccaugccuggcuaauuuuuguauuuuugauggagacaggguuuuaccauguuggccagucuggucucaaacuccugaccucaagugauccgcccaccugggcugcccaaagugcugggauuacaggcgugagccaccaugccuggcccacauuuucuuuaucgaauccacuauugaugggcaccuaggcugauuuaaugucuuugcuauugugaauagugugagcggaagaauuucaugauuugauuuacauucuaaaagauacaugggaaaagguggacaaagggagaucaguuaggaaauuauugcacuauuccuggcaauggaagacagugaauuagcuuauuaugauaguaaaauaugugagaagaaguaggugggauaugggaauauuuuuaggguagccaguagaaucuucucucaguggauggacugaauacaggguauugaaggagucaagaauggccucaagauuuuuggcuugagucguugaaagaauggaaccugaaaaaaaaaaaaaagacugaaggaugagcuuuggagggagucuguauuuuacucaauguuaucuuuauuccuuauuuacaucuaucucuaaaguuuaccucuuuuuuuaaauaaauauuuuuaaauaccuauuuucuccccaauaugcacugagaaauaaaaaugaauaagauacaguggcuuuauuccccucaaaauuuugccaccugcaggggagauaggacucacacgugguacauuacaaagcaguauguaucuaauaguauaagaaagauauuuaaaaugugagaaaucagagaaaggaggcauucauuguaauuggcccuauccuccccucaaaaugcuugcuuuuguugaguacaaguucauuacauuggaaaaggagaaugcuagcauaauaacuuuaacuaguuuuuucacuuuggguaaacugccuccuugcuguaccucaaaccaccuccacaacaagcaugcuuuuuccucaaguuuaccuuugcauuugcuguuccccuugcauaaaccaucaucccugcaagagucaccugguugcugucuuccuucacucaggucucugcuccgagucaccuuaucuaagaagccuaccuugauuucuuuauauaaaagaaugccuauuccuuuugcauacuuuuucuucacagcacuugccaucuucucucacauuauauauuuauuugcuuuauuggcuguuuccccacaugagaauguaaacucagugacaaaaggcacuuuguuuuguuuaccacuguauucccgcaaggccaaugaauugcuuaacgaauuauuuaauaaauauaggaauuaaaauaaaccauggguuuggaaagcaauaagcaaaugggguuggagauaggacuggacucugaacacagcguugguuucagaagagagagaagacacuagagaacagcucucugacuaagcuacaugccucuguggcagccuggaaucuugggacacacggcuugcaccaggccacucuuuugguuaaagcaaagguuaaagucugguguauugggacaaacuuuggauagagauacagaaugugaucuacgucaaucccuacuacuuaauagcugugggccuucugccaguuuccucauacaggaugaguaucccuuaucuaaaaugcuugggaccagaaguguuucagauuucagaauucuuggacuuuggaauauaauauaauauaauauaauauaacauaacauaauacaauacaauacaauauaauauaauauaauauaauauaauauaauauaguauaauguaauguaauguaauauaauauaauauaauauaauauaauauaauauaauauaauauaauauaauauaaauuuacccaggugagcaucccaaauccacaaauccaaaauccgaaaugcucuaaugagcauuuccuuugaacgucaugcugguguucaaaaagcaucagauuuuggauuuuagauuuuuggauuugagauacucaaccuguauauauuuugagaguaauaguguguacucugccaacuacauaggguuauugcaaggguaaagcaaagauaagccaugggacagcacuuugcaaacuguuaagaauucuauuaucagggucaagauggcaaucagggacacuaugacauggacuacagucaaaagauccaggaaugccugccuuggacagcuagaucuucuccccaggaggugccugagggagacauacacacaggugacagucacaaaggguaagugaaguucuacauuauuaguagcugggcuuggguccuaaaugccaaugugagcguucugauaaacugaccugggcauguagcccagguuaaaggccuccagaagccucucuuuauucauuaagucacuggugacaaggacuaaaacacuuagcacacucagcgacauguaagaucaguguugaggagggauuagagcaggccccugagagggccauuuucuuugugugauuuucaaaaaguacauugaucucauccauuggaaauuuuggccccauuagcauccuguguuaguguuuccucauccuuacucuucccuucaauuucacuucucagaaaguggaauuugagaauuuguugcuucauccccaaacaguucagauuugcccuuaagauucaagcauaaugauuaccuguggcacacauuaccucuacuggagaaauuauacuuuugauaagaauaggcaaagugauauuacauucauauguucaucucuugauucaaaacugacuuggaaaucauaguggaugguguguuaggcuguucuugcauuguuauaaauacauacccaagacuggucaauuuauaagaaaagaggcuuaauuagcucauaauucugcaggcugcacaagcauggcauuggaaucuguuuggcuucugaggaggccucagggagcuuauaaucaucguggacggugaagugggagcaggcaugucacauggcgaaagcaggagccagacagagagagugggguggcggggaagggacugcacacucuuaaaugaccagauccccugugaacuuagagcgagagcucacuuaucaccaagggcauggcccaagccauucaugagagaucuucccccaugauccaaacacccuaccuccucucccacccaccagcccccaccuccagcauuggggauuacuuuucaguaugagauuugggugggcacaaauauccaaacuauaucugaugguguauuaauccauuuucaugcugcugauaaagacauacccaagacugggaagaaaaagggguuuaauuggauuuacaguuccacauagccggggaggccucagaaucauggcacgaggcgaaaggcacuucuuacauggcagcagcaagagaaaaugaagaagaagcaaaagcagaaaccccugauaaacccaucagaucucgugagacuuauucacuauuacaaggauagcacgggaaagacgggcaggcccccauaauucaguuaccucccccuaggucccucccacaacaugugggaacucugggagauacaauucaaguugagacuugguggggacacagccaaaccauaucagauggugaacauagaaguguuccuguggguauauggccauguuucuugccaaaacuuccugcauaugauucugguuaauugcaguuucuggaaguaucagcuaauccuuggccuaaagcuaucuuucccuuuuuuagggugagauaagacuccaggaguucuccuugguaugauacaagcagaagggcccucuugccuucaguucuucaugguuguaguggauauccuccuucuucaagcccaugauguuccuuagggaagguaguucugcuguuucugugccaagccugggcauuaugcucacgugaaaccuuuuucccuugauuuuugcuacuucuccagggcacuuccugggaauggggcuugguaccuauuaggacuauaaauuugccucucucugaccccuccaagcugagagaagucucgccuuucucccugccaccucuacuccacccugcagucccuuucugagggcaggcuuucuaggaaguucuuugucuucauguaguuucuuuuuucuucccuguaaacauaaauguccccuagggugaaugaacauaaaggccuggccacaggcuuugaaaaaggaagugauaauacacaaaaaucuucaaaauuaucuuucuccagagauuauuucaaaaacaguuuuauugaaguacaauagacauacaauagacugcacacauuaaaaaugcacaaguuggccaguuuugacuuacauauaaaccugugaaaucaucaccauaaucaagauaaugaccacauccaucacuaccaaaaguugcuugugucccuuuaugauuccucuggccgcuccuccuucccccaggaaacaacugaucucuuucugucacuauagauuaacuuguuuuuguuuucuaaaguuacauauaaauggaagcauacaguaugugcuuuuuuggucugacuuuuuuuauuaagcauaauuguuuugaaauuuauccauguuguuguagcaugcaucaauaguucauuuuauugcugaauagcaaggcaugaucuaggguaggacaagugaagugccuaggguuaaaaugcagucaguuccuuaugaugauaaucauaaugaugaugacuguaaaaacauuuaaugagaccugcucucugaacaaguuuuuaaguguaauauaccguaucguuaaguauaggcacaauguuguacaguggaucucuagaacguauuaaucuuguauaaccgaacuuuauaucccucgaauaugaauuccucauuucccuuuccucccaauuccuggcaaccaucauucuacuuuguuucuaugauuuaggccauuuuugauauguaacguauguggaaucaggcaauauuuacccuucuauggcuggguuauuucacuuagaauuauuucuaccggguucaaccauuuagucaaaaauguuaggauuucuuucuuucuucuuuuuuguucuuuucauuauuauuuuuuauuaucauuauacuuuaaguucugggguacaugugcauaaugugcagguuuguuacauagguauacacgugccauggugguuugcugcacccaucaaaccaucaucuacauuagguauuucuccuaaugcugucccuccccuagccccccacccaauuucuuucuuuuuuaaagcugaauaagauuccauuguagguguaucccacauuuucuguaucuacuuaucugcugauagucauuuguguuguuuccaugucuuggcuuuugugaauggugcugcaaugaacauggaagggcagauaucucuucaagaugcugauuuagauccucuuggguauauaccagaagugggacugcuggagcauaugguaguccuauuuuuaauuuuuugaggagccuccauacugacugcaucauuuuacauucccacuaacaguuuauaaggguuccaguuucucuacauccuugccaacauuuguuaucuuuugauuuuguugaugauagucauccugacauguauaaggugauaucucauuaugguuuuaauuugcauuucccuaaugauuagugauguugaacaccuuuucguguaacuuggccauuuguaugucuucuuugaagaaaugucuauucaacuucuuugaccacuuuaaaaucauauuuuuuguuuccuaucaaguuguaugaguucccuauauaucuuggauauuaaccuucaaauauauaauuugcaaauauuuucucucauuccaaaggucuuuucacuuuguucauuguuuccuuugcugugcggaaguuuuuguuguuguuguucaauuguaguuccgccuguuuuugcuuuuguugcuuauguguuugguaucauauccaagaaaucauugcuuagaccaauguuuuuuucauguaucuucuuccaggaguuuuauacuuuuagauaucauguuuaaaucuuuaauccauuuugaguugauuuuuggguacaauguaugauaauaguuuaauuuuauuaucuugcauguggauauccaguuuucccaacaccauuuauuaaugagauuuuuuuuuuugcccauuguuuauuuuugacacucuuguugaagaucaguugaccugugugggugacuuccaggcucucuauucuguccuauuggucuauaugucuguuuuuucagguaccauacuguuuuaaguaacuuucuaaaauauuuugaaauuaggacgugugauacuucugacugauuucuucuuuuucaacauugcuuuggauauuuugaaacuuuuugugguuccauauaaauuuuaggguuuaaaauuauuucaaaauaauuucuguaacaaaugucacugagauuuugaaaugcaaucaguugugaauccguuucaauuguucuuuuuuuucuuacaaugguuucuauuuuucugcuuugucaaaugccugauaauuuuuuauaguaugggacacacuuacaccuuaaaacuuuuuguuagauggcugaauaggaacagcuccagucuacagcucccagugugagcaacgcagaagaugggugauuucugcauuuccagcugagguacuggguucaucucacugggacuugucggaaagugggugcagcccacagagugugagcugaagcaggguggggcaucgccucacccaggaagugcaagugguuggggaauucccuuuccuagccaagggaagcugugacagaugguaccuggaaaaucgggacacucccagccuaauacugcgcuuuuccaauggucuuagcaaacggcacaccaggagauuauauccugcgccuggcuuggagggucccacgcccacggagccuugcucacugcuagcacaccaguccgagaucgaacuacaagguggcagcgaggcugggggaggggccucugccauugcugaggcuugaguagguaaacaaagaagccgggaaggucgaacugggugguacccaucacagcucaaccaggccugccugccucuguagacgccaccucugugggcagggcguagcugaacaaaaggcagcagaaacuucugcagacuuaaacgucccugucugacagcuuugaagagaguggugguucucccagcauggaguuugagaucugagaauggacagccugccucaucaagugggucccugacccccgaguagccuaacugggagacaccucccaguaggggccuacagacaccucauacagcugggugccccucugagaugaagcuuccagaggaaggaucaggcagcaacauuugcuguuuugcaauauuugcuguuuugcaauauuugcuguucugcagccugcacuggugauacccaggcaaacagggucuggaguggaccuccagcaaacuccaacagaccugcagaugaggguccugacuguuagaaggaaaacuaacaaagagaaaggaauagcaucaacaucaacaaaaaggacauccacaccaaagccccaucuguaggucaccaucaucaaagacuaaagguagauaaaaccacaaagauggggagaaaccagagcagaaaagcugaaaauucuaaaaaucagagcaccucuucuccuccaaaggaacacagcuccucaagagcaauggaacaaggauggacggagaaugacuuugacaagaugacagaaguaggcuuaaaaauaucaguaauaacaaacuucuccaaggaaguuuggaggauguucaaacccaucgcaaagaagcuaaaaaccuugaaaaaagauuagacgaauggcuaacuagaauaaacaguguagagaagaccuuaagugaccugguggagcugaaaaccauggcacgagaacuacgugaugcaugcacaagcuucaguagccaauuugaucaaguggaaguucaagugaaugaaaugaagcgagaagagaaguuuagagaaaaaagaguaaaaaaaaaugaacaaagccuccaagaaauaugagacugugugaaaagaucaaaucuacaucugacugguguaccugaaagugacggggagaauggaaccaaguuggaaaacacucuucaggguauuauccaggagaacuuccccaaccuagcaaggcaggccaacauucaaauucaagaaauacagagaacgccacaaagauacuccucgagaagagcaaccccaagacacauaauugucagauucaccaagguugaaauaaaggaaaaaacguuaaggguagccagagagaaaggucagguuacccacaaagggaagcccaucagccuaauagcggaucucucagcagaaacuuuacaagccagaagagaguaaaggccaauauucaacguucuuaaagaaaagaauuuuuaacccagaauuucauauccagccaaacuaagcuucauaagugaaggagaaauaaaauccuuuacagacaagcaaaugcugagagauuuugucaccaccaggccugcccuacaagagcuccugaaggaagugcuaaacauggaaaggaaaaaccaguaucagccacugcaaaaacaugccaaauuguaaacaccaucgaugcuaggaagaaacugcaucaacuaaugagcaaaauaaccagcuaacaucauaaugacaggaucaaauucacauguaacaauauuaaccuuaaauguaaaugggcuaaaugcuccaauuaaaagacacagacuggcaaguuggauaaagagucaagacccaucagugugcuguauucaggagacccaucucaugugcagagacacacauaggcucaaaauaaagggauggaggaagauccaccaagcaaauggaaaacaaaaaaaggcagggguugcaauccuagucucugauaaaacagacuuuaaaccagcaaggaucaaaagagacaaagaaggccauuacauaaugguaaagggaucaauucaacaagaagagcuaacuauccuaaauauauaugcacccaauacaggagcacccaaauucauaaagcaaguccuuaaagaccuagaaacaaagagacuuagacucccacagaaucauaaugggagauuuuaacaccccacugucaacauuagacagaucaacaagacagaaaguuaacaaggauauccaggacuugaacucagcucugcaccaaguggaccuaauagacaucuacagaacucuccacuacaaaucagcagcauauacauucuucucagcaccacaucauacuuauuccaaaauugaccacauaguuggaaguaaagcacuccucagcaaauguaaaagaacagaaacuauaacaaacucugucucagaccacagugcaaucaaauuagaacucaggauuaagaaacucacucaaaacugcucaacuacauggaaacugaacaaccugcuccugaaugacuacuggguacauaaugaaaugaaggcagaaauaaagauguucuuugaaaccaaugagaacaaagacacaacauaccagaaucucugggacacauucaaagcagugcauagagggaaauuuauagcacuaaaugcccacaagagaaagcagaaaagaucuaaaauugacacucuaacaucacaauuaaaagaacuagagaagcaagagcaaacacauucaaaagcuagcagaaggcaagaaauaacuaagaucagagcagaacugaaggagauagagacacaaaaaacccuucaaaaaaucaaugaauccaggagcugguuuuuugaaaagaucaacaaaauugauagaccgcuagcaagacuaacaaagaagaaaggagagaagaaucaaauagauacaauaaaaaaugauaaaggaguuaucaccacugaucccacagaauuacaaacuaucaucagagaauacuauaaacaccucuaugcaaauaaacuagaaaaucuagaagaaauggauaaauuccuggacauauacacccucccaagacuaaaccaggaagaagucgaaucccugaauagaccaauaacaggcucugaaauugcggcaauaauuaauagccuaccaaccaaaaaaaguccaggaccagauggaugcacagcugaauucuaccagagguacaaagaauagcugguaccauuccuucugaaacuauuccagucaauagaaauacagggaauccucccuaacucauuuuauaaggccagcaucauccugaaaccaaagacuagcagagacacaacaacaacaaaaaagagaauuuuagaccaauaucccugaugaacauucaugcaaaaauccuaaauaaaauacuggcaaacugaauccagcagacaacaaaaagcuuauccaccacaaucaaguuggcuucaucccugggaugcaaggcugcuucaacauaugcaaaucaauaaaccuaauccgucauauaaacagaaccaaagacaaaaaccacaugauuaucucaauagaugcagaaaaggccuucaacaaaauucaacagcccuucaugcuaaaagcucucaguaaacuagguauugaugguaagagcuauuuaugacaaacgcacagccaauaucauacugaaugggcaaaaacuggaagcauucccuuugaaaacuggcacaagacagggaugcccucucucaccacuccuauucaacauaguuuggauguucuggccagggcaaucaggcaggagaaagaaauaaaggguauuuaauuaggaaaagaggaagucaaauugucccuguuugcagaugacaugauuguauauuuagaaaaccccaucaucucagccccaaaucuccuuaagcugaucagcaacuucagcaaagucucaggauacaaaaucaaugugcaaaaaaucacaagcauuccuauacaccaauaagagacaaacagagagccaaaucaugagugaacucccauucacaauugcuucaaagagaauaaaauaccuaggaauccaacuuacaagggaugugaaggaccucuucaaggagaacuacaaaccacugcucaacaaaguaaaagaggacacaaacaaauggaagaacauuccaugcucguggguaggaagaaucaauaucguggaaauggccauacugcccaagguaauuuauagauucaaugccaucccccaucaagcuaccaaugacuuucuucacagaauuggaaaaaacuacuuuaaaguucauauggaaccaaaaaagagcccgcauugccaagacaauccuaagccaaaagaacaaagcuggaggcaucacacuacuugacuucaaacuauacuacaaggcuacaguaaccaaaacagcaugguacugguaccaaaacagagauauagaccaauggaacagaacacagcccucagaaauaauaccacacaucuacaaccaucugaucuuugacaaaccugacaaaaacaagcaauggggaaaggauucccuauuuaauaaauggugcugggaaaacuggcuagccauacguagaaagcugaaauucgaucccuuccuuacaccuuauacaaaaauuaauucaagauggaucaaagacuuaaauguuagacccaaaaccauaaaaacccuagaagaaaaccuaggcaauaccauuaaggacauaggcaugggcaaggacuucaugacuaaaacaccaaaaacaauggcaacaaaagccaaaauugacaaaugggaucuaauuaaacuaaagagcuucugcacagcaaaagaaacuaccaucagagugaacaggcaaccuacagaauaggagaaaauuuuugcaauguacccaucugacaaagggcuaauauccagaguguacaaagaacuuaaacauuuauaagaaaaaaaaucaaacaaccccaucaaaaaaugggcaaagaauaugaauagaaaugucucaaaagaagauauuuaugcagccaacagauacaugaaaaaaugcucaucaccacuggucaucagagaaaugcaaaucaaaaccacaaugagauaccaucucacaccaguuagaauggcaaucauuaaaaagucaggaaacaacaggugcuggagaggauguggagaaauaggaaugcuuuuacgcuguuggugggaguguaaacuaguuaaaccauuguggaagacaguguggcgauuccucaaagaucuagaaguagaaauaccauuugacccagcaaucccauuacuggguauacacccaaaggauuauaaaucaugcugcuauaaagacacaugcacauguauguuuauuguggcgcuauucacaauagcaaagacuuggaaucaacccaaauguccaucaaugauagacuggauuaagaaaauguggcacauauacaccauggaauacuaugcagccauaaaaaaggaugaguucuuguccuuuguagggacauggauaaagauagaaaccaucauuugagcaaacuaucgcaaggacugaaggccaagcaccgcauguucucacucaugagugggaauugaacagugagaacaccuggacacagggcggagaacaucacacacuggggccugucguggggugaggggacgggggaggaauggcauuaagagaaauaccuauuguaaaugacgaguuaaugggugcagcacaccaacauggcacauguauauaugugacaaaccugcacauugugcacauguacccuacaacuuaaaguauaauaaaaaaaaaagagaaaagaaaaaaaaaaacuuuuguugcuuauccgaaauuuaaauuuaacuagguauacucuauuuuaucuggcaaucagguguccugagacucuagcuuccuuuacuucucuggacucccauuuuugucuccucaacucaggaaauucuccaggcucugccugaguucccacucauuguguuguauccuggacacacucucaugccaguaagcugaugccaccguaggggucaacuuuuuuguuuccugacucucagauuguuguccuucguugucagaugcucauuaucuuaaaacauaauuuuucauauauuuuguccuuuuugguuguuucacacuggagagcaaaucuggucucuguuacuccgucuuugguugaaaguggaagucuguauccagaaguuauuguuuauagccaggagccagaacaugguucuaaccagggccaaaaauguguguuugaucccuucauaggugaguguguaguuucuuuauaguuuuuaugcaauuaacuacugaaaaaaauaauucuuugggucauaaaggcgccuggugauuaugaggguuccucacuacugucaggaaauugauuagaaguaaacaucuucuaauaagagaaugggaugggccacugggguuauuaccaaguacaaagcauaaauuggcacauuacauuguauuacauugauugucagaguuugaaccaaaauauagauuuggcugggggucaaaucucggaggcccaaauuguauuuggagucagggccaggaagacaagucugauagagucagggugaucaaacuggggccauagaggaauuuaggaagauguaaauucucuuauuccuuguucaauauucagugauauucuuccuagggggcuuggaaauaaaaauaaaaccauguccucucuuuucucuuugguuucucuuggucuagcuauaugccgcuauccucugggcaugucaggaggccagauuccagaugaggacaucacagcuuccagucaguggucagaguccacagcugccaaauauggaaggugaggaugguuacaucaagaaagcccauguucugggguugggcagauuuccugggcacagauuccugacccuaggggcuggggaaggugguguuauuggcaggaacuguugagaaaugaaggacagacagcaagugggccuguccugcucuguauguuuucagggagagaauuuaggacuuagccacauguacuggucuggcagccccaucucaaccacagaggccccagggccacauuacccacagugaauggguucauugauaggaaguggauuugcuuucccugacuuucucauugugagcugcugcaggaggcaggcaacaguggcaccuaugggaaggugcagauuauguaggacacugggaguuagcauccacuccucuucucagugggucuaugaaacaucacucacugcaaagcaucacucacugccaagcaucaagacacugaggccuccaacaaguucuccaccucucucaaggaucucuuacacagaagggccauccuugccaacagacagaguguggcaguuuccuggggcgauugauuucaggggucuuguacaucaauaaacucccuacugcucuacugguuggacccaauacucuaccuggaaucuuauuauuuugugaaguauugauuuuauuaaaauggaauuacccauaagaaaaugaauccugaugaaccuuuccccuuaauuucuuaguguaugaaagacuagagugaugguagguggaauuggaagggagcaacaaaugaauggguaauaucugugagaaaagggagcaauccaagggagaggaaaagugguagggaguucucaaaguaaacuuuauaauaauuucacaauuuugcucagugguagcucagccugaagguaauaaaaugaaaccagauuauuuacuacuuccuugacaugcucuucccccucauccuccccauguguuucuauggcuccuugcuggucugcaaugcccauccugcugcauugcauaacccacacuggagacccuacuaucccuccucccuauugccauaacuugauguccaagcaaaggguggcuagcuuuguuaggcugaguuugaaagagggaagggaaauaugaaaugacucaugcgggaacagagaguaggaagaguuuuauuucucuuuaugcuucuaaaucaggaugggaagugaaggcuaugugugaucugaaggccucagcucacugucuuucagggucucaugguacuccagggaaagggaucugaccacaaauggguacugugguggcagugaaaacuguggcaagaacccaaaauguuuauaaggacagccugcucucuccccucaguacagggcagcugcuugccugugaaccaguaaacagcucugugguuucaugguugcucccucucuccccaacccucaccucucaaggcuggacucagaagaaggggauggagccuggugcccugagauuccaguggaaccugaugaccugaaggaguuucugcagauugacuugcacacccuccauuuuaucacucugguggggacccaggggcgccaugcaggaggucauggcaucgaguuugcccccauguacaagaucaauuacagucgggauggcacucgcuggaucucuuggcggaaccgucaugggaaacagguaggaagaagagacauccagauccuggauguccaagaccauauuuugacuuaggcuaggagaagaaggguacagguuuucuguguggauauguguguccacagaccaggcaugcccuuguaaaugugugacccagggugagggaggcagggaaggaauaucaaggcuguggggaaagcagaguagaugcauucugcuccucgaauuaagaagagagaguccaucaaaaacgugguggggugaagaaaagugagcaugauuuaauaccaccucuucacucauucucuucucucuccucaggugcuggauggaaauaguaaccccuaugacauuuuccuaaaggacuuggagccgcccauuguagccagauuuguccgguucauuccagucaccgaccacuccaugaauguguguaugagaguggagcuuuacggcugugucuggcuagguaggucacuagcccaggaagccuauagacuuuauuaaaaacuccaacuucugggaaaugaaggcaaucaaaucagaaagggaugggaucaguuacuccuggaauggugaugcccucuugggaagaauagagacagaagcauugcucauuaacccagggcuuagggccccacacugagucaugcauucagagucauuacguugacugccauggaggggcacuccuccaaagucuucccucgguguccagauggaguccugcuggacacgcugugcaagcuuauacccuugaaacucacauaguucccugagguaaugggccugagcaguaggcacucacuuggcuguguuuccuuugcagauggcuuggugucuuacaaugcuccagcugggcagcaguuuguacucccuggagguuccaucauuuaucugaaugauucugucuaugauggagcuguuggauacagguaaauccugggaaacuuuauuagaaugggaaauuggccacuaagaaagaauaauauuuuaucaugucuugggaucaauaaucaaucaaccaaucaguauuuauuuaguucuuguacaaggcauuuggaaauaauuuagaugaaggaauacacaugaccuuuauuuccagggaacuuaaagcccgguuugggaagacaaguuaauuacccagaaaacaaucaauuacacaaaguaauggcuaaaguuugugauauggcucuaaguauaauagccauauuuuugacccucaaaacaggacauguagucugacacaaauauugaccuacuuauggaaacaaagggccagagaauugaaguaauaaguauaauacucugggcaagucaagaagucagaaagaauagaccuuauacauauaaaugcuuugaaauuuguaaaaaggggacuaguaagacuuacaauagacaaggaaaguucuagguuaagaugagaauuguagcagaggaagguagguagaagguagcagaagaaaggaagcagggcugaaggcaagacugaccuggcuauaguagaagcuggaguugagaagaacagaauggaacaauggauaagccugaaguggaucaaaggagugccauggcaaagaagugugaccagauauaguaggaacuuaggguuggguacaggaugcucccaccuauacuguuucacuucaagccuuuaagccuugccauucuucuagcccacacuaacacuuuucucucuaagcuuggucugcaucugcaaagugagccugggagagaauucaguccaucgugaagaccagaccagaugauggagguugacagggcucgagagaaggagauacuagugagucucaggaagggaguguggaauuacagccuucuacuggcuuagguguggagaaugaacuauugcccucuagcugccauccccugggugaagaccugauucauccacucuucuacuccuagucacuuccuuuccaucuucuuaaucacuguucuuuccuuuuugcuuaaacggucuuggcauaauuucgcucagucacaccccaacaggcauguauucaaggcacagaggaaaucagagaucaaccgaauucaguuuaauuuaauaagccuuuguuaaucaacuguuacuauauacaaggaauuuggccaggcauguuagguauucaaagguaauggagucauugauccuaccuuuaaagugcucacaauuuggaguaggggcuaaaacagaauauaaguuacuaugauucaaguauaugagcaagagauagccuaugacugcucugggguucaaaggaaaaaguaaacuauaguaggaaagcacaaaaauggggaugaaaacaucuggauuucauauaauaaaaguuacuucuguuugcuacaaggcuuaagggauuaaaaugugugugaaaagcauuucguaagauaaauugcuaugcacauauaaguuguuaucugauuaucauuuuucugacugaaggaccaguaaagauaugguagaacagaugaaaucugaacugggucccaaagaauggguaguacuuucacaggugcagaaucuugaaauggaauuuuaggcagagggaauaauagcaugaggaaaaaagaaucaugguuauaaaguuuaggggacugucugggagaaaucaacaguuuauuuaaccacgggccauauuuauguggcaaaguagugcaggagaagcaaaacaaagcagauuaugccauauuuugaaggaaccugaagucaaagccaaaaggagcaagaaguggaggaggaggaagaggagaaauugcuguucuuauucuucauaaacauuaucauuaauguaaugagucauugaagauuuuuaaagcugaggaaggacaugauuggagcugugcuuuagacagauuaaucaagcagcaugcaaagguuagauuggaauggaaugaggaggcuaugaggaacauuuuaaaacucuuaguucugccaaguaaaaagaauuaaugaccaaggccauaaccgugacuguggggaaugaggaaaagauauucauuuaggauguuugaaaucugauuggauguaugaggcaaaacaguagggugagaaaaagggucagaugaaguuugacagucuaagugacugaaacaauggggaugacauuuauuuauucgacaaauauauuuugagugcuuaccuugcgccaagcauuuuccauuacuaugaagagaaguauaauuuauggaaaagggaaaccaaggagaaagacuuaguucaguaggggaugaugauggauuuaguuuggaguguaggucugugagacugagaagacauucaguagagaaauaaggaagguagccggaauuauggcucuuaacuccaggggaaagauaaaaaaaauuacaaaaauguagacaucauuggcuuucauuuaauaauugaaguaaugaaauaucugguggagguggcugagugaagagauccucucagccacugagagaugacaucagagucucaggaaauagucauauuagcaaaaguuacuuuuuaaauuuaaaacaauuucaagaauaauauaugcuuacuggugauuuuaauaacucuaaaguauauaaauauugaacauuuauuuucuuaucccuucuucacuugauuuaauuuugaccaagggggaacugaacaggcauuccuuuuaauuucuguugcuuuucauaaaacuuuccugggauuuauuuuucugaggauaaugggaaauauauuuauugcaaguaaacuuacguucuccuagcuuucugaucuguagagagaagaaaaagauggcaaaaccuuggaagggagauccaggcucuggucacuguggauaaggccagucaaauuuuauaauuuaccaaacauuuucaaugauuaaauauauuuuaaaaggcuggcauaaucacccuuaguauuuuuuuauuuuuugcgauucacaaauuuuacauauuauugaucuagcucuaaaccucaagggucacaccaauuauugcuugagggugaguaucccaaucucgucauuugggaaauuugugucauaucugccagagcuugagaugcagagcuugaggaaagagaaguuccacaugaugguuuuugcucugucccuccauaaaaagaaggaaggagccucuucguguucucuaaguagucaaauaagcauacaugcaguuauauuccauccagcagucaggcuucuggaaaacucagccuuuaaaacagagccucuuacucagaagucaaaaaagccugcuaagcuagaacacaaaacuaaauccaauaccugggauucucaugaaauccuugcaucuuacuuccugggucuaguauccuacaaauuuaauuagaauuaaauagaaauuauuauuuaaauuuagagcuuguauuuucccccuuaguuuaauaucaaacuggguuguuggauauguggaauagaagagagugugacuggauucucugaaauugauucacugaacaaugacaauauguaguuaaaggagagucagcaccaagcucuggaaacauuuauaugauaguggggcaagugcuacuauguaugguagcauucauucuaugcauuuauccauuuccucauuuacucuaugaauuaguucaucaaaugcauuugauaauauuaagucauuaugugaagacauauucaguauauaagaauaggcaaggugcaauaaauuauagaaagcuuuucauauuaaauaagacauuguuuaaaaguuuuacuacuaaaggaguaagcaucaaauauuuuauaaaaauuacuaauaugaaauucuuaguucuccauugaugcaagauaaacgagucaauacuauaaugcaaaucugauuauuuacaauccuucaauuccaagauaauaagcucauacaaaaucuggagugaagaugccggguaaaagcucuuccacgaaugugugguuaacucagauuucucucuccuuuuccuccucuucuccuggccugagcagcaugacagaagggcuaggccaauugaccgauggugugucuggccuggacgauuucacccagacccaugaauaccacguguggcccggcuaugacuaugugggcuggcggaacgagagugccaccaauggcuacauugagaucauguuugaauuugaccgcaucaggaauuucacuaccaugaaggucaguggggucgggugugguggaacuucuuuaaggaggcacaaaucauagugugguagagaaaaggcaugcuagaaaaaagucuaggcugaugccaguucaaugacauauucuguuacuaacuagcuaaaugcauuucacaagucacuucaucucuaagggcgugauucuccauuuguguguaagggaguuagaauaggucagugagcucucuuuuuuuuguuguuuugacacuaaaggugacauauccauuaagccaauaacacaguguccagggcccacagauuuuuaagacgcauaaaaaugcucuaauuucuuuuaauaucaggugaaaaaaauaaauuuuuagggucaaagauuaucuuuuuaccagcacaguuguguguguguguguguguguguauacacacacaacuauauauauauacacaaugauauauauauauacacaacuacauauauauaaccauauauacauauacaacuauauauauacauauacaacuauauauguauauacauauacaacuauauauauguauauacauauacaacuagauauauguauauacauauacaacuagauauauguauauacauauacaacuagauauauguauauacauauacaacuagauauauauauguaguugguguucugcagucuucugaauuuuuccuucuaggaaccucacaguggcagugauaguuggucaggccuuauaaaaccugggcugcaacccugguuaccuguaugcacugucugcccuuggccaccucacuucauguugcuggacugcaguuuucucaucuguuaaaugaggacugcaccagcaucuucucagcccuuccuugccuugaacucucucgagucuauaauccucucagccgcaguugccgucuacccugauucguguguguaucuauacacauagauacauacacacauaugugagaauauguguauucucauuuagaaaugagauuucuaaaaaaaaaaaugaaauuguuuuagauuguacacuauuuuggguuucucaccuagcccugugaaaagaagaagacuggcucugaaauguaccuaggaggaagcaggauggcagucuuccucuuaccucaguucagaauagcucgaaucaggguagacggcaacuacugaguuggcuggcacugugucuccaugcaccuuagcagggccaaccuaucacucacaugccucuuucucuaccagguccacugcaacaacauguuugcuaaaggugugaagaucuuuaaggagguacagugcuacuuccgcucugaagccagugagugggaaccuaaugccauuuccuucccccuuguccuggaugacgucaaccccagugcucgguuugucacggugccucuccaccaccgaauggccagugccaucaagugucaauaccauuuugcagauaccuggaugauguucagugagaucaccuuccaaucagguagggagcucagguccucuuugggaagugggagcaaggugaugaaggaggaaugcacaugcccagaacuucucauuagcaggucucugagaggagugggauuguacaggcagcuucucauugacggauacggugaauccuuugugugacuaguuuuaacuguggaggggaugggaugagaauggaagugaacaaaauaugcacguaacucuucuuagaaagaauguuuuuaaaugagaguacaguguguuaaaaauuuuauauaauuuaagguaguuaacgagugcgcuguuaaggaaaagcacaccuaagcauuacugagauauuuaaaugaaaauuucuaaauauacacaaaaguaaagagaacaauaaaccacucaucacucagcuuuacuaaucauugauauuuugccauauuuguuucacccauuccuuccuuuuggcuguagcauuuuaaagcaaauaugagauacuacuugauuucauuagcaaauaauuggacugcaucuaagaaaauagcaucauuuucauagguauaaugccaugauaacaucuaacaaccuuuauuauuaaauaauuucuuaauaccacccaauauccuguccauauucaaguaugacuaacuguccaucaaugucuuaauucaguugacuuuaucaaauaaggaucaaaauaaggaucuguuggugaguuucuuuauucuauuugcucugugucucuuuuaaucuaaaaaauuccuuccauuuuuauuucuuuuuaaauggauucuggcuuggcugauggcuuucuguggugucauuuuacuugagcuucuguucucugucauuccuaaugacuggugcuuacaucuacagguuaauuugauuccaguucaauauuuauuuuugucaagaauucuuuauaagcauucuauauaucucaguaaugcuguauauuuuaugcugaacuucaucauggggauguaaugcuagauccucucacuuuuugugauacuaagauugauuucugguuccucaugaacuuuuucccuaaguuuuauccuccaucaauaaccacugucugaauuauuuauuucacuaggguugcuaaaugacgauuuucuaauucuuuuauuuuuucugcauuucuuagcugaauuucuuccgaauagaguaacuauucuucaucaugcaccaguuuacucagaaaucacauugaaagagcagcauacgugacuuaucuuccccuuuaauuguuaauuuucagaguaaugacuugauaccguagcaacccucaauaaugucuaauuaauuuugguuuuuacccuuauuuuuuugguaucauuauaaacucauugcuuuuuaucaauuuaaugcuuaaucgauugcaguuauuauuauuaguaguaguauguuuauuuuuagacagagucucgcucugucacccaggcuggaaugcaguggugugaucuuggcucacugcaacccccgccucccgggaucgagugauucuucugccucagccucccaaguagcugggauuacaggugccugccacugcgccuggcuaguuuuucuauguuuaguagagauaggguuucgccauguuggccaggcuggucucgaacuccugaccucaagugauccgccugccuuggccucccaaagugcugggauuacaggcaugagccaccgugucuggccauuauucuuuuuaauacucaaguugugcugucuuugacuagaguuugcauuuuuuuuuuuuugagacgguaucuugcucuguugcccaggcuggaguacuaucuugagucauugcaaccuccaccucccagguucaagugauucuccugccucagcuucccaaauagcugggauuacaggugccugcuaccacgcccggcuuuuuuuuuuuuuuuuuuuuuuuuuuuuuuuuuugcauuuuuaguaaagacgggguuucaccaugcuggccaggcuggucucgaacucccaaccucaggcgauccagccgccuaggccucccaaagugcugggauuacagaugugagccacugcacccagccuagaguuugcauuuuuaagggggcucuuugcucuuuugaucugacccuagaagccuuugauaacuuucuuguuuuccgaaagaacaagguauuucaagcucauuuugaacauguacagcacccgacguggaaucaaccauuucaagaaaucuugauuccuuuuaguaggaaaugguauuuagaaaacacaaacuggguaguagggaugcucauuacuaauagguugucauuguuucuuggauuuuucgguggaagaaagcaaugaaauauguauauuuaaaaagaaagauugugaguuuacauuguuacuuccaauucaaauuaaagauaagguuuuuauuuaaaguugauuuuauacguucaucucuauuauuuaugcuaaauaucauguuuccuaacaauguuaacagcauuuucuucauccuauuauucaaaaagcaauaccaauauuauuacuagcaacguaacuauugaacauuaagauuucuuagcaauucucuuuucuuuguccugagaauauauccuacuaagaaugugcagucaaagcacuauguucuaaggucaguuggguaacagugggauaauucuuuucuguauauaguuauaucaccagugugguauacaguuaggguaacagugggauaauucuuuucuguauguaguuaugucaccaaugugauauacaguuagguucauuguauuccauuuguuucaaccuuuagggauuccuuuuaaacuuuaaacacuacuuuugauugaacaguaacugcagcaaauagugauuuaacuuacuacagccagaaacugugccaaaucuugaaaaguuaaaagguguuuagaacauuguucauaccauuaaauuuaaaugggaagaugaaagauacagaaugcuuuaaaaaaaaaaaaaaaaaaagaaauguccaaagcaauaugaacaauaaauggucaggaggagagaggcacuagcguggguuugucauagacagcaucaaaggaaugagacuuguacugggccuggaagaaaaguccagguguaaaauaacauaaaagagaggaagagacuaauuuaaagauaaaccacacuuugggaggccaaggcaggaggauugcuuguauucaagaguuugagacuagccuaggcaacauggcgaaauccugucucuauaaaaaacacaaaaauuagcugggugugguggcacgugcuugcagucccagcuacuugggaggcugaggugggaggaucaccugagcccuggaggcagagcuugcagugggucgagauugcaccacugcacuccagccugggugacagagugagacccuguuuaaaaaaaaaaaaaaagaaagaaaagaaaaauaaaucagaagaacccauccuuucagauuugauuuuuaagggaaaaaaauuucaagaugguuugcuuauuaagauguacugauaagaaaauagagcauauuuuuaggaaaacagguuugguguuuaaaugccuucugugcuaaugauuuaaucuaagaguaaguugauugauuguuucaucugaauacugagaguagaaaucaagaugcucaaagucagugccacuuacacuguaaguguuaacugggggacaaauagauucccacccauccucagggauucuccuggcauaguaacugguacacuuauuauagcuaauuauagcuaugaaccaugguuuuuacuccuggggucucuugagcuuuaaauccaaugcauaauaauauuaguuuucaccggagccugacagccgaacuccgaaagcacaugcagaggccagauaccuccuuauuuauauaauaauauuaagaagaagaaaaauuaggauaccuggaagaaaugucucuuagaaaggaaauacauauucuaauucuugacccccuugauuagacaaaucagagggaaaaacucuggcaaagcugccaacaucaaucuggcaaauacgcuuuugugguuuagucucaaaagcuguaaaaucacagaaaaagacacuccaaugucaguaaauaucuauaaagauuaagccuuaauucauaaauugaagggcuaggccgaugaggcauaguggagacucuuuuauaaacaaucuaauauccuugaaggaaaaagcaucuuaacacuaugucugucccuugcccauuuacccgcuauauucugucuauauuuucacugaauuuggguccugcuucuuaugcuuuaugacaaugugugguacagcccuuugaaucacuguuucuuaaacuuuuuuguaccauagcaucuaguauguaauaugugaaacaaaaauuuuacaaaggaaaacuugcuuuuacuauuuagauaaauggugauuuuuuauucaacguauuuaugauuuuaucuuuuuaaaagacugaugacaacucacuaaauugaucuuguaaugugcuaggucacaauaugccuucagagaaaacacuagcugucugucuucucccuggcucugacucacccuuguuuuauaacagaugcugcaauguacaacaacucugaagcccugcccaccucuccuauggcacccacaaccuaugguauaugugauuccuaauuacacaaauuaauuugaagggacuuacugggggaugaagaaggguggagaguugcaaagcccuggcugugugggaggcuuuacaccaguuggcuuuggaugaagaguagcccuggaaagguaggacugucuaccuccaaguuauggauccaaauauacucucuucacuauggauucaugugcuucuucagcugaggcagagucuggaguuguccuaauuucuccaugaaaguuugggaauuuggggucagaaacagggaaagggacauuccugggucagacccauaguggguauuucuaaggagggguggaaaucaaagaaacaaaaugcugauaucuccaauuggagauaaauaugccauguaugcauugcuuuaggcagucauuggugacacuagccagcaaugugggaaacaugugggauugaauguguccaaagaggacuuucagcuaccuuggcaugucucaaagaaugcagagagugaaacugguuccucaccuguuuuucaugaggugugauuaagggacuacagacucaggccauaauaauacagagacaaaauuuugggaagaauagaaaaacucaccauuacucugucugacacauggagagggggagacuacugucuuauggaagagggaaauaggauaggggaacaaaguaauaaacagauugggcgugguggcucacaccuguaaucccagcacuuugggaggcagaggcaggcagaucaugaggucaggaguucgagaccagacuggccaacauggagaaaccccaucucuacuaaagauacaaaaauuagccgggcguaguggcgcaugccuguaaucccagcuacucaggaggcugaggcagaauugcuugaaccugggagggggagguuucagugagccaagaucaugccauugcacuccauccugagggacagaacaagacucuaucucaggaaaaaaaaaaaguaauaaaacaguagcaagaaaacaaaacaguagcaagagcaagaauaagcagaaguauuaagguggcaucuuccauaauuauccucaaggaacagggucuaccuccauguuuccaguucagucccucauacuuuuacuugaccugugagaugauuguauucucugccuucucucccuggucacagauccaaugcuuaaaguugaugacagcaacacucggauccugauuggcugcuugguggccaucaucuuuauccuccuggccaucauugucaucauccucuggaggcaguucuggcagaaaaugcuggagaaggugaggaggugcagaauggucaugauauaagaaacugcuccuuucuuucuuaagccacuguugucccaggaguaaaaggcaaauugcaaacauuuauuaaugguuggaauuaacugaggcuaccaagaaacauaggaaugaagccagaauagaauuagcuaagucuauuuucucauuuuuagaguggagauguuggaaccuuccuaacguuccucggaaaugcagaaaacucuucuuaauacauugaaucuccauucaggcauuuuccuugaagauucugauucacuggauuuuggguagaguccaggcauccauauuuaaaaaaaaauuuaacaagugcuucugaugcacauucgagguuaagaauuacucuccuaaugccaagcugaaauuucugauaaugcuguugaaguuccuucucaucuuuuucacuuugcuugucuguuugguguguguguguguguguguguguguagaaaaacauccagcuucauuaauauucaagccaaguuucucacuauucuauuucuacuuuuguguacuugaagguugugauuauguaucccucugagucccucuucagacucugucuaugccaaaugaucugaauaacuuuuuacauugucuaacacuuuacaggaagcagaauuuuuccucaugcauaauuuuauauacaccucauugaguaauaacucauaggcauuguuauguuuaacuauuuuucugaugagaaaaugugaugugcuuaaggucauacaacugauguccagucuucuaugcuuuuuccaauuguuaauauugaaaugcauugauuucuuucuucaaaacuauauucauuucaucaaagauggaauaucuaugacuugucuugguuucuuggaccaaauagcaacucccuuggaccaaauagcaacucacugcugcuuagugucugauucuuuuggggccugcugacgacuaaguguuucugccuuuggccaugaucaccucuccuggucaauuaguuccucucaauagacauggacuaguagaggccacaggaacucugagcuguggggcuuugaacugccuccugagggcagggaauaggaaggaggagaaauccugauugauuucuguguuuggggguggggacucagaggagaccaaugccuguguggaaccucuauuccagaggagaggaaagggcaccaugagaaugggcuugagucucuagagcuuucuagaugcaggaugggagaaaaauggcucaaaucagggguaaggaggagcaauccugaugaguagccugcaauuccuucugaucugugccacccucagguuccugagaugguugauguuuguuuuaagguuuuuaggaaggaauauuucauggaagagaaggucuccuugcuucccacaaguaugucuaccagucugaaaacacuuaaagcuuucaauucgcaaauagcaacagaagacugaaauacagaauccacagagacucacucgcugucacgaguaugucucaaggcaugaaugaggcaaauaucaaaauuuuuccuccuuuagaaugcuggaaaacacuaguguuuaaugagguauuccagagugagggugguggugaacugaagguucauugaacugcuugaagaggauaugugaccuucuuaaauagucuguuaggaccacauuuuagccaagggggaaagucuguguucucugcuauaugagcucuuuuucucuuuauuugagccacaauuuaccauacuucucugagucuuuauucugaggccuguuggaauaucuucaugggcuaagagagaaauguuggaaucuccagguaaaagguagagcaaacauuuugcccuugaauauuuaacuugguccuccaagaaauucuaccccuguacauccugaguaagaugacucaaggugcucuggaaugacacccaguguuucuuccugggaacaaaauuuuauguggaaaaucauuaaguacacacauacauucuaagaacauuacuuaacauagcuguagacuguauguagcauuauuuguaggauaauuuuggugguguccucaacauuccuucuuugagagauuuaacccacauauauugaguaccuacuuuguucugagcuucaugcuuaguacuggggauauuacugcaacaaaagaccuucagucuaguggaaaagugcacaucuaaguuucgccauugagcaccaaagcuguguuuguuggaguggagcauuuuacauguuuaaacccaaauagucacauacaugcaaaugcuggcauuugccuuuugauggagcaggcagguuauauuagauaagauaccacagaaguaguugcuuuguuguucucccucccuuauuagguguaagucacauuguuaucucuggacacccagggcuuuccugucccauguuguagccauuuuauuuuugguuagugaaaauaugggucagugguggguauuauccuaaucuaggguaucaaaaugaucaaguagaacuacugauucaucauguuauagcacaugcauuaaguuaauaaacaauuuaugucuauuccaaaaccaaguaguuaaaggguaagccaggaaaacccaucauuuaauaaaacauagaaaacucuauaagauugagaucuuuggcuacugauggguucuuauagcaacagggagauaaucuuuuuuuuuuaaguguuucagaaagcacaucauagaaauuagaagaucaaauucuaccuugaagaaaugaaggauuauucuaaguuccuacaacacaggcauuuguggaaccagacugcauuccuagcacgugcaguguugcugggguuaaacaguaguaaagaguuauuucauuugagugggagagcugaguuuaagaagaggaggcauugaccaucucuuuugugccaacaugccuuucuccuugcucuucucuuccaggcuucucggaggaugcuggaugaugaaaugacagucagccuuucccugccaagugauucuagcauguucaacaauaaccgcuccucaucaccuagugaacaaggguccaacucgacuuacgaucgcaucuuuccccuucgcccugacuaccaggagccauccaggcugauacgaaaacucccagaauuugcuccaggggaggaggagucaggugaggaugauguggugggcagggugucaagggagaaaccucagcaagcaucagguagguaugacacgccugcucccaguucauugcaucuauuuuuagucucugcuaaccuccugagaaguccacauucucuuucuagauuuggucugccgcugcuccuggccuaauuugagcaacucuccuuugcuacugaauauaagauguguggagggacccacauaccagaaaagaaagaaaaaaauaauaaaacaugugaauuagguguugacaccagaagaaccuaaacaguccaaccagucuaaccucauuuuacaugucgggaaagugagaaaguccagauagaguacucacccaacaccaaauuucaugaguggguaaaggcaggacuagauuuuuaccuggagaaauaaauaaauaaaugaagcuaaagacauuccaaaauucccagugguguagccauuuaaauaacuaaaauaaauaacuacuugaguuaucuauuuuuugugaauuucucuuugguaaacguuuauuagaguaauaugagauuuuauuaugagaguaaaacauuucucaccuuuucucaauaaaagcauugaaauaaaacaauaaaacagguaaaacaguaaguagugucaguugauucaaauuucgaugucuuucaaaaaaugaugcagagucauaucagaagggaagcuggagucaccucuuuagcucagagcaacuuuucuauaagaucaucaaccugagggacccgagucaguagaaaagaacuuguaguguucaggagagaggagcuaggccugagcuggauguagaagcagacaggacuaaauucaagagcauaggauuuuauaggaaggagccugaaggggucuuuucaaaggauaaaaggaaacuugcaucuauuuuauuauucaauggauagaagacaugaaagagcaugcuaaauucaaguaauuucacagagacagcaagaauaaaggauauaaacuaauuuauuucuuggggugaauggaaguaauuuaccuauuuccuaagucuaaaacaucccccacuucauauuuuaaggcuuuuuuaaguuagaauaugucuuaagcuagaucauaugucuuuaaucugaaaguuuuuuauaccuaaaaucaguuuuuaagucaauaacagugucuuaaaauuaaggaaauaaguuauuaaaccuucaaccuuuaauauucccacccugauauaccaugagccuuccuauagcuucaccacacaauuccacaaguuuagccacagaauuuguuaaugaucauguauuaugaggaaaagaaugagaaauaaaaugauguucuacauucuguaggccacaagaaaaucucuagaggaagcaaaaccauuuuccaaguaagaaugucaugaagcagguuaggcuuucacaggggcauguuuuagcccuccucucagaguuccuuccugaagagaucuccaaagacacuccacggaaugagggcucguugcccuugucuucccaggcugcagcgguguugugaagccaguccagcccaguggcccugagggggugccccacuaugcagaggcugacauagugaaccuccaaggagugacaggaggcaacacauacucagugccugccgucaccauggaccugcucucaggaaaagauguggcuguggaggaguuccccaggaaacuccuaacuuucaaagagaagcugggagaaggacaguuuggggaggugaguugauucuuugauucccuuauagcucgaagaaggugguuggauaaaaaugaucaguagaacaaagagucccuuccagagguggauucacaacagaaugucucuuccauuugucucuccuugcauuguccucuggauuucaguauugggucaaccuaaucuuugucaaauagcuguggaguuccugggacuucugauuucuauauaggaguuuuuaaggcaggcaagucacuagacuucagauaucuugaaaaacauucaauauuuucaaaaauguuuacaauagauuauggagggugggauccagaagaugugaucaucuuuuaugaacuguccaggaacauucugcuacucaauagccacuuuguuuuuuuccccuuuaaugggaguuauauguaaaauggucaaaaacaaccucgccccugccuuuggucccagaaucagccacuagggaaugaaucaccaacuaagauaaggaggaguacucuuuucauuugcccucagagugaugcaugcauuauuaaacuuuucauucuugcaucagucacaugaaccuucugggagcucaaagcaauguuuugaauucuaauaggaacucuucaccacugccgucuaaacuccaaauaaaacauuugguuuccuaagacauguuauugguuuucaguguggaucucauguucucuccuuagauaggucugguguugcaagagguugagggacccauguuaucuguucauggugugacauguacucauucuguccccuggguugaaaacccacaucuguuauacuguuacuaauagacaggaguuucuuauaaugcuaaacccuauacuaagggauuauuuuaggaaauugccuuacguuuuacaugauccagugacuaaugaaucgaaguucaagcauuuguaauaaaagacauuuuauauugggcuaugcuguaauauaauauuguuauugauucauucauucacuuaguguuccaagcaauguguauuucuaaggcaggagaguggcacauuagcuggguacuuuaccauuguuuuaaaucuuaucaauuauuugaaucauagauauguuacacauaucuucuuauuggucuuuugaucauuuugccugaguuguaagaguuaguuuaucuccaggaaaugcccagcaagaguacugagacaucuucaggagaaaugaugaugcugagacuagaugacuuuugucuagguucaucucugugaaguggagggaauggaaaaauucaaagacaaagauuuugcccuagaugucagugccaaccagccuguccugguggcugugaaaaugcuccgagcagaugccaacaagaaugccaggucuguggucuacauuuugaauuuuccuuuagguauuucaucuuuaggaccaggaauacuccuggauacuucugagcaauuuuuucuuuugagaugggaaggucagugagcugccucccauuuccacuguuauccuuuuucuuauuccgauggggucggcaguccucaucuuuuucuccaccucucucaaacacaaagguacauuuuccauuguacuugccacauauuuacuuccuaacccccugugcacaagcacuguacuuguucccaacauauacaacugucuaaauguguacuucuuuggucuuuauacacagacauacuccugcaugucauuaccuccucuugacaaagucuucagaaucacacaugacuuucuugcuaagccucuuccagucuccuuuuuucacauuucuauuuauuuucucaucccuuuuuucucuuuuaugcuccuuuucuucuauuugagcaacccucaaaaugagaagcuaccucuauuuggaaaauuaucuaugaaccucaaagcaaaaggauccacaguucucuagcaguuuuccaaacuggcuaauaaucucuuggaucuuuuucuacauaaauugcaguuuccagccacacuucauugucugacagccuuuccauuacaauaauggugaguuaauccucacccagagagacaagcugguugaaagcuggcuguaugugucccagagaaaucuccacaccuggauaacauaugcauuuucccauuuguguugucuugauuugucucacugauauucauagugaaaaaaaguuuauuauucuuauuuuccaaauuaucauaaauuccaagaauggugauagacuucauuaaaagucuugcaauggacaagauguaagauaaagaagagagaaaggugaggaaaugaaacuggaggcuuuagaaauuuaacugauaauuucaaucuuuaagauacugguaagaauaaaaagugacauucucugggucuuauagagagacgaaguauuucuuauauuaaucuuagcacaugauuggagaaaguggcaugaggggaaacaaaaccaaaccaaaccacaggacauaggauaugacaaagccuuucuccguuguuccgaucggugaaguuugccauuccuccaccuguguccuuagcaaugauggauggccaugacugcaaacccucccaagccauggaaaccccugguuugagacggaagggggaaugaaagaggggagguguugcaucaggacggcauugauuccagugguuuauauugacguaguaugacuuccaguccaggauuccuagcaaacucuuggagggcuuauaacucaucugcuccaacaguuuugggaaugugggcuagaggccucacuaacaaaaucuugcuacuuuaugacccaagggugucugucaccauguacucaaacaauuauuagucuuggucaaaugaauacuucuuuugacaugauuaccaccacagccuuuaaagagcucuguuuucgacaggcuacuaaauacauguugcaacugacugaugguucguacugcauuaagaaaagucaguaugagaaaauaaagaguaaucagauaagccaaagaugguuguucacaucauacaaaguuucuucacuaguaauagagugacuccauggcuuuaaaaaaaaaaagguaaauauccucgugcacuuaagauaugauuuucagugaaacauuuuacucuguagagugguuuuuagcagccuauuuuugauucagcaaauauuaaucacuuucuguguggcagggauuuuguuagaugugagggauagaaaugugaauaagucauggaucuuguucucaaaaacauuacaauugaauaagggcccaugauauuucaggaggaauagaaugagacagauccaggugucaauuucucuguccucucaaaaguuauccaaagggaaacaagauuuggcauaauguccaggaauaggccuuggugugcauucuucucucucuugauucugacucuggcaacuucugaguuuaucuaugucuguauccucccaaggaaugauuuucuuaaggagauaaagaucaugucucggcucaaggacccaaacaucauccaucuauuagcuguguguaucacugaugacccucucuguaugaucacugaauacauggagaauggagaucucaaucaguuucuuucccgccacgagcccccuaauucuuccuccagcgauguacgcacugucagguaaacaagccaggucuuccuucuccucccuguggucaugagaguaaccugggaucugaaaauagggagcagugagccuuaaaguguaucaauguucugggauggugggggaagucagugugcagggaauaauggagcagcugcccuuuggggaaacgcaagggauucaucaagaguagagaaagaauguugagcuuucaacccuaguuuguugauaccauuuuagaauguguaccuuucacaucuuccuguuuccauaggcuaccuucugucuucuugucuauuuccucaguuacaccaaucugaaguuuauggcuacccaaauugccucuggcaugaaguaccuuuccucucuuaauuuuguucaccgagaucuggccacacgaaacuguuuaguggguaagaacuacacaaucaagauagcugacuuuggaaugagcaggaaccuguacaguggugacuauuaccggauccagggccgggcagugcucccuauccgcuggaugucuugggagaguaucuugcugguaaguucucagcauuuuaaagcccugucuaacaacuggcuugugggcucacaugcaugacacguggagacaaaccugagacagcaggaggcaaacucaauagacuguaguauuuucucugauuugaaauuauuuucuuuguguacuaauucuuauuauuuaaugcuugccuauuucugcuaaaaaauuaacacacauaaaaauuuagggagagaaguuaaaaaguauaagagauuuauuaucuuuguuucucuuuaucauuucuaccuagugauuguucuuaauuuaagauauuaaaaaccuuaucauuuaaagaaauguuaccuauacaaaauauuuucuucuccauuaguuucauaagcauguuucucauaauuacauagacuaauuccuauaauuguauuucaauacuuuucaacauguucuuuuuaaguucaucauucuuugcuuuauaauuuuuauuugauucuugauauuccauaccauaagugaguaauuuuucccaaauaucucuauuagagguauauuuucuguccaugcauaccugagacuuuuuauuguugauuuuauaaccacucagcugauuuauagacucauuagacuauacacuuuuacuuccuacaaugccauguacauguuauuuuaucuuuuuucuugugugacauugcagagaaaagucugagaccaauuugguuuuguucauuuaugauuaaucugcuuauuuccugcuaauauucuuauaggauuuguaaauuaauuuugaaauaaaaaauguauaguuauucccuugcacucaccaggauaaccacuaucaauacuuugguauauuuucuuagaggauuuuuuucuauacauauauuuuuucuaugcaugcaauuuuuuuucugugcaugcauuuauauacauauguacauauauguaauuuauauuacauaauugggaugacacuaugccauacaauucucuaucucuauuuuuaacuuaacauuuuauuaucugcauaauauuccauguguagauauauacuauaacuuaauaaugccucuauaauuugauauuuaaguacuuuccaauuuccugcuauuaugaaugaugcugugauguacaccaguuuacauaaauccuuauaaagaucuuuuucaccuauauaugugaauugcuauauuuuacccauuucuaaugggauaguuaggcauuacucucccuaaagguauuauaugguguucaaaacaauauauuagacugacauucagaggaccuugguucaaauccaguuuuuccacuacuaauggucuuauuaaccagaagaauuugggaaaccucuccuguuucauuuuucugaucuaaaaaauaaggauaacuggcauggugguauguaccuguagucccagcuacucaggaggcugaggcaggaggaugaaaaucugggcugcgcugcgcuaugacaauuggguguccucacuaagucuggcauuaauauggucaccccuaggagcaguggaccaccagguugccuaaagagggaugagccagcccaggucagaaacagaggaggucaaaacucccguguugaucaguaaugagaucaaacgugugacuggccauugcacuccaggcugggcaacauaaugagaccccauuucucaaaggaaaaaauauuuaauaauaaauaauaucauccacuucacagugugguugucuguauugaguagaaaaugugaguagucaaugcaugcuauuuacaccugaaucucauugcugucacuuguuaaagucuaucuuucaacacugugauuaucacugaacugguaaaugagaguccuggauucacugcaggcacuuaaacuagauuccucuaucucuaacauaaaaaccauugacuucccauucagauuuugccuuucucaggagcauuuucccaaggcuacccuagaguugaaagguugaccuaacacucaguugcagagucaaauagcuuauggcugcguuuuuuucagcucuuggaucucauccccagagaaacagaaccaagcugagaucaugagaaugaaagaaugggcuguuucuaaauacuccaugcacaucuuggcauuuucagaauuccuugccuguggugggggaagggguauagcugcagauuaugaaauuuaacaggguguuguugugcacagguuauucugauuucccauucuuuucuuuacuuaaauagggcaaguucacuacagcaagugaugugugggccuuugggguuacuuugugggagacuuucaccuuuugucaagaacagcccuauucccagcugucagaugaacagguuauugagaauacuggagaguucuuccgagaccaagggaggcagguaagaacuguuggggaugaauggauguggaccuguguaccuugaaggauggagaauggcaaguccugccuuagcaggagugggccgagauggaagacagacuauccagguguuagucuuugucacuaacuauccagaugaugugaaagaccaguauccuccccaggcauccauacacuuugcuuuaucuaugugucaacucauugacucuuggagagcauaaagggucaugucagguuucuccccagcucaaagguagcaggaaacaaaguccuaucucucaugauuuaucuauuucuugaucuagaccaugugguuuuucuucugggucaaaaaauaaaaguguaaaagggauguauuagcauucauuaaaaauauagcuuaguauaagaaaugggguugguuuugacuaucuagcaauguuucuagacuuggaugucugaaaaugggcagauauauccuaaacuuguugcucuuggaaggcaucucugggcccaguauugugacaucucaggacucagggaaagaugaguucccaagcuccccaggagucucaauuccuagccaagauacuccaagcuuuuuuuuggguggcuuagauuuaaaauuccugugagaucuggaauuuaaagcuugccaguaacuacagcaccgcacuuccccaaaggggccuggcaacagcauacccuuggauuaugguaucuuuaccaggaaaaggauaauagcugggggaaggaucuugcagacaauaaaaaguggaucuucuguggcuugaacagauccaagcaagccaaagauagauaagguauugacaagagauaauacauuaugcauauuaaaaauaagagaggggucugagaauuuaauuguaucuugauacucuguaaauauuuuggcagcagggagucuaaauuagcuaucuugguuaugaggcaauuugccuucuuacuauagucaaaggaaaauuuacuccugaguacaugagauaagugagugggccaaagaaaaauguuguuuucugccucugccaugaucggcucagccaagaugaacuucaauauggguugcccauaaauggaagauuuggucucuuuuugguuguuucaucuuuugcaugaagguagggaccacauaauggcccaucaaaaaauucugcugcagacaacugcagaagacaaauggaacagcuuagaaaagggcugauaugauucagaacuuucacgaguaggaaaaauggacacuacacccauuucaguuaucaaguucaagaaagugggcagggggcaaaucaaaccaugaugcaaagauacuucccuuucccccgucuuuguaauauucucucucucucucucuuuuguuuuccuuuauuuuuguucccaaagacuuaccucccucaaccagccauuuguccugacucuguguauaagcugaugcucagcugcuggagaagagauacgaagaaccgucccucauuccaagaaauccaccuucugcuccuucaacaaggcgacgagugaugcugucagugccuggccauguuccuacggcucagguccucccuacaagaccuaccacucacccaugccuaugccacuccaucuggacauuuaaugaaacugagagacagaggcuuguuugcuuugcccucuuuuccuggucacccccacucccuaccccugacucauauacacuuuuuuuuuuuuuuacauuaaagaacuaaaaaaggaaaaaaaaaagccuagggcagauacaaucuaguaaaagaaaaucuuugauauaccaaaguguuggauaacaaaggcuagaaaauucagauaauuuauaaagguuaacuauacuugugcuuauaaaugugcagauucuacaauauuuuuccaugucauucuaaaagaaucuucagaaagaaaaacuugaagaauacuaaugucuugggaaacaugagauuaaguuuagggaaaacacuugauagauguggagaaucugaggacucagaauucagcaacuaaucacaggugguuuucuaauuuggccucuggacaugucucacuguuuguauuucucucuccugucaaagugaaugauauauucuugaaaacccccaauuucuugaaauggguguucuguucauucaugggcaggggucaggauugaaguucauauaugaaacaacuggggauguagauaggaaagaaugucugcugcaagaguguaugaagggggauugucauuuacaaaaaaaaaguaccucauggauggaaggauucaugaauagauaauggacauaggaaaggaggucaauggaggacacauaacagacaugcuauccaccauuuauuugugauuuuguaagaggguucucuucuuugucuuguucagauauuuucauguguguguuuuagugagaaucugaguuuuuaaucaguaaagucugauguuuugauaucuugauguuuugaugguagacucuugaguucaucuuguccaaaucuucuagcauuuucaaggaugaagccucugugggaucuuugggcuuggggcugaauuucucaggcauaaauaccuaauggccuugucuaagagggaauagaucuguucugaguguccccaaaaaaguuguccuaggaacugauguggagaaguuacagggagacugauuuccauuccuuauuggggaaaacgaagcacucagaacauacaaggauaaaugggcugccaccagaggugaggagucucuugucacuggagagguuaagauagaggcucaagaacaaugcaaggaaaauggagguuuucaaacacaaaguggauggugguaugagacaauguuuaauguccuucuaacuccgagaguccuugauucuggagaggcacaggaugaacaucuguugcuacugcugaguauacacacucuugccucugagauggcgugaccagcagaaaagaaagcucagggcuguggcuucagaauucauggaaacagagccacugucaagaaggaaucugcucagagcagauucugaguuuucacacuccacaaauccucagauuuagugggaagcuggaaaaaggaacucuuaauuccaauugaggagaaacaagaaaacauuacaaaucaguuucccaagcugagaaggauuagccuugaccccuugggucugccucuguugcccucaccaguuuaccuucuacaacaguuucucaggaacauguguauuuccccauucagcuuucagcauugcuccacgccacagcauaagcauagaucccaaguccacaggcuccauuuugcaggucaucuucugauccuagcaaauguccuuuccccauaguuguccuaugccuuugggcuuuagucuaucccaggacuaacuguggagaaaucauugguuugagagucaagagagcauugguuugggagcuuuaauccucuuucugcuucacacuaagugugucaucuuggcuaaaucacuuggucuuucugcauuuuguuuucuuauuuauaggaugaggaaauuagauuaaaugguuuugagguccuuucuuguucugauauguccaguacucacuggaaaauuggaucuauaacugauggguuuaguaaucuggucauuucuugcucugaaaauuguagucagcaaaagagaucauggaagaaaucacuguaaugguaguaauaguaacacaugccauuuguauugugccuuagguuuaccagguguuuccaaauacauuagcauauuugauaugugcaggacuagauaccuugggaccugccacacuccacuuucaagauauguauuagcuucauuagaauuaaagggacuugaacucaggaccugcagccuauucuucuuuauccacaugucucugguagggcuacauccagaucacaccaugacuucuuauagagcaagagaaaauaauauuauuauaucuuccuuugccuaaaaucucuccacuuauucuuuuuuaugauucugcaccaguucacuggguuauucuaugauuccauauuuuuuuuaaaaaaaaucauauuuaaaaugaacuuacaaugucugaauuuuccuggccuugagucacagaaguaauauguuucagauggcugcccaauauguauuaucauguaauacauaucuguguccuuuucugggaugaggaaggcuucaacuucuggcacugagaacuuuguauuacagacacagguuuaguuucuagcuuagucaugccuuuagaguuuaguagcacaaauccaugcaacccaacagaauacauggugagggccuaguauguagaauuugaaaguaguucaaauuugaauuagaagaaugaagcuaggacuuauuuggaaaaggagauagaaaaaaaaugaucagaaacuguggggccuuauuaccuuugcaguaaguuaucuucuucaugauauaugugaauuauuuuaugugcagauuguguuuugggauugucagaucuaaacuuauauucuugcuggcuaaugugcugauagccaggucugaaacuugaugugcuauccagacacauaugaucagaaaagaucuagagugcaaagaggugccugaggagcaaaaugugguuuuaauguuguggaaagaucacuugcaaguauauaagacuguauaaagaagaggacugugugcaaguggggugaaaaaaaaggauacgugaaugugcauaugacugaauagggaggaaggucagggcuagaaaggaggcuacauaaaaaggggcaauggagaaugcacaggaaagacacaggggaaggucaagucgagcaagguagaaacaggaguagcuagagccauugggaauccauuuugaaacaagaaggaguuuugaaagggaauaggaaaguaagugucuugaaguaaaagauaaauauggauggagaaagaagaaauucuggaugauagagaugauaaaaauauuuauuaagaaaugaagucagguucaguguaugaaauggaaaggaauuuuucagaauuuuaagaaaggggaaguuccucuuggaaaagauauagcaaccaucggggaaugaccuuuucauuucagaaguggaugaggaagguggugugagcaucagguauauucuggaccauuucaagugcuggugagaagaaaggaacucuuugccugaacugggcuugguuuuccaagugcugcuuuggaaaugaagacccagagaugcagagcuuaugguaguucauaaaucuucauguucuauuaucuuucaucugccaauaaaguucauuuucaauaauguccaccauugcugugcccagaauaaccacaggcaaacaucaaaacaauacgcauaaguuagacaagauuaaaucuugucugauaucugcacaaacagauaugcaccauguuggaaacauguguuuuccuagucccauccaggcuucccacaagaaagccaugaugugggucuaaaccauauguuuugaguaaaggagaauagaagaaggggaguguccgcaaaauggaaagagaugaagauguuccaaggaaguaugcugaaacagaacagugaauguuuugcccaaaacuacaaaaauaaaagaaaaaaagaaaauugcaauacauggcuacuaagucuuugaucauaagucgaauuuauagaccuggaauuugccauccuagucuuuccuuuuuaguaagacuucuguccucuggcagugcauaugguaggucucuaauguuucuucaucuccaggaagaugcagauccuuauuuuugcugggaaauccuucuaaauagaaauguaacauuuuuauaaaaacagauuaauguguuuuucacuuaguaaauguuuucaagagcugaauugagaaggaaagagacuggagugguuaauggugauuugauuucuggcauucugaguuuucugcuacaauuagcugcauuacuuggugccaaagagcaguggggaauuguugaguugcuguauccuuuaaaaaaaaacaaaaaacuuguuauuuugaaagaacuuaaggcucacaagauguuacaaaaauaguagaguggccuuacccuagauccaguuuuccccauuuauaacauuucacuuaguccauuuucggaaccagaaaauuaacauuggcauaaugcuauuaacuaaacuacagaccuuuuuucaauuucgccaguuuuuccacacauauucauuuaguugcuggauacuuuuaauucuugcugauuuguaaacuggccuugcuuggauacaacaggaaagauacuaucuggauaaaguucuacaguuuuagagagacuauuaacacauuaauguguuccuuugucaugagcaauacccugccuacacugcuucuaaauuuucugauuuguuuggcuguuuggcaucugaaacaauccaagacaaacuuagaaagauuaggcaacacaaaacacaguaagaccuguucauagcuuguugucuagaaaaccagguagcaggauauucuagaugcuuccugcugcuucuacgugaguaggauuagcacuggggacaaaauaaggaguuuagaguaaaccaguauuucagucaagaguuaguuggcacuuaguuaauggcacuggaaauagcuuguggagagaauagaauacaaugguauagacuccuaauguuugauaaaauacuauuuucagagugguagagagguuuuauuugccuaaauagccguuauuaaauggaauaacaaccacauuagaccaaauuaauugcaaacacagcggcaaccuggggagaaguugaaacuccaguuuuguggauuacaguuuugaguuuuaugauugacauuuuuaaguccccuauuuaaggggucaagauuauaacaaugugugucuuacuaaguuucuaggucauugugagcacuugauaaauauuugcugaauguuguuuuuuugaaugaacauaagauagaaacaaaaacuucucauccaguuaacuagagugaauguagggagaauuguuuugcuuguaacauggagaguuuauuuucaagugaggaaagagaaaaaaauuacucagacuuguuccuggugaagugcauucucuguuuguauacuuuuugauggagaaauugaucuauagaacugcuuaauuuuuugaggcauuuagacagcaaugaaagguaguucuccacaggacaccgaaucaaaaggagagaccagacucuggccucauacccagccuauuugaaacaagcuaucuaguuucuccugcagacaccuugucaacaacaugcaacagugucaggugccuugcaggaaaauaaucugagucccaagcuagccugugcucauccacaaucacaaugaacaugucaaggaagaauuugcagagacucaagggaagcacaaugggauaagguaaucacuuucagugaaaaacuguuuucuugaaaacaggcuuggacacaauugaaagcuggcuuccugcaaacacaccaagagucuguaaucuagccuauccauuauauguccuuuauuauucaugauauccuauucuucuaccuuguugccugguaacuuuuucugaggacugaguuucugcagcgauguggugcacucuuccugugaugaggaaacaucugggcccccuucugcaggcuuuggaagaugaugugucuugucaagggguaaagggcaaauggauuuaauuucugcuuaaaacuaucauagacguuccaaauagaauauguaaaauuucucuguauuagaaaaagaaacgugauaccaauuguauauuuucuuuucuuuauuuauucucuguaagucugucagaugauaaauuguaaauaacaaugauuaaagagucaugcuacugauggaucucccuuucuguauaaacagugccaguucugggcuuuguaaccuuugcucuuuauagucuuucauuccuggggaagugauggggcaugggcccagagcugggguguaugugguauggacaccuguuuguggggcuuuccagcaaaggauuauuuaaauagaccucuaacauaugaguugacuguuuauugggaagaaagcaucuuggucucugacauauccaaacauacgagacacugggauuuuacguccucacauuaauuaguccaguucuggggaauccagucuagaauuaacuggugaucccuuaucguuaugguuacagacuugucuuguuugauacacagaaauccuuuuuaaauccaaauauagucugucucagacuaccugcacaugcacaa

SEQ ID NO: 12947 - RNA, 3794 nt, Homo sapiens
auauuuugagcaaacaucaguuuguucuuuuuugaaugcugaaaacacgccaguuugcgcuuaagagaauaguucaacuucagagacauccauauauaaacauggagggauuucaggcaaugcccgcucuguacagguuucugugcucuucaucuaagccuccacuguauccaacuagaaggcugagaaucacagaaaaacauuuuccuaucauuauucccguacuaaggaggcacaguugccaccauaaacagcacuuaccgguggcauuuacagcuucucaggugauguggcauucugaccagaugccagaaggcuugugacaugguacagauaugcuguucuguacacugucacaccuuuccuggaucauuuuccuucagagcugugugcucuguggguuaaagauuuucuuuuguguuggacugguaaugaacaacuccacuguugguuguauuuuaaaauuuuauguaauuucaaucuuacuugaagaacaguauaaagaaguucuaaauacccuuuaaauuaacuguguuuuccuccauuuacuuuacuauuauuuacuuugccucccaaauuucuuucuugccuacccccauguauuuaugcacauauauuucuuucugagccuuuuauuuauuuauuuuuugagacagggucucacucugucacccauacugcaguguaguggcaugaucacagcucacugcagccucaaccuccuggacuaaagcgauccuccuguuucagccuugggaguagcuggguccacaggcacauacuaccaugcccgguuaauuuuuauguuuuuuaauaaagaugggguuuugccauguugcccaggcuagucucaaauuccuaggcucaagugauccucucgccuuggccucccaaaguguugggcuuacaggcguaagccauugcuccucaucuuucugagccauuuaagaauuacagacaucauauucuuuuaccccuaaauauuuuaguaugucuuuccuaggaacauaaacauucuuuuacauaaccacagcacaaugaccaaaaucaauuuauuuagucauuuguucauauccgcaacacacaugaaauagcuccagaauuuuuucauuugaucaaauaucuuguguggcuuuuaggcaucuuuuauaacucuccuuacacagauuuugcacauuuugcgcuaaauuuauacuuaauuuuuuuuguugcuguuauaaaugggauuuucuccaccaucgugucuucuaaauguuauaauguguguauaugagagcuauugauuucuauauguucauuuuauaacuugcuaccuuacugauaugguuugucucuguguccccacccaaaucucaccuugaauuguaauaaucuucaugugucaagggccagaccagguggagauaauugaaucacuggcgugguuucugccauaguguucucgugauagugaguucucauuagaucuguuuuuuuuuuuuuuuuuuugagacagucucgcucugucauccaggcuggagugcaguggugaaaucuaggcucacugcaaccuccgccucccagguuuaagcgauucuccugccucaaccuccuaaguagcugggacuacaggugcgugccaccacacccagcuaauuuuuguauuuuuaauagagacaggguuucacuauguuggccaggcugaucucaaacucuugaccucgugauuugcccgccucagccuccaaagugcugggauuacaggcgugagccaccgcgccuggcagauaugaugguuuuguaaggggcuucccccuuugcucagcacucauucucucuccugcugcccugugaagaggugccuuccaccaggauaguaaguugccugaggccucugcagccaugcagaacugugagucaauuaaaccucuuuucuuuauaaauuacccagucuuggguaucucuugauagcagugugaaaacggacuaauacacuaaccaaaauuuuucugugguuuguuagucuuauuguugacucucaagggcuuuccagguauucucucuugucauuugcaagucgaaguaguuuuaugacuuuuuaaaauucuuaaaaaauaauuuuuuaauucuuauauauuuuuucuaauuuauaagccucuuaggauuucuguugucuaacuucauuagcugauaccuuugguguaaugucaaaaaaucauagguagugugaacaucguugccuuguuuucuucaaucagcucuuaaaagaccauguauauaaaaaguauuucgaaggacagaaauaacucuaguguuagacauuucuggacauuuagcuggcaagaugagauuauggccccucuuaugccuaguaaccagaauaacaaacaaaugaaacuucagcaaaaaaggguaaaaguacaaaugugauuuuauaguaguucauuaaaaacauugagcuggaccucaguucuaucuuuuuucuuuaaaggauugcuaacuaauaauuuugcucuuuacucagucauucaucuaugacuuauagaaugccuauaauauuccagacauuaucuuagguucuuucucauuuuuuacuauacccaugugaaauagguauuagcuucauuucauaaaaggacauuggaguuuggagugguuaaaugacuuacccaaagucacacaguuaguaagcguagacugauuuugaaucugggucuccuaguuugaauuaauaagugcucaauaauaaauaauaacuaaagguuauuuaguguuuacuguuuuacauacuucauuuauaucgauugguuuaauacaaccaccaaauggcauuuucaucuuuauugucuguuuuuuauagaugagaaaacugauagcacaaguagcuugccaaagaucacaagcaauaaagcugaaauugucuucagaucccaugauuaagaaaccaaucacuacacuauaaaccaaucacuacacuauucuucuuucaaagaaacgaaggaaguucuaggaucaugagagauggagaguauucaaucuccugaauguaaaucuaccagcauuacuuaccaaguuuaaguuuuucuguuguuacuugaggcagugggugauuaugcaauugguaaagggaaugaaaaggccuuugcacccaagaaaguagaagaaaggcgccugaaucucuuuaugauaggugguauguuaaaucuagguauuuucguauuucaacauauuccacuucuugcaaaagcugcaaaaugcaacacaacuuuaaauguaaacauagcuuccaagggcacagugcugaacauauaauaaccugugugugcacacccacacuagguuauguaacaggacuguaaacacugguccuggaauggccugggaggucaucuagguccuccaccaucuuucugcagaguacugaggccuagcgacguuaagucugcaaacucacaaagaugaccccgggcuuauacuaccuuagguuaccuacuaccuuugcuugcauuuccucucuccuuuccugucuguuugugcaaaagaaaaaaggccuggcuucgccuucuugggagccaaaacacaaccaaacagagagcgaguuuggagcccggccaggcaucuugugaacugcacacaaaauaacuagcccaaggucagagagcgcgccaggcccgcccugaaaguuucuccgcaggaaaauccaccgcccuuucccaaccacccgcguggguggcucggaaauccgccacccuggggacacagcucccugcccaucucuguggcccgcuugugccccgugccgcugggccgacuaa

SEQ ID NO: 12948 - RNA, 6466 nt, Homo sapiens
ccaaacucgcucucuguuugguuguguuuuggcucccaagaaggcgaagccaggccuuuuuucuuuugcacaaacagacaggaaaggagagaggaaaugcaagcaaagguaguagguaaccuaagguaguauaagcccggggucaucuuugugaguuugcagacuuaacgucgcuaggccucaguacucugcagaaagaugguggaggaccuagaugaccucccaggccauuccaggaccaguguuuacaguccuguuacauaaccuagugugggugugcacacacagguuauuauauguucagcacugugcccuuggaagcuauguuuacauuuaaaguuguguugcauuuugcagcuuuugcaagaaguggaauauguugaaauacgaaaauaccuagauuuaacauaccaccuaucauaaagagauucaggcgccuuucuucuacuuucuugggugcaaaggccuuuucauucccuuuaccaauugcauaaucacccacugccucaaguaacaacagaaaaacuuaaacuugguaaguaaugcugguagauuuacauucaggagauugaauacucuccaucucucaugauccuagaacuuccuucguuucuuugaaagaagaauaguguagugauugguuuauaguguagugauugguuucuuaaucaugggaucugaagacaauuucagcuuuauugcuugugaucuuuggcaagcuacuugugcuaucaguuuucucaucuauaaaaaacagacaauaaagaugaaaaugccauuuggugguuguauuaaaccaaucgauauaaaugaaguauguaaaacaguaaacacuaaauaaccuuuaguuauuauuuauuauugagcacuuauuaauucaaacuaggagacccagauucaaaaucagucuacgcuuacuaacugugugacuuuggguaagucauuuaaccacuccaaacuccaauguccuuuuaugaaaugaagcuaauaccuauuucacauggguauaguaaaaaaugagaaagaaccuaagauaaugucuggaauauuauaggcauucuauaagucauagaugaaugacugaguaaagagcaaaauuauuaguuagcaauccuuuaaagaaaaaagauagaacugagguccagcucaauguuuuuaaugaacuacuauaaaaucacauuuguacuuuuacccuuuuuugcugaaguuucauuuguuuguuauucugguuacuaggcauaagaggggccauaaucucaucuugccagcuaaauguccagaaaugucuaacacuagaguuauuucuguccuucgaaauacuuuuuauauacauggucuuuuaagagcugauugaagaaaacaaggcaacgauguucacacuaccuaugauuuuuugacauuacaccaaagguaucagcuaaugaaguuagacaacagaaauccuaagaggcuuauaaauuagaaaaaauauauaagaauuaaaaaauuauuuuuuaagaauuuuaaaaagucauaaaacuacuucgacuugcaaaugacaagagagaauaccuggaaagcccuugagagucaacaauaagacuaacaaaccacagaaaaauuuugguuaguguauuaguccguuuucacacugcuaucaagagauacccaagacuggguaauuuauaaagaaaagagguuuaauugacucacaguucugcauggcugcagaggccucaggcaacuuacuauccugguggaaggcaccucuucacagggcagcaggagagagaaugagugcugagcaaagggggaagccccuuacaaaaccaucauaucugccaggcgcgguggcucacgccuguaaucccagcacuuuggaggcugaggcgggcaaaucacgaggucaagaguuugagaucagccuggccaacauagugaaacccugucucuauuaaaaauacaaaaauuagcugggugugguggcacgcaccuguagucccagcuacuuaggagguugaggcaggagaaucgcuuaaaccugggaggcggagguugcagugagccuagauuucaccacugcacuccagccuggaugacagagcgagacugucucaaaaaaaaaaaaaaaaaaacagaucuaaugagaacucacuaucacgagaacacuauggcagaaaccacgccagugauucaauuaucuccaccuggucuggcccuugacacaugaagauuauuacaauucaaggugagauuuggguggggacacagagacaaaccauaucaguaagguagcaaguuauaaaaugaacauauagaaaucaauagcucucauauacacacauuauaacauuuagaagacacgaugguggagaaaaucccauuuauaacagcaacaaaaaaaauuaaguauaaauuuagcgcaaaaugugcaaaaucuguguaaggagaguuauaaaagaugccuaaaagccacacaagauauuugaucaaaugaaaaaauucuggagcuauuucauguguguugcggauaugaacaaaugacuaaauaaauugauuuuggucauugugcugugguuauguaaaagaauguuuauguuccuaggaaagacauacuaaaauauuuagggguaaaagaauaugaugucuguaauucuuaaauggcucagaaagaugaggagcaauggcuuacgccuguaagcccaacacuuugggaggccaaggcgagaggaucacuugagccuaggaauuugagacuagccugggcaacauggcaaaaccccaucuuuauuaaaaaacauaaaaauuaaccgggcaugguaguaugugccuguggacccagcuacucccaaggcugaaacaggaggaucgcuuuaguccaggagguugaggcugcagugagcugugaucaugccacuacacugcaguaugggugacagagugagacccugucucaaaaaauaaauaaauaaaaggcucagaaagaaauauaugugcauaaauacauggggguaggcaagaaagaaauuugggaggcaaaguaaauaauaguaaaguaaauggaggaaaacacaguuaauuuaaaggguauuuagaacuucuuuauacuguucuucaaguaagauugaaauuacauaaaauuuuaaaauacaaccaacaguggaguuguucauuaccaguccaacacaaaagaaaaucuuuaacccacagagcacacagcucugaaggaaaaugauccaggaaaggugugacaguguacagaacagcauaucuguaccaugucacaagccuucuggcaucuggucagaaugccacaucaccugagaagcuguaaaugccaccgguaagugcuguuuaugguggcaacugugccuccuuaguacgggaauaaugauaggaaaauguuuuucugugauucucagccuucuaguuggauacaguggaggcuuagaugaagagcacagaaaccuguacagagcgggcauugccugaaaucccuccauguuuauauauggaugucucugaaguugaacuauucucuuaagcgcaaacuggcguguuuucagcauucaaaaaagaacaaacugauguuugcucaaaauauguuuauuuggcugcucugugcuagacuuugugauagacauucuagggaaucaaaagauucuguguccuuaauggcuuauagugcaauaauagagauagaagagguuucuuuuucaaugcagagagucauaagcgccauagugaaugcacaaauaaaggauuucagagcucagaggagggaaaguaugaaggaaugaagagguuucccaaaaggacagccagaagguuugggaaagaggcaggaggcaagggacagccucacuccucaugggaggcugcccuuuuauaagcagccuuggggauagaggccuucauguguuuccccccuuguaacaccaucaccuucucuaacuccugcugccuccuuaaugaaaaagaccaaggaauuuguacucagguugagaacuuagaaaguaagacaucuggccaggcgcgguggcucaggccuguaaucccagcacuuugggaggcggaggcgggcagaucacgugaggucaggaguuugagaccagccuaccaacguggagaaacccugucucuacuacaaauacaaaauuagccggguaugguggcacaugccuguaaucccagcuauuuuggaggcugaggcaggagaaucacuugaacccgggaggcagagguggcggugagcugagauggcgccauugcacuccagccugggcaacaagagcaaaacucugucucaaaaaaaaaaaagugagauaucuacuuaaggguugcuauuaaauaaacuguaaaauuugaaacaccaaaauggaauauuuaccaaaauguauguauuuuuagcaguguauuaugaucucagcuugguuuuccaaaagauaauauuucaucugcuagauagauagauagacagagagauagauagauagagccgggcacggugacucacaccuguaauccaagcauuuuggaaggccgaggcagguggauugccagagcccaggaggucaagaccagccuaagcaacauggagaaacccugucucuaccaaaaauacaaaaacuuagcuggugugcuggugugcaccucuggucccagcuacuugcgaggcugaggcaggagaaucacuugaggcugggaggcagagguugcagugagcccagauuacaccacggcacuccagccuggacggcagagugagacccacaucucaaaaauaaaauaaaauaaaauaaaacagguauauagaagcggugagaccuggaaaaaaaucaccuaaauucccugaacuucaguuuccucaucuacaaaauugaaauauggaguuggaaagagaauuaaaagagaaaaagccuagcacacaguagcuauucaauaaauauuaggugaauucaaggucaggaguucgagaccagccugaccaacauggugaaacccugucucuacuaaaaauacaaaaauuagcugggcaugguggugcacgccuguaaucccagcuaaucaggaggcugaggcaggagaaucacuugaacucgggagguggagguugcagugagcugagauggugccauugcacucuagcccaggugacagagcgagacucugucuaaaaauaauaaaauaaaauaaaauaaaauaaauaauaaauaaauguuaggugaauaaaugaaagacagaaggaaagaaagaaaaaagugaaauagaauaguccucuauuaaaaauauagaaucaggcugggcuagauggcucacacuuguaauccagcacuuugggaggccaagguggguggaucaccugaggucaggaguucaagaccaacccgaccaacauggugaaaccccgucucuacuaaauacaaaaaauuagccaggagugguggugagcaccuguaauaccagcuacuuaggaggcugaggcaggagaguugcuugaacccaggaggcggagguugcagugagccaagauugcaccauugcacuccagccugggcaacaagagugaaacucugucucaaacaaacaaacaaacaaacaaacaaacaaucauaccacgauuacaggagagauguuuuaagugggccauuacuacaaacaaauuaaaaaauucaagacauacaagaguagguuuuguguuuugucuuuuagggaugauagaauuauggugauuuuuauauucuuuuggaugauuuugagggguuauuuucuaaauaugcuacagaggaaauuguuuuauaauuaggagaauuuuuuuuuaauuucagaagagcaggcaugcuaacaacuuaaaaagcugcuuccuugauuguucuucucugaagucaugacagauaugugccagucuggccacacucucuugcuuaguacaaccaguaaugauccaucacccaggguuuuuuguuuuuguuuuguuuuguuuuguuuuugagacagggucuccaucucuugcccaggcuggagugcaguggcaugaucucagcucacugcaaccuccaccucccggguucaagugauucucaugccucagccucccaaguaacugggguuacagacaugugccaccauguauggcuaauuuuuguauuuuuaguagaaaacgugcguuuugccauguuguccggcuggccacgaacuccuggccucaaguaauucacucaccucugccuuccaaagugcugggauuacaggcgugagccacugugccuugccccaccaagauuuuuuaacaguaggcugguauuagcaaguauacacuagaggagccuucccuccauuguccugagugcaauggccucagcuaguccacugaacuucugcaaauguccguauuauuucccagcaguauagacaacacaccaggagaaagucuggcucaacucaaggcucuguucaaggcaaggccugagcauucaugaggucacug

SEQ ID NO: 12949 - RNA, 198015 nt, Homo sapiens
uguccgccugccgccgccgucccagauauuaaucacggaguuccagggagaaggaacuugugaaaugggggagccggcugggguugccggcaccauggagucaccuuuuagcccgggacucuuucacaggcuggaugaagauuggggugagugggaucugagaauguaccaggguggcucggguucgcgucuaaagguuucuuccucccuacuuccgcccacucguggugacagguguggaccaacccugccuggggagugaggccccucgucacuccuguucgugccccuggaagagucugggaguaucguucggcuucuguccuggccacagggagaguagaauauugucuaacuggaguuaacugucguuuuucacuauucccacuggggaaguaccgggugaucuuuuuguguggcuaacacuggacgucuuuaggagguuuagagcaaaauggcugggaccgccaaaaaggcuacaagcuauuuccugagugugaaaugugggcggugagcacaauggaguggguuuuuguguguuugguguauaugagagaaugugguuauauacaagaaauucuaaucuuacagcuuuuacuauugguuuaagccugauguccgucuuggcagaaaagcaaaacacccaagcaccugaccucgggucccugcuuagcuacaccuaauacuuaugguguaauccugacugcucuccagauacagcucuuaauuuucuuguuaauggauauuuuguuugguuuugguggucaggaaggguggaaugggaugaaguggaaaugagaaugaagaaacuuuguuaucuaaguauuuagaggagacuuuuauucuccucuugauugcaagauauaauaguaauauuguucuuagguuccaauaugaauuugggauuguguagguucccaaaugggcccgcuagugagccuacaccacucaucagccuuggaacuggggggaacccaguuuaucuuucucccuuggaucagcauucucaauagcaggaguggaaggaaucucaacuuuuuauugaacaaagucauuuaauuguuucaaggacagauguucucuaaaacuauauucuauuggagauuuauuuuaauccuuggguagauuuuuuaagaguugcuggaaaacuuaagauuuuuuauucccauuuucccaagccaaaugcauuagugacaguaaccauuuauuuagcucuuugugucagggacccuguuaaacucuugacaugaaguauuuuguuuaauccuaccaacaguccaaugagguacuguuuauuuuagagaugaggaaacugaggcuaacagaauuugugcucagauucuuagagcuaguuaguggcagaagaaggaucagaccagguuuuucuaccuccaaagucuguaccccuagcaucuauucuauaaugcuuuccuaacucaugucuacagauuuuauucuuccuaagaucccugguuauuaauaagacuacuugaauauauuggguaguuaugauuuauuuugucagcuagucagcuauuauauuuucaugacauuucuuuucuuuaccucuuuuuuugagauggaguuucgcuuuuguugcccaggcuagaguguaauggcgcaaucuuggcucaccgcaaccuccgccacucggguuugagcgauucuccugccucagccucccgaguagcugggauuacaggcaugcaccaccacgcccggcuaauuuuguauuuuuaguagagacgagguuucuccauguugguuaggcuggucuggagcucuggaccucaggugauccgcccaccucggccucccaaagugcugggauuacgggugugagccacugugcccggccagugacauuucuuaaaguauaacugugggacacuuccugguagcauaauuuuaugucgucuucugauacccaggcugcauuuuccagacuuaucugaucacuugacuuaauguucucuaacagagcauucaguucuuuguagucaguucaccgacucacuucuaucggguauccugcccugucccucccugaaugugcccauuuccauuguuuuccagguuucccuuuucaaacuguuaacagucuucucuucuuugaagacuuuaauuuaauuccuuagguguucaguaaguaggauagauuuuguuggcaauagagugaaacacuacugucugauaguguuucguucugugacaguugcuguuuuggauguucaaguacuucacugauuuacuugauuuuguuguuguuguuguuguuucuuuuagagacagggucuugcucugucgcccaggcuggagugcggugaugcaaucauaguucacugugaccuggaacuccugggcucaagugauccuuccaucugagccuccugagucgcuaggacuacaggugcacaccgcuaccaugccugguuaauuuuuaauuuuugaauuuuuuguagagacaggggucuugcuguguugcccagacuggucuccaacuggccucagucauccugccucaaccucccaggugaugggauuacaggcucaagccacugugucuagccuugauuuuuuuuuaauauuagacacuaucuaguuaaaauuuaaaaaucagauuauguaauuaguauguccugugauuuuaacaacucuaaauaauuuaaauaaagugauuaacucagaacagccugugagggaugugcuuuccuuuuucuuuuuaacuuagguaaugaaauuuagagcaagagucuucaaacauuuucuguaaagguucagauaguaaauauuuuaggcuuugugauuacauggucacuguugcaacuacucaagucugcugugauagugcaggagcagccagagacagcauaaacaagugagcauggcuguguuucuauaaagcuuuauagacacugaaauuugaauuucacauaauuauuuuaaauaauaagccuacuuuuuuaguauaauuauagauuuacacaauaauugagcagauaguacaaagaguccacauacuuccccuucauccccagcuucuccuauugguaacaucuugcauuagugugguacauugguuacaauugaugagccaguauugauacauuauuauuaacuaagcccaucauuuaaaguucacucuguuguacauucuauggcagggauccccagccuuuuggcaccagggacugguuucaugaaagacaauuuuuccacaggagguggggacagggaggcacaggaaauguuuucaggaugauucaagugcauuacauuuauugugcacuuuauuuguauuguuauuacacuguaauauauaaugaaauaauuauauaacucaacauaauacagaauuagugggagcccugagcuuguuuuccugcaacuagauggucucaucugggggugaugggagacagugauuagaucaucaggcguuagauucucauaaggagcgugcacucuagaucccucacaugugcaguucacaguaggguucacacuccuaugagaaucuaaugcugcugcugaucugacaggucguggagcucaggcgguaaugcaagugauggggaguggcuguaaauacagaugaagcuucgcucacucacccaccugcugcucaccuccugcuguguggccugguucccaacaggguugggaaccacuguucuauggguuuugacaaagguauaaugacauguauccauaauuacaguauuauauagaauaguuucacugcccuaaaaaagcccuaugcucuaccuauuuuuuccuccuuccucuucccuaccucuggucagguaaccacugaucuuuucacugucuccaugguuuugccuuuugcagaaugucauauaguuggaaucauacaguauguagcauuuuugaauuggcuucuuucacuuagcaauaugcacuuaaggucccuccaugucuuuucauggcuugauagcucauuucuucuuagcacuaaauaguauuacaaaaauacuauuuacaguguuacaaaaaauaguauguauguucuauagccuauuagucugccuaggcugccauaagacaacaccacagacugcgugguuuaaacaauggaaauuuauuuucucccaguucuggagguuagaguucaagaucaagauggccgcaccuucagguucugguuagggcucucuuccuggcuugcaugcacauggcugccuucuucuuguguccucacauggcacugagagagagaaucuucuucuucuuauaaggccacaguccuaucagauuagugccccacuuuaaugaccucauuuaacuuuaauuaccuccuaaagacuguaucucucgauauaguaauauuugggguuagggcuucaacauacgaauuuuggaggacacaguuuaggccauaaauucacaguuugcuuauccacuuaccuauugaagcacaucuugguugcuuccaacuuuuggcaauuauauauaaaacugcugaaaacauuugugugcagguuuuuguguggacaugcauuuuccaauuguuuggguaaauaucaaggagcacaauugcuggauugugugguaagaacauguuuuuuguuuguuuuguaagaaauugccaaacugucuuccaaaguggcuauaccauuuugcauucccgcuagcaaugaaugagcauuuuugaugcuccacauccuugcuaacauuugguguugccaguacuuuggauuuuagucauucuaauagguguguagugguauguuuuaauuugcaguuuccugaugacauaugauguugagcaucuuuucauaugcuuauuugccgucuguauguuuuacccuccucucuccuucucucuucucuuuuacucuugcuugaauuugugcaaaagcugcuuuauucugcuuucuucuuucuucccuccuccuccuccuuucuccuuucuccuuuuuccuucucuuuauucuucugucagcuguacuuaagauauguguaucaagaucagaagcuuucgucugccacugugguuucguuuaugucuucagucucuucugugaagguucucuuggcuuucuagcacuaaaucaaaaucuggugcuccuggaugacacaacuucccguaaugccccggugaacgguugcuaauuuuauucucaaaaccuuuucaccauagggccucuguuggugggauaggugucuccauuguccuucacugcuauucuccuuuccuccucccuaaaaauaucuaaguugaaaucucauuuugucacaauaucccauccucuaccucuccugauuccuggaucacucucuuucacuuuucuuuuuuucuuuuagagauggggucuuguucucuugcccagguuggagcuggaguaugcgguggagcaaucacagcucacugcaucuucagaccccuggggucaaaggauccuccugccucagccucccgaguagcugggacuacagacacaugccaccaugccuggcuucuuuuuggcuuuuugaaaacauuuugccacuagcuuacuguuacuuucuucaccauuacuuccaucaugauucuuggaugauuucaguauccuuagagaagauccuucagauacacugaccugucauuuucuggaccuccucuuuaucacugaucuuaccuuuuacccagucucagccauuugcuuuccugaucauaagccuaagucuugucacuaccaauaacaucucacuuucaaacauccugcucugacugccuucgccuguuuuaccagcuuacuuccuuuaguauuccaguuucaauaguuguucaguccuucugagauuuugccauguuuccagugucucucauucucuucaguucaucacgucccucuuacccaguuuaaauaccauggacagucauugucacuauuuccuuccuuucaccuuucauauucaugucugucucuuuucugguagguuucucuuggauaaaccuauuaguuaaauucaguuuugcccacuucaugccuguccuaguauagcugaaucagcugaagaaaacacuucaacuguccugacuggucucaauuuaaguguugccagaccaaucauauuucccugguccucucacugucccauucugaugauugcuuuauaaaguuucuucuaucuucaaaccuccaacaucucucccauccuuugaaucagaagagaacuucuacagucucccacuaccucauuuacccaccuaucaacauguuugcuuucucuuuuguuggugagaaugaguggcuucuugcuccuagcuagagccaguccuuccauaugugcuuuagauucuuccuguuuuguucaagaauauugcucaagcuauucuuccuccuguuuccugcaucagcauuuccccucucuacuagaucaucucugucaguaaaugaacauguuguuguuucuccuagaaguacuguuucuauaucuagauaguacucuagcuagaguuaaaaaaaaaaaaaacaaaaccaacaaacucaaaacucucuucagauguuacuucaccucuugcuguuacugcauuucucuacuguauguuacagcagaauuccuuuuaaaaaauguccacguucacugacucuaguuuuuuauuucuccuugucucuugaacccaguccagucaggugccaccacuccacugaaacuccuguuuuuuuuuuuuuuuuuuuuuugagacagagucuugcucuguugcccaggcuagagugcaauggcacgaucuuggcucacuguaaccuccaccuccuggauucaagcgauucccgccucagcuuccugaguagcugagauuacaggcgccugccaccaugcccggcuacuuuuuguauuuuuuuuuuuuugagacggagucucucucuguuacccaggcuggagugcaguggcucacucggcucacugcaagcuccaccucccagguucacgccauucuucugccucagccuuccgaguagcugggacuacaggcaccugcuaccacaccuggcuaaauuuuuuuuuguauuuuuaguagagacgggguuucaccguguuagccgggauggucuugaucuccugaccucaugauccgccugcccaccuuggccucccaaagugcugagauuacaggcgucagccacuaauuuuuguauuuuuaguagagaugggguuucaccaugcuggccaggcuggucucaaacucccgaccucaugugauccacccgccucggccuuccaaagugcugggauuacaggcgugagccaucaugccuggccugaaacugcuguuuuuaagggcacuacugauuuccacauugcuaaacccagugacugugucugaucuuauuaaacuuauaaggaguaaaugaauaaauaaaugggcaagguggaggugaggugggaaaguuuguugaguacacuaaaaauaguaacuaccauuauuuacuacuguugagggaaaucuaauagugugggacuggugcaaaggauauagaaauaggcaauagguuuuaggauacuuugggguaacugaugcuaacaguuucuuauggauucuuuuggaauguucuauaaauauacgaguauauuuaucaacccaccuucaguuauuuuuuuaaccacagaaaagucaaaagaucaguacacugauaaacgugcguuuuccuuaucuagauuuaccaacuguuaacaucgugccacauucacuuuauaucuuaauauuacccacacuuuccuccuuuuucacaucugaaagugggcugcagauaauaugaaacuccuaaacacuucaccauguauuuccuaagaaugaggaaauguuuauuuuuaaaaagcaucaauucauuuuaauaugcuuuauacuucaaagcuaacaucacaggguucuuuuucaccuucuugcaccauaugcuuguauuucucuucugccgcuaugagaauccugauucccaauaacauccuuuguuuuuauaggcucacuucagcagcucuguuggaaauaaacugaaagaggggcaagggcagaagcagggagacguuuuggaggcuguuauagcaauccccaugaguuacaauaguagcaguggaguaaugagaaguaguuggauuauggauauguacacacacacacacacacacacacacacacauacacacauauauauacauacauuuuaaaauuuugaaauaguuugaaaucuauagaaaaguuuuaagaacagugcaaagaacucuugcaugccuuuuacacagacuccucaguuguuaaauuuuacugcauuuacucaauuucucucuuucucccuuucaagagagagagauguguugacccaucaccuuuaaauacuguaguguauacucucuauccuccugccucccaaaagaaggccacuuuccucuauuacuacccuauauuucuuccagucaggagauaaacauugauacaacagugucauccaauucaaagacaccauucaaaguuugccaucuguuucaauaaugauuugcuuuucuagucuaggauuuuacuugcaaacacucauugcuuuuacuuaucaugucucaucaguguccuuuaaucuggaacaguucuuuagucuuuuccugucucuaauguccuugacagucuuaaagaguagaagucuuuuauucgacaagaugauccuaaaccacuaagggguuccuuggaaaaaugaccaauuccagggcugggaaagugcagggaaagugcaaaauaagccuggaaaaucuugggccagaaauucucagcaaaugaacauguuaaaaagaacaaaggccccaauaugaaugaacuccccguggucaaaucugggaaaauuuggcaucagaauaaaaugaggguauacauuauaguguaaauacuaugcgauguuccuaugccaucauaucauccugugauauagucacaugaucacuuggucaaguugguaucuucuagguuucaccacuguaaagccacugcuucccauuuuguauuuuauugcuauuuugggggagauaaucugacauaacaccaauauccuuuucuuauuaaaccucuaaccacgagcccuagccucauuaauaaccccaaucuauaucaguuaccacucuaaugguugccaaaugguaacuaucuaacucuaucauucugucuaucauucuaucauuguugauugacauugcacuauaagaaccaaccuaccuaccuaccuuccuuccuuccuuuguuccgugaugaacucauugauuccuuuuuuauuuggugguugguaaaccgcuacucucauuuuauucugaugcucagauuuucccagauuugaccacugagaauucauucauauuggggccuuuguucuuuuugacauauuccugucauuugcugagaauuucuggcacagcaagauuuccaggcuuauuuugcacuuucccugcugcaagcccuggaauugguuauuucuccaaggaaccccuuaguggacuucuguuugguggaagaugguauuuaguauccaagaucuggucacccaguauuuucauugcuacugggaugucauugcuucuaggaccucuuagcagacagaacuaggaaauauauauacauguguguauauauauauauaugugcauguguauauauguauauaugcauaauacaaacaucugcauauguguguacauauauauauacuuccacagcuaucuguauguguuauauuuuaaaugaguuuauuuacuaauacuucuaguucuaauccaacaucuuaggauucuuuuagucucccgacucuuuccaugcucuuaaauccuuucucagacugugagaaaucugacuccaauuauuuuaguaaaaggcaaaagauucauucguucugaagagaaaccagagcauucuaauuauuuuagauauauucaaccauuugcucagucaccuaacauauuuguucaguaugaccacucuccuaaccacucagccugcguuuuccaucugcuacuccauucccccucccacugggcuggggcaugcuggcaucuuugcugggcaauagucucucccacaccauccuauuuccuuggauaugaggcauauugcuggagaugacugugcacaaaaccccaucaccuuuguugcccugcuucuuuggaagcugacaucucuguguugggagggguagggaagaaaaggaagguugggaagggaaggaagaaugggaggaaagguaggaagccacauuacagauauauauuuugagaacagagcugacagaauuuucugguagauugauuauggagagugaggaagagaaguaaauaauuaaguaauaaugaucccaagguuuuuggccugagcaacugggaaaauccaauugucauuaacugagaugaggacaaagcaguaggagguuuggugggguugaugaggagcucauuuuggauauguuagguuugacaugccuuuuaaacaucuaagaggagaugucauacucacugcacaugcaucuugaaguguggguuggagauguauauuuggaaauccuugguauauagauuuuauuuaaagccgugagcucagcugagauuaccaaggaaguaagauagauagaaacguuuaugcugagcccagggacaaauuuguguuagggagaugaggaagaaccagcaagguaggucaaccacugaggugggaggaaaacuggguaagugugauauucuggaagucaagugaagaaaaugcuucaguuaaaaugaaaggaucaacuauguuaaugcuguugauaggucaaguaagaugaggacuaugaguuuaccauugaauuuagcaauauggaagucacuggggacauuaauaauuauguguauguggagcggggagcuugauuggagcagguuuagaacgaaugggaggaaagaaaugagagagccagauagagaacucuuuaaaggaguuucagccuauauauaagccgcaguccucugcuuauauguuucuuggcucugcaccugaguagucuuuucugagagucaugugaguaaccuuuuguuauuacuacguauacauuuuuuugcuaaauacuauuuugucuuaggcggugaaauguuacuguaauuggucagguuaauaacagacugacagugcaguuccuacacuugugcacugaggaaaucaucagagcaguuucagcagcauaaaauagguagagaguacaaaggaagaccuaguuuugaaaaacucuucaaagugcuuaaaguuuugaaagugucagaggaaauaggaacuucauagauucuauggugaggagccuucuugggccuuggucaacaccuuaaccuuucuuuacaaaaaguuuucaguauaguguauugaagaauguuuucuguauccacauauuucuugauuuguaaugaaaccucauuaggaaauuggaauauaguuagauuugcugaaaugaauuugaugguuuagaugaaugaauccuuuauugucuagauagaaaauugguugcacccuuaacuuaaggcauggauaacaaauacgcaguguguauauacuuuccacagcccucuccuauugcuuaugaaccaugucuacuuuccacaguugucuccuauuacuuaugaaccacauuaacucuucaugcugaacccagauguagcaucagaauucuuguuaguaauguuccauaaagccacuaccaauuagucuuacaugacauaugacauaaaaccuuuuuugaucccugguguaagaauucaguucacaagauaaaaauuaugcagaaaacaacacauaaauuggaaaugagcauugaauugcuuauucacauuacuggaguuuaucaauaauaguaauggcuaaugagaaaccuuaauagaggugacauagggacacagugcuuguuucuuugucaaauaauugaauugacaguucauuucuauucuuuuccuuuguccaaagauucugcucucuuugcugaacucgguuauuucacagacacugaugagcugcaauuggaagcagcaaaugagacguauguaaguauuuacuaagguugaauaaugugauauuuagucuuuaacccuaauuauugcaagaaaguuucaggacaacagguucaggcuaguaauuuaaguuacauacuuaaugguaaauagcuucuaccauuaaguaugaaaguuaguagccauuuuguaaucaguaaauguaggacaguagaaauugcauuguauugcaauucuaggcccaccuuuggcccuagggaugggugacuuuggaaaagucacuaaucugccuaccugguuuuuacagauacuuugcuacauaagggaauuggcaggugacuuuggaaaagucacuaaccugccuacuucuugguuuuuacagauucuuugcuuuuaaaaaggaaguugguaaguucugcuugacuaaguuaguccuuuuuaaaaguuguguauucauguagaaagcucugaaaaguagguguauccuuaccuuugauugguuagaggucugugugaaaacuauuauaacacugaguccccgagaauaucuuagauuuucuuuucuugauuaguacauauaaaacucuuugcccuauagaacuuugauuuugucuuauucuuuaauggaugaggugcuguuucacuuaagaaguaauucaagugagcagaguaauuugucaaucagguugaauaucacaucauuuuaggcucuuauuaacuugaguacaaaauauguaaagauugcuuagugaguuucagacauuucuuaaacaaugauuuagcaguuguuuuuaccauuaaucgacagaagagaaugaaggacaugauauauuuuaaaaaaucaguacuagggauuuuaaugguuucauuuacuccaugagauacuuuagaauguggcccauugauuaaacugccuuuuaauauuggcuauuugaauaagcaacugauacucauauuucauaacaucuagaauccuaaaagaaaauguuucuuuuaaacuaugucaagaaacugugugcucaauuggaaagauuaagggaaauauauuccugauuuuacaacuaacauucuauuauuuuaugcaaaucacucaaucuuucaguuccuuaguuuuucuaguaugacaugaagggauugaaucucugagaccccucaugucauucuucuuccaaacggcaauagaauuucccaugcuaaaucacugaagaguuagaguauauaagugccaguauguuucauuuugcaugaacugggccuguuaaauuucugaugugauaaaaucuuuaugcuguagaagguauuugacuuauuuggcugaagauugagucagaaguuuccucaaguagaucaugcccuuauuuaaaaguguugcuggcacucaggcaagcaacauugguaacuuuacuuagauuaagaaaguuuaaggauuuuuugguugcuaaaacaaggcugcuuaauuuuuuuuuuuaagacagagucgcacucuguugcccaggcuggagugcagugguuugaucucggcucacugcaaccucugccucccagguucaagcgauucucaugucucagccuccugaauagcugggacuacaggugcaugcuaucacgccuggcuaauuuuuguauuuuuaguagagacgggguuucacuacauuggccaggcuagucucaaacuccugagcucaagugguccacccaccucggccucccaaagugcugggauuacaggcaugagccaccacaccuggcuaaggcugcuuaauuuuuugaugugaagauccaaauaagagaaaaaagugaaggagauugauuuuuuaaaaaaugguuuuuuuaugauuuaaauacuuuuuuuucaugugcacuuucacauguucucuuuauguaccuuguacuaauauuuacucaguuaugggcaucauaagaaaauaguuucccuucuguguuucuguuacauucucaauaaaaaugaaccauauaguagucauuuugaaaugauaauauucuucuagaaauuguuaacaaauggucguuaccaauuacuagauacauuuuuacuuuuuuugccugagguguauuuuuuuauuuuuauuuuuauuuuuuuuuugagacggagucuugcucugucgcccaggcuggagugcaguggcgcaaucucggcucacuguaagcuccaccucccggguucacaccauucuccugccucagccuccugaguagcugggacuccaggcacccgccaccacgcccggcuaauuuuuuguauuuuuaguagagaugggguuucaccauguuagccaggauggucucgaucuccugaccucgugauccaccugccucggcuucccaaagugcugggauuacaggcgugagccacugcacccggccgagguguauuuuauuguugcuguuuuuguuguuguuguuguuuuguuuuguuucuuugacagggucuggcucugucucccaggauggagugcaguggcaugaucuuggcucauugcagccuccaucuuuuggacucaagcgaucuucccaccccagccuccagaauagcugggaccguaggugcacgccacuaugcccagcuaguguuuguauuuuuuuucuuagguagagauggguuuugccauguugcccaggcuggucuugaaccccugggcucaagcaauccuauuguugcuguuuuaucauuugugacauuaaguuaauauuuacugccuuuugacuuuauugcauuauuuauguauuaaguuuacuuuucuuuuugucucugugacuccagacacuuaauuuaaaauaguacuguuugguacuaacuugaucucagacuuacaugaggacucugaaauuaugugacacuucuuuauucauguauauaguauaaggugguuaucuggaugacccagaauaugcuuauauuuugguuagaaaaaccaccuaaaugaaaagaacuuaaugcaggcuuuaagaaguuugcuggacccuguuuuagaaaauuaguuuuauuuuauaggauuaaaaagugguguuuuuuuugauucauaaaaguuuuagaaauuuaagaaguauagaacuguagaaaaaaggaaaauuacucagugauucauaaaaguuuuagaaauuuaggaaguauagaacaguagaaaaaaaagaaaauuacucagugguaacuauccucuuuaugauucuugccugucuuuuggauauaucuauauucuuucuauuguauauagagauuauauuaugaauagcauuuacuuugucuuguuuuucuuaauggcaaugggaaaauguauuuugcuggauuucccuuaagauaaaagacacauuuuugacuccuguaauggucauucucauagaaaauaaugaagccaacuaaauguuuuaaauacugaaucccuuaccucuuuccuaguuguugcugcugugcuucaaguaacugaauugauuuuaucucuaggcuauccaagauguauucucauacaagacugacuuagaguauucuuuuuacuagguuggcuaauagcaguuaaauuauuugugccaaauugugucucacaguuugauuuuaagauguguauguuuuauucuuuuaauauucuuuugcugauuugaaaccuacaggaaaacaauuuugauaaucuugauuuugauuuggauuugaugccuugggagucagacauuugggacaucaacaaccaaaucuguacagguaauuauguguuucacugguaaaaguuuuaaaaagaucaauuuuauuuuguaguuuggucauacucaaaauuaggugggguuauugggcuauucugguagguuaaaagauuccugguguuaugcauucuacuucugguauggcaauuauguaaacaaauuucuugccaaaaauggauaugaggaguuucauaguuauguuucaguaguguaaugaaugaacaguucauaucagaaauagaaauagugauuuugaauuaugaauaaugucucuguauaagauuaaccugagaaccagacagggcuuagggaaucaaagggaagagccuggguuaccagaaccuaggaacuugguggaggagucccaugcauuuaauacauguacuucuaagaaggggcagcaccuggcugauacuaauaucuuuaagggggccugaugaggucgggguugaguauacugaaagaagccagaaccuggagcaaauugccagugcugggauacagcugaugguagaaugaagaaaaaucccuucuccucccuucuagcuuuuucuaguauccccuauugacaggaccuaaaaggaugccagcugggaauaauuuauaucaccgauuauagaaaguggacuuagugcugagagacagugaauaaauaaccagcacauucuccuaucuaaauuccucucuaccucugcacuaccuauuccucuucauuuuauguauuuacuuauacuguuucaugccuguuugccuucauagaaugugggauacacaaagucaguguucugguuuuaucguuugacaaacuaaaucuuaguugcuuaaagcaacaaccauuuuauuagauugcuagaaucuaugggucacgaauuuugacugggugcuuacgaauuuugaccgggugcuccaaggauggcuugucucugcuccaugauguccagaccacaacuggggagauuugaagauuguaguagcuugacauuugggggcuagaaucaucuugagguuucuucacucauauguguggcaccugggguggaaugacuugaagacuaggacuacuaaauggagugccugcauagggccucuuuguguggcgugguguucucagucaugguggucucaggguagucagacuucaaaggcuccaaguaugaguguuccagcacacaaagcagaggcugcauuuccagcuucagaauucacauagcauuacuucuaucuucucuugauugaaggagucaagcccaccuaaauucuuggggaggggaaaucgacucuacuucuuggugggaaaguggcaagaucacauuguagaagaucaugagggaagaucaugaaggaugguagauaucguauggcuaauuuuggaaaacacagucugccauccccacccuauucuaucuuugacaccaagggauacugccugggccauaguugcucaguacauuuuuauaggauaaauuaauaguuuaaaagauaugaacauuuuuuaugaguuugaauuguauugucaaaaaugcuuuccaaaauauuuccuguuucuuauuuuuuuaaauuuuuugggaagcuauaauauuuugcauaugguaaaauauucaaaagguacaaaaaucuguauaguagaaaaaugucuccugcuuuuauuccucagccaacaaguucuauuuuccagagacaaccacuguuaccaguuucuucuguuuacccuuccagagaauuagugcagaugcaaguguacacauauauauacacacacacacagacauacauauauacccccuccccacauauauauauaauuuguaacacaaguggaaacauacuagauauauuguuuucugcaucuuucauuuucacucguuauauuuuggugaccuuagcuuccauaucugauugaauuuuaaaaguagauuuuaccuucuuucuuguucauuuuauuauaaguuuuuauuguccaguggguaaaaccuuuccuccauguuuuccaguuaaagauauuaaggcagaaccucagccacuuucuccagccuccucaaguuauucagucucgucuccucggucaguggacucuuauucuucaacucagcauguuccugugaguagccagucuuuuacaaugauuuugguuauaauaugcuaucuggaaaauauguauauggaggaggcaguuaacauuuauugaauacuacuaugaguuauauugucucauuuauugagggaacugagacucaagaaagagccuugugggagcuagaaaguuguuagugccuuugguuuugcucucuuuuccccucuguucaugccuccauaauuucauuguuucauuuguuucauugcauuuuaacaguauccaguauuuguuuauuggcuuacuguccuuucucccacccuuucuuucuccucccuauuaggauauacauucuuuauauauggacauagaagaauguaagauggucaguuuuuauaucucuuuagucacagcaucuagaaugauugccuuaguuugggaaugccuagugcuaccuuuugaaggggcucacguuuuuauagaagucugguagcucuuuuaagaacacuucugcucuguguccagacaaaagcccugaggccaggaaaaggaaguaccugauuuagguacuuuuuagaauggggaaagggaaaguauaagaauaaaaaaaucaaauaauauuuuaguauauuauaugugcuauaaauugugguaucuuuguuccugcaggcucuacauuuaguuacuaaauccuggugguuauaugcacauauuaauucaaggauuuaucuuuucugccccugccaggccaucacuaucucaccuggauuaagucaauaggauuuuaacuggucagccuuacaacuccucaaaccuuucuuagcaguggaaucuucaaagagaaaucuuucagugucacaagcuuuacuguaucagucauuugcuuaaaacuuuuuaguaacuucccaguccuuacaaggaugaaauuuaaauucccagaguacuaggcuuuccaugaucuggcccccauuuacuuuuccagucucuuuucuugcuauccccuccuacuuccacauuccccuuaauuugagcccugugagaguuccucucugagagcuccuaugcacucuacucauucaaccgcugugccaggcacuguuccagaugcuggcagugaacaacagcagugagauugcugcuguuacaguucuagguuuuugcacauccucuuucuucugccuagaauagccccauuuuuuucuugucuuggaaaacucauccuucaagucccaguucaaaaacuacuuccuuuaugaagcuuuucucugauugcugcuauugguagcucucugaggucccacaauuucuccaaaugauuuaauuuuuuaaaaaauuaauaauuacaaaagguagcauacuguauacccuguccuguaccuuguuuuuuuagcuuagcaggauaacucuuaauuucagaguauauaauuuucccauuaugcuacauaauguuucauugcauggccuuaucaugcuuaauuuagugauuuccuuauugaugaguauuuguguuguuuuuagucuuuuccagacccaauuaaccuguacauaagucuuuuccagacucaaauaaccuauaguaaauaaccugguacauaagucacuuuauauuuuuaccaggauauuuuugggauauauuucaagaggugggauuguugacaccaagguaaauacacuugaauuuugcuagauacugccaaauuucucucuauagggguuguaaaauuuuacauccucaucagcaguauguaagagggccuguuuucccaucaucacuccacaauagguuuuguuuuauaucucuuuuauuauaaguaugguuaaauaauaucuauucauauguuuuauauguuuaaggccuauuugcauuucuuuuuaaaaaaugaacugucauuucaaauuuuuguucuuuuuuuuuuuuuggagaugaacucucucucuugucuaccaggcuggggugcaauggcaugaucucggcucacugcaaccuccgccuccuggcuucaagcaauucuccugccuccucagccucccgaguaccugggauuacagggauuacaggcaccugccaccacacccggcuaauuuuuguauuuuuaguagagacaggguuucaccauguuggccaggcuggucucgaacuucugaccucagguuauccaccugccucggccccccaaagugcuugggauuacaggugugagacacugcgcccggccguucauuuuuuaauugaauuguauuggucuuuuucucuuuaauauuuuaggugcuuuauuauauauuaggauuauuaguccuuaguuugugaaauaagcugcaaauauuuuuuccccaauuuuucuuuugucucuuugcuuuauuucugguguuuauuuuuccccagguguacuguuuucuauagccaaauuauugaucuuuucuuuaauugcuuuuuuguucacucaaaggaagguuuucaccacugagagguuauaaaauaauucacucauauuuuuacucuuuuuuuuugcuuauguuaauuuuuuguuuggaacaaucucaaauucacagaaguguugugaguaccuugcaaauaacuuguuuuuuccuuaugcauuucagaguaaguuaccaguccgaugccccuaucacuccaauacuuuagugucuacuuccuacaagcacagauauuucuuagccauaauacaagcacaaaaucgggaaauaaacauuaauauguuacuauaaucuaaccuucagcucucguuuaaauugugccagacaucccagagguguccuuuagacuaucaaaaggacccaguucagaaucaagcauugcaugugguuaucuugucuuuuuaaucuuguucaguaugaaacaguucuucauuaauccuugacuuucuucaccuugucacuuuuggggauuaggaguuaguuauuuugaagagcauuucuuagucggguuugucugauguuucuuuaggaucauauucagguuuuauaucuguggcaggaaugucacagaagugcugucuguguccaacuuuugaugacccaauuuugauuuuuucuaauacugauuauuuucacuuugaucccuucauagauguuaucugccaaccuauuccauugugaaguugcuuuuucucucuaugccauacauauuuugugagaaagauacuuuaagacuauguaaaaauauccuguucaucaucacacuuuauauuuguucacuuauuuguuaauaucuguauggauucaucguuucuuauuuuauucaacagauuauaauccguuacuauaauuauuuauucugauucuuacauuguucuggauuuggccagugggggucccuucacaccagcucuuauguucuuuuaacaugucuccuuugggcucugauguccuuacacuaggcugucuucccaugcggaugcccuccucacucugcugugacuccucaugccaggccgccugccauaucagugcccucucuacccuucuuggacccugacauuccaccaggcuacuucucugcguggaugguggucuugcuuuaccccaucuaguggcuuaggauaaaauuauucaggaaggaauauuuucuaagugacuaugaauaaguauuuaucaugagauauuauuuuuaguguuuagaucucggauccauuugaaauuacccuuguguauuauaugagauacaaauccaauuuuauguuuuuccaaaugacuaucaaaaugauuauucuaguaccauuuaucaaaaaguucaucugauuucaauuauaugcauguauuuuaaauuuauguaaauggcauuauaguagauaucuuuauauuauuuacuuuuaaaaaucagcacaguguuuuuaagauaaauuccuauugcucuguguacaucaaaucuguugcaucuaacucuguacaacauucaaguaugcauucacuacauuuuuaccuacaccauaaugaauauuuuaaaaaauguucccuugcggacccaugugagaaauccuuuagaauauaugccuagaauugcuggguaguagaaugugcagguauuuaauuugacaagugcuuccauauuucucuccaggaucaucauaguacucugugggcuggcagcagugccugaggaucccugugacuucucuccugauacuuggcauugucugccuuuuuaauuuuuacuccauggcacaauguguuuuuuuguuguuugcuuuuauuuuguuuuacuuuguauuucuuugguuauuguuuucaacauuuauuuacauucuuaugagcuuuuuggacuuuuuuucuuuuauacauuguuuauuccuguccuuugccaguuuuucuacucaguuguugucuucuuguuuaucagcaggaauuccucauauacuugaaauaguaaaacucuuguuggauuuagacauucaaauugccuauaucuuuucccuuucuauuaucuauuaacuuuguagucuuuauuaaguauaaauaguuaauuuucaauuacucaggcuuaucuuuuuuuuucuuuuccuuuauggcuuauuuaagaaguccuucuaugcuuuuagagcacagagguauucugcauuuucuuuuauuaaccauaugguuuaccuuucacauuuagguuucuuaauacucuuagacaccacuuuaauaugugguauuauguagggaucuagcacuagguagggaucuaauuuuaauuuucucuauaaaaugaaucaguuuuccuaacuguauugucuuuauaaucacuuguaaucacucuuuucaacaauauuguauaucucucuguuuacugaaaucuuuuaugccuuaguucaguuguguaguuuucuucauauggguccugcacauuccuuagaaaauuucuagguauuuuguaauuguuauugcuauugugagugaaauauuuauuuauuuguuuuauuuaaaucuuuuuuauuuuuaacuuuuuuuggguacaugguaggcauauauauuugugggguacaugagauguuuugacacaggcaugcaauguaaaauaauuagaucauggaaaaugggguauccauccccucaagcauuuauccuuuguguuauaaacaauccaguuacauacuuuuuguuauuuuaaaauguacaacuaagcucuuauugaguauagucacccugcugugcuauuaaauaauaugucuuauuccuucuccuuuuuuuuuuuuuuuuuuuuuuuuuuacccauuaacaauccccaucucacuaccagcuucucaguacccuccccagccucugguaaccauccuucuacccuauguucaugauuucaauuguuuugguuuuuugaucccacaaauaagugagaacaugugauguuugucuuucugugccuggcuugaaauauuuauuuuuuauuauguuuucuaaguguauauuaauacaauauuuucaagucaaauuuuuuuuucaguggauuguuacaugugcuucaaguauauagcauauuaccuugcuaaaaggcacgcugucucuuuuguuuuaauguuuuuuaaauuucuucuuuuaguguaauuauacuagaauuacagaaaaagcagguaucuauuuuuuauccugacuuuaauuguaaugcauucagcauuggacuuggcuguauaauuacugauagcuuuuuaauguuaagaaaguauuccucggauccuuguuuucuaggauuuuauugaggaauacuugucgaauauuaucaaauaccuuuuaagcaucaaaggccgugaagauaauagucuccucccguguuaccuuguacucuuugguuucuuggaaauguauuuuaauacacucuacauauugcucagcuuacaugcugaguagguguuaaggaugaaggaagaugcaauugucacuugucacucucaccagugagacugagagcauuucuuucucccauauccucucaaggucauuuaaauuuuuuuuuaugauaaaaaaaguuuaaauuugccuuugacuaccauuugcguuuccuuuucagugaaauggcuguuccugccuuuugucuauuuuucgcaaauauuuucuaccaauauauaucuuuuaacuuuguuuauggucuaguuuuuauuguuaaauaguuuacuuauuauuuguucaaaucuauuucuucuuccuuuguggcuucuguguguucugacuuaagagggucugcaacacccugagaguaaacaaguauucucuuaaauuuuauuuuuauauuauaaucuuauagauuauuuugaagauguuaugaaguagagauuaugucuauugcgugaucaugcaugccaucuuuucugucugaauugaauugcuacuucuauguuguuucuuuauucuaacaaaaugagauagauucacugaauauuaaaagacuuugggaaaaugcgaauguuaucuuuauguaucucaaucauuaugaauucaccuacuaaauuaaagaaaauagcacuguuggcuggguggggugguucacgccuguaaucccagcacguugggaggcugagguggguggaccauaugaggucaggaguuuuagagcagcccagccaacauggugaaacccccucucuaccagaaauacaaaaacuuagcaaggcgugguggcacacaucugugguuguagcuacucgggaggcuaaggcaggagaauugcuugaacuggggaggcagagguugcagugagcugagauugcgucacugcacuccagcuugggcaacagagugagacucugucucaacaacaacaacaacaacaacaacaacaacaacaacaaagcacugcuccauucaugcaucuuucuuuuacaacauuuggaacaaaggcaguauuacaaaauagaaaacagaaaagaauacaaauaaaauuauuuugcuuuugauauucuuuuaagaccaaauaagagagauuauggagaaaggauauuggcauuuuaacugcaaccuuauacugauacugaauguuuguaugacuacgaaccaaguuuuauaugugugugugugugugugugucucugugugugugugugugucucuguguguguguguguguguguguguguaguuuguaggaagaaauguagcaacagaucaaugauucauaucuuuaacaggauggcauagacuuacucugcauuuugaguuauuuuuccuuugguauagauggaucaugcugauagucacuuauuacuuaauauauauauacaguuucuaauauaccuuuccuuugaaguuacccugaaguguuuuucuguuuauaugugggucuccuccuuuucuaugcaauuugcugcuuaaggauuauacucauuaauuuuuguuuuuauuaugcuacaggaggaguuggauuugucuucuaguucucagaugucuccccuuuccuuauauggugaaaacucuaauagucucucuucagcggagccacugaaggaagauaagccugucacugguccuaggaacaagacugguauuacucuaucuccuaacuucuguuauuucuauuucagauugagcuuagguuccauuucuuaaaagaaaaugcuggauuaaauuuauguuuauuaggcuggcuugcuguuuuuuaauugguggaccuauauuguuuguugugagugauuaccguggagaggaaaggggagaaauaaucuuugguugucucugucuuuacaggugaaagauacuuuaaaauagacucagaccccaccaucuucaggagagauuucaaaguuucaguuaaagauaacugaauggagcuaugacauuuguuaccucauuaaucucuggguguuaucccgugauuuuagcaauucuccuuuaccaguuagugugucccauucccaaaacugcagcuugguuagaaaaggagguaacaguuuaaguacuuuucuucaguucauucagguauauguacuguagcuaugcuuaaacuccaguuaaagauuguuaaucgaaguuaagauaauguguagagaaaggugugugauagaaucuguuuuuuagggcuugcguaauugcuuucacauugacuugugguuugucugguuuuucuccagaaaauggacugacuccaaagaaaaaaauucaggugaauucaaaaccuucaauucagcccaagccuuuauugcuuccagcagcacccaagacucaaacaaacuccaguguuccagcaaaaaccaucauuauucagacaguaccaacgcuuaugccauuggcaaagcagcaaccaauuaucaguuuacaaccugcacccacuaaagguaccugagcagaauuuaaggcuguguaaauuuauuuggagggcaguaaggguugugucauaugauuuguuuuaauucagguuauaauuucugagcacgugcuguuugucaggaaugucuuugguuaugaggacguugcagagaugacuaaugugugguuccugucauaacaagggauauagcucuccagaccaguuacaucugaugguuauuuugaaaaucugggacacuuucuuggugccauuuuauucugguggauaaaauacaggaacacaaauuuuaagcuaguugaaggcagaguucaggucagccagauuuuuguggcugugaacuuuuuuuguuuugaaggaauauuuaaaauaauaggguccauuucagguguguuauagcaauagaaucacacccuuaaucucugaggaggcugcaugguuuaguaaacaguauauugaccuggucaugaggagaccugaacucugcuuucaacuagcuaagaauuuguguguuucguauuuuauccaccagauggccucauacacuugugauucuaugagagguuuaugucauuauugaaagaaguucaagucugaggauuugguacuauucagauaugggagucauuuccguauggagaucucuuagguagauuagucaucauuguacucauacugauaucuguauacacuggguacaagaaaacuuuugcagcauucuuaucucuggauuuaguuuguuggcaccagauaugacuaggcgauaaugggguauggguuguaaauaaacaccaauguuacauuuguacuguaucuccaauugugaauagguagcucguuuuuuggagcauaguuuuaaugaggguaaauuugauaaauuuaauuuccagauacucuuuuagcuuuguucuauuacauggucauagacaauaugacauugauaaaaagaagaccuagaugagagaauggaugaaucagugaaaauucauccaucagucccaccaaaaauaaacagacaaacaaacaaacaaaaaccaguuugaaaugccugcucucucaguacaaagucagaacugcugccuuuuccaucugaaaaguagcauuccuauagaauagguauucuugugauuuauaaauguguauuaaggguucaugaacuccuugaaacaaaaugcaggauuuaauguauguucauauguggauuauucuagggauagucuccaaaacuuucauuaggaucucauaaggaucugugccuucccaaaggcuaagaauuuaaacuaaugaagaaccucauuguaguucccauaagcuauuaaaauacgucuauacaaaaagucugacauuaauaugacuagcguauaaagcagggguauuccuaagaauuugcccuuagcagaucauugacuauguuugagugauggaagaucuuaccuauaauaagaagacaaacuguucuuuucugagcaguuuaucaguuccagaaaccugaauuacacauuauuugaaacuucaauacuuuccugucaucugaagacuauaguuauuuuuuugugagcaugugcuaauaugaggaacugcaccuugccuguuuuuuuucuuuuauuugagacagagucucgcuguguugccaggcuggagugcaguggugugaucuuggcucacugcaacuuccaccuccuggguucaagugauucuccugcuucagccuccagaguagcugggacuacaggcacgugccaccaugcccagcuaauuuuuauauuuuuaguagagacaggguuucaccaugucggccaggauggucuugaucucuugaccucguaaucgccugccucggccucccaaagugcugggauuacaggugugagccaccgcgccuggugccuugucuguuuuuauaguacaaucuaaauaggugguauuauuauaauaacauacagauuuaaaguauguuuuucauuuauuugagaauggggaggaagaagggaaguaugggcaagacauuauacaguuaaucauguuaauacuaguaguaaauauguuaccauugaaaaagaagagguaauuuccacagguuuaagacugagauucucuagcuuggaauguaaaacucuucacaauuuggcucuaguuuaguuuuuuguuuuuuuguuauuguuguuuguuuguuuuuaauagagacaggaucucacuauauugcucagucuggucucgaauucuugggcucaagggaucuacccaccuugaucucccaaagcucugggauuaaggcgugagccaccaugccuggccuccuaguuuaguuuucgaacuuuauaauauuacucuuuucuauaaaucccuucuucuagcucaacuaaucugucauuguccuuugaauucucuuguuuuuccuaguuuuuuggcucaccauuuucuaccaaccagcaacaacuuaugccuacuucuacuucucaguccuccauguccuuuaagacuguuuugaguaguguagaugagagauaaugaaagccuggaauaucaaugaaaguggagaaccaggaugaagaguagagauguuaaaaguguagaaucuuagagauugguaauuggauuguguagaaggaggcugaacgauagagaggaaggugucuaggaugacuuccguuuuucuaucuuggggcuuuuuggguagaugauggcgaaaauuauugaaaugggagacagagguaaaauauguugcccagaucacucugcuaauaagaaguggagccagaacuugagcccagguggucuggcucggagucuaugugaauaaucacuauacuguaucgccuuaaaaaaaaaaugacagauguauuccuugcucucaagaauucuacacuuuaauugggggauuaaauucacauaaacaguuaaauaacagucacugugauaacuaauaaauuaauaacucaugcagugcccuuauggaagcuauuauuauauagaaaaggagauuaauaauaauaauaauugcauuuaaguucuuacuaugugccagacacucuucuaagugcuuaagugcauuaucuuauuucaaauaauauuuacacauuauuugaaacuucaguauguuucuaugauuuauggugauggguugugauaucuccauuuuuuagaugagaacgcuaaguacagauuauuugcccuaagucacacaccgaugcuguuucagacaaaguaggcauucaauaaauguuugauacauaguuuaaaaucuuugaagaaaguuuaaaagaaagaacuaucaaaaucagugaguuacacauagucaaaaaaauauauggcauugaauccagccauguuccguuaagggggauuugcauguaaugccagagaggauuuugagcaugcuaaaauggauaaacagccuuuggaauguccuuuuuaacuguuuccacacuaggaacaguaguaacuauguucagcugcuauuuaaggccccaaacaauucuuugcauuguaguuuguggccuggucagcauuuaccaagucaccaugagaguuuuuuguucuuucacuugaacauauugucauagaaauuuaguuguuuccccucauucuguguugaacccaaacaugccuagaauauuuagaguaucccugauuuagcugcuggguaauuugaggauaguuggguacucugggaugaaaaggcuugauacaauaugggaaaaaaaggaagcagcaguggcuugguaggacucaagccacauuuggccuugccuugguauucuuccaucuccuuugugugaugcggucgucucagcaaggagacagugguaauuacacaauugguaguacagauuuggauuauuuuucuuaauuaguuuaagaaauauuacaaagcccucuguacauguuaucugcuagggcuuuaaaucuguaacuguagcuagaaauaggauucuuucuuauaaguugccuaauucauuauauuuacaccucuucuguucuuuaaaauagucccaaaguucccugaacaguguuuaauuuuggggagggaucuuuuaaucauaauuuuaaacucagaggauguagaacauggcuuccuauaauacucuucucaaaguauugguuuaagucagugguucucagucuguauauuguggacccugggaugugggugauggggguaguagcuuuauggcauuuugcaaagcaucugcaaauccauacuugaagcaagcauuuucuguagaccaaauaauuuauuucauauaucuuuguacagcucuucaaauuuuuauagcuauacuucugacuaauaaacuccaaguucauuuuaaaucuucacuaaauucuuagcagccuuuuuccaucauguauuuucucaguacacagaagcugaaaggacaaccuugaugguuuugggugaccaggauauuauuuuauauuaaaagagagcccuuauauucaggagccuuuggggagagacuauggguuuucuagguguagaauuauaucaucugugugagagaugguuugacuuccucucuucauauuuggaugccuuuuauuucuuucuuuugccugauugcucuggcuaugacuugagcacuugggaauucuuguuuuuugguuuuuuuuuucacauuaugauaaauauauauuuucauagugccagauuuacuguaauuucuuauuguuauuaaaaccuaacacuuggucauaugcuauuuacuuuauguguuucuaauuuuuauuugcguauuuggccuaagcauguuuauaucugcuucugaguaauuucugcauuuuauauguuuuuacuucauaaaagauggaggccaccucaaaacaaauuaggcaucaaaggaacauaccucaaaauaauaagaaccaucuauagcaaguccacagccaacauuguaaugagugggcaagagcuggaaguacauucccuuugagaaccagaacaagacaaggaugucccucucaccacucauauucaacauagugcuggaaguuguagccauagcagucaggcaagagaaagaaauaaaaggcauccaaauaggaagagaggaagucaaacuaccucucuucacagacgauaugauucuauaccuggaaaacccauagucucagcccaagacuccuagaucugauaaacaacuucagcaaaguuuuaggauacaaaaucaauguacaaaagucagcagcauuucuauaccccaguaauguccaagcugagagccaaaucaagaaugcagucucauucacgauagccaaaaaaagaauauaaaguaccugggaauacagcaagcuggggaggugaaagaucucuacaaugaguuacaaaacacugcugaaagaaaucagagaucacacaaacaaauggaaaaacauuccaugcucauggauaggaagaaucgauaguguuaaaauggccauacugcucaaagcaauuuacagauuuaaugcuauuccuaucaaacuaucaaugacauuuuucacacaauuaggaaaaacuauucuaaaguucacauggaacugaaaaagagccuaaauagccaaagcagcccuaagcaaaaagaacaaagccagaggcaucaagcuaccugauuucaaacuguacuacaagacuacaguaaccaaaacagcaugauacugguauaaaaacaggcacauagaccgauggauuagauuagagaacccagaaauaaagcugcaccccugcaaccaucuggucuuuaacaaaaacaaacaguggggaaaggacugccuauucaauaaauggugguaagauaacuggcuagccauaugcagaagauugaaacuggauccuuuccuuucaguguauacaaaacccaacucaagauggaugaaagacuuaaauguacaggcucaaauuauaaaaacccuagaagaaaaccuaggaaauaugguucuggacauaggccuugucaaagauuucaugaugaagacuccaaaagcaaucgcaacaaaaacaaaaauugacaaaugggaucuaauuaaacuaaagaggcugggcguggugguucacaccuguaaucccagcacuuugggaggcugaggggugcaucacuugagaucaggaauucaagaccaaccuggccaauauggugaaaccccaucucuacuaaaaauacauaaauuagccaggcauggugguacaugcuuguaaucccaguuacuugggaggcugaggcaggagaauugcuugaacccaggaggcggcaggugcagugagcugagauugugccacugcacuccagccugggugacagagcucaaaaaucaauaaauaaaaaucaacuaaagagcuucugcacagcaaaagaaacuaucaacagaggaauaggacagccuacagaaugggagagaauauuugcaaacaguguauccaacaaaggucuaaucuccagaaucuacaagaaacuuaacaagcaaaaaacaaccccauuaagaagugggcaaaggauaugaacagacacuuucaaaagaagacauagacauggccaauaagcauaugaaaaaaugcucaacaucacuaaucauuagagaaauguaaaucaaaacaacagugagauaccaucucacaucagucagaauggcuacuaucaaaaaguugaaaaauauccgaugcuggcaagauugcagagaaaagugaaugcauauacauugcuggugggaauguaaauugguucagccacugaacguaguuuguagauuucucaaauaacuuaaaguagaacuaccauuugacccagcagucccauuacuggguauauacccaagggaauauaaagacacacgcacacauauguucaucacagaacuauucacaauagcaaagacauggaaucaaccuagaugcccaucaguggugaacuggauaaagaaaaugugguacauauacaccauucaauacuacacagccauaaaaaagaaugaaaucauguucuuugcagcaacauggauggagcugaaggccauuauccuaagauaauuaaugcaggaacagaaaaccaaauacuucauguucugucuuauaagugggaguuauacauugaguacacauagacauaaaaaggggacaauagacaacaggggcuacuuuugaggguggaggaugcaaggagggugagaaucuaaaaauuaccuguuggguacugugcucauuaccugagugaugaaauaaucuguaugccaaacaccugugacaugcaauuuauccauguaacaaaccugccugucuacccccugaaccuaaaauaaaaguugggggaaagaaaaacugaauccaagggaaaacgagaagguaaaaauguuuaaugaucauuuaugccgaaguauuaauacauuguaucuacuccaaauccaugaaauuauuuuuagaucuucuuaucugggauaaaaugcuguuuauugaaauucugcuacuuucaguguguuuuuugaggccaucugaaacaagggcuuugcuuuuauaaguuaucuuuuuuagccaagacagauguucuugacaaacagguguucugaagcuuuauuuugauuuuuaguuuuccccgauccuuugaaauauugagcugaguuuuacaugggucaaccugucugaaagcauaaugcuuuuuuuuucuuaaacaaauuauaaauuuacaugauauuuuaguugccaguuauuuuaguaccuucauuuuguuagauaggcucaagcagcuguggauguuaggcaaggcuuucagcaccuuauaaaaaucugccagaucugaaaggaaacacuuagcaggcaaguaaaauuuuuaauagauuaguguuaugaguuguauaagucuuuagguuaaugguacagguuuaguaccccuuaaaugaaaugcuuggaaccagaaguguuucagauuuuggguacuuuuggauuuuagaauauuugcauauacauaaugagauaucuuggggacagaacccaagucuaacaugaaauucauuuauguuucauguauaucucauacacauagccugaagguaauuuuauauaauauuuuaaauaauucucugcaugaaaccaaguuugcauacagugaaccaucagaaagcacaguugucacuaucuccuguggacaaucuguaguuguuuggcaccaccaucauuccuggcucugaauucauaugcuacugacaagcaaucauuuucuuacacuuauucacaaauucacaccuaagaacuuaacaaaaauuaugacauaccauuaauacagugaaaaaauaaugugugcagaguaacaaggcaggacaguagaaucaccagaauaccagugucagcuacuacacaacagcaacaacaaaaaauggcagcuuucagucucugccuuugaugcuguuuucauuaaaagccuacuguacccucuauuuuaugucuucaggugagaagaaacaucagaagcaguugagagacuggaaguggguccucuagggaugaggaggcauucugcuggaugacuucuaaaaauguuuucuauggagucaucugccucauuaacaaguuuuuguuuuagaagucucuuuuugauuuuguaaacugacaugauuucuuuuucuguuaugacuguaugcugcuuuaguccuucacuaggcccaucacacauuuuuaccaugucaucuauaggcacuuuuucugcagcguuaacagcaucaucuucauugucauuauuauagauugaguaucccuuauccaaaauacuuaggaccagaaguguggaguuuuccacuugugaaguugugucagcacucaaaaaguuuuggauuuuggagcauuuuggauuuuggguuuuuggauuaaggauguucaaccucuaauaauucucgucagauuagcauaaauuuaaaauaaugauaccucugaauacucagaaaagaauugaaggccauuuuugggggaagagggaaagggcugguaucaucuacagacuauuuugaaucacagauuuauguuuaccgugauuguuagcuaagauuuaaucucaaaugguuuuaaguuuuuugguauuuguagucuuuuuuuuuuuuuuuuuuuuuuuguccuuuuuagggaucugccugccucagccuccugaguagcuaagacucgaggcacauaccaccauaccuggcuaauuuuuaaauuuuuuuuuguagagacaggcuaucacuauguugccuuggcuggucucaaacugcuggccucccaaagcacugggauuacagguguaagccacagugcauggccuguagcuccuucuucuucuaauauugaguuacuaaguuuauguucagauauuuuugguauuguaugcauuuguaaauccuauuaauuuagaauacaugacucuccauauucaguguaaaagauuuguuauuuauaauaagacaaauccuuuuagcacuaauaaauuucagagguuaauucuuagaaaucuagggauuacagcaaauuugauagcuguuuaguugagaaagauaaauaagaaaguauauuaaaguauauuguuaaugauaacucaaagagaugaauuuaguuggucacauuaaaaacauaacaaagucaccauaagcgugugcugcuauugauccaauguuuuaauugaugguguccaaucccuugguguugaucuuacccauuacgucugcagaaaagaccuaauuauaagcugcuuccccugccacaguaguuguguacccuuugauuccuuuucuuuuuucuaacgcaggccagacgguuuugcugucucagccuacugugguacaacuucaagcaccuggaguucugcccucugcucagccaguccuugcuguugcugggggagucacacagcucccuaaucacguggugaaugugguaccagccccuucagcgaauagcccagugaauggaaaacuuuccgugacuaaaccuguccuacaaaguaccaugagaaaugucgguucagauguaaguuuugaaacuuagugcuucucuuaaugccugauuuaaaaaccaacaaaaaaacaccuuuugcuuuuguugccuuguuuuuguuuuuuuuagaguuucuuauauugcaucaaauaaaagagugugcugaauugcacaucuagucuuuggaggaaaauuaggguaaggcuuacuacguuagaaucuaagugaaaagguuuuugaaagugaagugguuugaugaaaagcaaaguaugcauaccucccucuucuuuacuccuucuuuagaaccaacccucuuauuauucucuucaagcccuuacacccucaacccagucauccacuaauauuuuacagauucaacguuuccugauugaaauguuuuagcgaucuucagauaagagucuauagauuacuuuuuagguagguuuuauauuuagcuuucuuccuugccguuuugaaguauuuucaccacuucauaaugaugacuagcuacucuuaggaauucugucucuuagugauuauuugguacuuucccauuuuugcaaaccuuuaaauuuucuagcauguuguagggauuucuuauaauuuauaaaucacauaguuuccuaagaccugucacucucuaaagccaguuacugcacuugccaacuaacucuugcuuucuuucaaaaugauuggaaauaacuuauguauuaaauugaacaucuugguccuaaaauuuaaugaauguuaaagcuauauagucaaacaguggauucucuaaaguuacgauugggaaagcaaaguguguauguuuucuuuaaaauaaaaauggauacuacuaguuguuaauauuacuacuucauccuuucuuuagguagaaugcauuugaaaaguaauuuuaaaauccuguggguuaugcaagguuguuuaucagacuacugucugaucugucugccagaauuuauuaaccagcaugucagugacccauuuaauuauaaaauugcuccacaguugcauaaacaguaaucucagccagcaauauuguaaaaauucauaacaaaggaauauugucuggugaaaguagaacauccaguuucuagaauaagagucccaucguuuguauagguauugaaaacaaugcaugucaagacauggaauaggaaaauuaguguugcuaugagacuagagaccauggacaguacaggauuaggcuugacuguuauguugguuuguuuugaggacuagaagagguaagcacaaugcuuauggcauaauaggcucuaauacauagcguguguuucaguugaagaugaaacaauguugcugggaugggaagguggugagcacaggauagaggcaacuggauuggcaaaauguugauaaugauggaagcuggguguuuauuuuucuauccuuuuggugcauggaaaaauuucuacaauauguuaaaaaaaugacaauaacaaaaauccaaaagcuuucugugauauuuucaauuaaaaaguugugugaccaauaagaaaagaguaugauuuucaugggagaccaaccagguuaagaaugaugaaaaaggauuuuuaaaaauaaugcuuugaaauuucuuuuuuuuuguuuuauuauacuuuaaguuuuaggauacaugugcacaaugugcagguuaguuacauauguauacaugugacaugcuggugcgcugcacccacuaacucgucaucuagcauuagguaugucucccagugcuaucccuccccccuccccccaccccacaacaguccccagagugugauguuccccuuccuguguccauguguucucauuguucaauucccaccuaugagugagaauaugcaguguuugguuuuuuguucuugcgauaguuuacugagaaugaugauuuccuuuuaauacucuuuuaaauuaugaacuugaauguuucuuauauaauacccccaaaugaaacuuauaauagaaaauauccaaaguugccuuuauguaauauguuaggacauuuaaaauauuuuuaugaaauauuuuagacaugaaaaaaagauaaagacuaauuagaacuuuaaaaauacauaggucaacaguauaucacuguuguuaaaaaauauuaacaauauuaaucuaagucaucccaaacauggaaaaguccagaaaagcauagcuaggauggggagaguaucuagaaaccaugggguagaggaguggguuaaagguuggaaugauucaguaaacugaagaagagaggauggaaaguagaccugggagccaucuuccaggaaaggaagguuguuauguggaaaauagaauuguucugcuuguuccagaagaguuaucuggaacaggugcaggaaaaauauagaaagguuucuucuaaacauaagguuuuuugauacaaucauuguauuuaaaaaccagaagagcaaccccccugccuuuuuuuuuuucuacuuuuaggcuuacuaucugaauaaugagcaucuuaauguugacaaucaucacuguaugccauugacccauuuuauaaucucuaaacauauuccaauuaauuauauguuggucuauuagucagacauccuuuauuaguucucuggugugaaagacugugucuguucagcuuuuguacucuuaagggggaucuguaaauuuaaaguauuuuuaaugaaauauuuuagacaugaaaaaagauaaagacuaauuagaaguuaaaaaauauauaggucaagaguaugucacugcuaaaaauaugagaaaauguagaaccaauaaauacugcuagaaacaaaagcuaauacuuauugguucuauguuuucucaucucacacaucccccaguucuucaacguuaauugagacuuugucagcaaagucucaauguaugaaugucuacauuuauuguaugaauguauauucagaugagguuaauuuuuuuaacaaugauauaccguugaccuacauauuuuuaaaguucuaauuagucuuuaucuuuuuucaugucuaaaauauuucauuaaaaauacuuuaaauuuacagagcccccuuaagaguacaaaagccaaacagacacagucuuuuugaaguuuagaauugacaggauuauaaagaaagauucaaacacuuuauguuuaaugcaaagagaccuaaggacaauuagaauaauuuucuagucaaccugcauugagguuuuugugcuuauuuuuacuuggccagcacaucgagacgugagccaagccuuucaauaugaguuuuuuugguagaaauuuugacugaauguuuauuucaaguaaagaagcauuagucuguccuagcagcaggccaacccacucaggaacccaaaguaaaucuguuccagaaggaguugcagagaagaacuuugaucagcuuguauagccuucuguguuaguaacuugguugaccucaguauuacaugugucuguuaaaacacaaguccuauuaaauuaggauaaauuaauauaaauuccuaauuuaaaaugaucaaaaaaauauuuuuuaucauauaccuuuugugccuuuaaaccaaaaguauggugaaagaauuguaauccaccaaaaaaaaaaaaaucauaucaguuuuuuuguggcuuuguaaugcugacauggcuucuuuuucuaccuuuuuuaguucuuuuguuuggcugguuucacucuccagaggccugcuacagccauaaguagcguuuuuagcauaccauauucugcaaacugcauuaaaugccacauuuucuguuaugaaacaguuugccugguucaaauuauaucuuacucuuccugucuuuugcugguaaaucuguuuuguuuaacucuuggagaccucaccuaaguuuucaagaaauaugguuuguuuuuggcugugauccugauggaaaaaaugaacaugaucucucauuucaguguagaaguucucugugcaguuucuuaguaaauggcaaucuuggaacuacaaaguugacuuuauaggacagcaugcuuaucuuucuuuaaagggcuauuuaguguugccacacaucaaaccaagggcuuaaaaacaagcagucuguuuaaaucugcauuacacucacuacuuccaccuacccaucauaaucgcauaaacuuuaugaaacauuacugcccuuguuuuaagguuauaggaauuacauuguuuuaguuauuggaacaaaagaccagaaaaacaagugguaaaauucuacaucuuccacagugggccacauuggagcaaauacucuuaguggaaaucaguaggugggaauaauggaaagaaaaguauccagaacugauauagaacuauaaauaaccucagaugugagguugaugaagggauacaaacuacuguuaggagucuccuuccuuccggcucagucaccccacugaauaucuuccaaacucuguaucaccuuuuacccuguuucuaaauccuauaguuaggaaacuugaucccuuccaucccaaaaugacuucccuuugggagucccugucuuggguuccuagagucaucaugagaagguaggugcuggggggaauccuuugcuacugguuugcagguauuagaaauggugcgaaggggauucuccugucauaccaaauuagaacuuuguauuuccuuucucuagaauugguguacaguuaauuuagggauuucagguauuuuuaguauuguucuaugggagugaugugacaugggccuagauggaugcccugcacacaguguuccucucuugcaguggaggaacaugagcuuggagaaucuaccauguguauagcaagcagaaagcaagccuccucauugucuagagggagauuuuaucucauccuucaagguugcuuguuggaaacugaaccuugagaauggccugggaaaagagugguccggaccuugcauucuuugcauacccaauaagacguguaggagcaaaacucauaagagacucccuggagguguguuucucaagaaaaauaugucuauaauaaucuauuugcaaugcauagcaacucagaaaaacagagacugccuauguucuauuucagaaaaaaagcaaaacuucaauagacguugaaguugcuuaucuguaacauccaagaauaggacgcugguuaggucaaaaugugagcugaaucuccuuaaauuauguggcuagcuuagaucucagaagauaaauaaugaauaggcacuucuuaauaacuucuaacaacaaacaaguugagaucaugauauuucuuuaggcugcaaaguagaggaaucuaucagaacaaauccaauaggaaggauuuggagagcuggaguuauccaggguuuaguaaaaaaauuacuucugugcugacugcauuguggcuuugcugcuaccagggacucugcaaauaaaagaaaauaugcuuuguuuaaauauuugcaguaucucuuuaaauguagguuuggagcuucuaaaaauuuaucuugaauagcaguucaguuucauuugagguuacaguagcuuuggaaggggaagugaacagcuuuuuuuuguuguuguuuauuuuuccuuccugaugcauugcauuaggauaaauuuauguuguggcaaccucagcauucuuuauucuguacuuuuuguacuuuuuaguuugucaucuuuuuuuuuuuuuuuuuuuuuuuuuuuuuuuugagacaaagucuugcucuguugcccaggcuggaguacaauggcacgcucuuggcucacugcaaccuccaccuuccagguucaagcgauucuccugccucagccuccugaguagcugggacuacagcuaugugccaccacacccagcuaauuuuuguauuuuuaguagagaugggguuucaccaguuuggccaggcuguucucaaacuccuggccucaagugauccaccugccucggccucccaaagugcugggauuauaggcaugagccacugcgcccagcaguuuggcaucuuuauaagaauaauaaauaauuauuuuuaaggauucugauuuuuaucuuaauaaacaaugaaauacuucucucuccuuucucuaauuucccuucucaaaaccuuguggggacucauucuagggagacaguccuuuuauaccccagagacuuucuugcaaaucaguuuccuugucugguagucauucuuacuaguuuugugugcauucuucuggagacaguucuuuaauauguaaguacuuauaguuuuauuuauugaccuauuucauagaaaagguagcauacuguacaugucauccugcaacuugcuuuucucacuuauaccuuagagaucuguucagaucaguacuaaaaacuuuucucauuccuuuuuuaaauuuuuauuuauuuauuuauuuuuuuaaagacagucuguugcucuguugccuaggcuggugugcaguggcaugaucauagcucacuauugccuuaaauaucugggcuuaagcaauccuccugccucaggcuccugaguagcuagaugugugccaccuggcuaaauuuugauuuuuuuuuuuguuuuuguagagaugggggucuuguuguauugcacaggguggucuugagcuccuggccucaaaugauccuccugcaguggccucccaaagugcugagauuacaggcauaagccaccaugccuggucuuuuucuuauucuuuuaauagcugcauuuuaauggcuacauaguaaccuacuucauaggggugccauaauuauuguaaaauuuugcaguccuuuucauuauaaacauuucuucauugaauaacuugguacuuauuucauuuuguucauauacaaauauaucuaugggagaaauuuuauuuuauuuuuauuauacuuuaaguucuaggguacaugugcacaacgugcagguuuguuacauauguauauaugugccauguugguguguugcacccauuaacucgugauuuacauuagguauaucuccuaaugcuaucccucccaccucccccaaccccacgacaggcccuggugugugauguuccccuuccuguguccaaguguucucauuguucaauucccaccuaugagugagaacauguguguucgguuuuuuguccuugugguaguuugcugagaaugaugguuuccagcuucauccaugucccuacaaaggacaugaacuuauccuuuuuuauggcugcauaguauuccaugguguauaugugccacauuuuuuuaauccagucugucauucauggacauuuggguugguuccaagucuuugcuauugugaauagugcugcaauaaacauaagugugcaugugucuuuauagcagcaugauuuauaauccuuuggguauauacccaguaaugggaugguugggucaaaugguauuucuaguucuagauccuugaggaauugccacacugucuuccacaaugguugaacuaguuuacaguccuacuaacaguguaaaaguguuccuguuucacuacuuuguaaugauugccuguuuccugacuuuguaaugauugccauucuaacuggugugagaugguaucucauugugguuuugauuugcauuucucugauggccagugaugaugagcauuuuuucaugugucuguuggcugcauaaaugucuucuuuugagaagugucuguucauaucuuucgcccacuuuuugaugggguuguuuuuuucuuguaaauuugaguucuuuguagauucuggauauuagcccuuugucagaugaguagauugcaaaaauuuugugggagaaauuuuuagaauuggauuugcugggccagaagguauguacuuguucaguuuugauagguuuuaccaaaugguccuccauugagguaguucuaauugagaagucagucacagggcuuaauggaguccuuggguggguuucaguguuuccauaaucagcauccuauauuagucaguucucacacuucuauaaagaaauaccugaaacugagugauuuauaaagaaaagagguuuaauugucucaugguucugcaggcuguacaggaaacauggcuggggaagccucaggaaacuuacaaucaugacugugggugagggggaagcuggcacaucuuacauggcuagagcaggagaaagagagaaaagagggaagugcuacacacuuuuaaacaaccagaucuuaugagaacuuacuaucaugagaacagcaagguggaaaucugccuccaugaucgaaucaccuuucaccaggcuccucccccaacauuggggauuacaauucgacaugagauuuggguagagacacaaaucuagaucauaucacaccccuuuaccccaccucaccucaucccucauauaguuguuagcaaugugcaagugcauuugucuggggaguccauaagcucuuuuguugucuuuuuuuuuuuaacagcuucauugagauaaaaugcacauuacauaaggaucacccuuuugaacuguacaauuuagugguaccaucacugcugucuaauuccagaauauuuuugucacccuaaaaagaaaaccccauagucauuagccauagucuuuccucauuucucacucccugcagccccugguagccauuuaaucuguuuucuguguggaguugucccagacauuucauaugaguggaaucauacacuaugugcccuuuuguguauggcgucuuucacuuaccauauuuuuuucaagcuucagccauguugaagcaugugucaguguuuauucuuuuuuaugacugaauaauauucuauuauauggauauaccacauuuuugauaauccauucaucaguugguagacauuuggcuugucuccacuuuuugucuguuaugaguaaugccacuuugaacacucauguacauuuucacagucuuuuaagaacgauuuuuaauauauagaguauaaaucagugagaaaaaugcaaauuaauucaaccaucaauggacaauauauacgaauagauaauucacgaagaagagugguaaauuuuaaaaaugaaaguaucaauggcuguguauuccugaagggauauucccucugaaagauuacuauuuuauaacuaugugaaagaauauuaauuguuagcaggagagaucuuguggcugguuacagguaguucgagaaugauauucaagaauuuaaaguguuaugguuagacuuuucuguggcucuuaccucccuugaguaugagaucuaaaggaaaaugucuuauggcuucuuauaacuucccaguguguauacacugcgguugugugugugugcugacacauguuaaacuuugguuauuguauggguacacauguuaaacuuuauauuuaguuauaauuuuaaauuucaaaaaguacaaaaacaaaaaauaguacagagaacacccagguauucuucagccagauucaccuguuguuaacauuuuacccaauuugcuugcuuauucuuuaucuaccuaccuacccauccauccauccauccacuauccauccauccauccauccauccacuauccauccauccauccacccacccauccacccaccauccaaccauccauccauccauccauccauccauccauauacacacacaauuuuuuuccugaacuauuuuaggguaaguuacauaccucacaguauuuuaccccuaauuuuuucagugugcauuuucuaagacuagguacauucuuuuauuaacuucaauaauuuacauuaauaaaauaguucaaucaccugucaauauuacaauucugucagucgaccaaauauuuacuggauuuucacaaagucuuugugaaggggacauuauuuauucccauuuuacuacugaaggaaucaacuagcuaagugauucaacaaaugucauauugcuaagauggcuaauauuaauaaaguacuaugugccaggcacuuuucuaagugcauaacuuguaaauacucucuuuaaaucuuauaacagcucuuugaaaugaaucagggcccugaggaauacagaguaaggaacagacagagugcucagaggaauguuaaguuuuaggcucuuuuucugcuucuuuagugauuaaauaacauuucaugcuuuguguguguguguguguguguguguuuuaauuuuaaaacuuaaaaucugaaaaugggagcuggaaugggagcagguauuuucuuuuuuuuuuuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuguauuuuuaguagagacgggguuucaccguuuuuagccgggauggucucgaucuccugaccucgugauccacccgccucggccucccaaagugcugggaucacaggcgugagccaccgcgcccggccaggagcagguauuuucaauauugcuuuaguugcaugguauaucagagcagcugugagguacauuguugauggaaguaauaauuuugccuccucugugugugugugugugugugugugugugugugucacauaauuuuccugaaagccauauuuguaugguacauuauagcuuacagagaaccuucaugucuguuacacaguugauucucaccccaaucauuugaccacuuauaauugaguuaggauucaagccuagcucaauuauaacuggucuucuccuaauccaguggugucaucauuacucugugcuccauuaauagagccuuuacuuucaagguaguccugaugcagcucagacuuuaaauuacccacguccuuugcuuacaacuuuaugggaaaagaaaaaagaaaaaaaaagaacaaauuacccaagucucgaaacuugcugauaccuuuuuucucccuuuacaaauguuuuuucuuaauuuauaaaaauuaagauaguuuuaagauuuaauuuuuaaaaauuaagguagcagauaguuuuaagucaugagggacaaagguuuagaaagauugaccuuauuugaauaauuuggugguaucaaaugaaaccuguagcaaaaauaaucagauccauauuucauuauauaguagucauuauugugcuaugucguugugccaauuaaauuaaguguaucuauuuagcaucagccccagaauuauuuuguuuuuggauuggaugagaccuuuagaggacuaaugaaguggcuuuaaacuuuuuuguacacaguccacaguaagaaauguauuuaaccucucuuucucucuuauacucaaucucaugaaacaacucuuacuaaauauaaugcacccuuuuucuuuuauucuguccugugcuuuucugucaaauuguuuuugaaggcuguggugauuuacuaaauugauaaaccugauauuggguuauaauaaugucauaagcacuauucuggucuaacucucucuuuuuacuaauauguaaauacacccuacaaggugacgugauuuauuuuuauuuuuauuuuuagauuuuccaauuaauucauugcaaugcugggccaagaauuaaggacuccuaacuuccaauuuuguauuuucauuuaaugacuuaaauuacuauuacuuuuauuuaguugcaucaaguauuucuuuucuuucuuuuuuuuuuuuugagauggaguuucacuuuuguugcccaggcuggagugcaauggugugaucucggcucaccacaaccucugccucccagguucaagcaauucuccugccucagccucccgaguagcugggauuacaggcaugcaccaccacucccagcuaauuuuuuuguauuuuuaguagagauggguuuuuuccauguugaggcuggucucgaacuccugaccucaggugauccgcccgccuuggccucccaaagugcugggauuacaggcgugagccaccgcgcccggccuccaucaaguauuucugaagacacgugaagcaguggagucauuaacugaaauaacaggaaaccauuuugaggcuccuuugaagaucccuguguucaggacuugggucccucuauucuucaagaggcugugcccaugguguggcuuugcugagagcaucuggugcauacuucugcuuuuaccucucuuuugguuguucuuuaucuucauucagaagaugagauugguaggguuuccccauccuauaaccuagcagggacuuugucuauuaucuguucucauucuggaaacuauacuacauaucagaaggcauucuucauuuuaaaaaauagaaggaaauaguuugcaggaugaagauuauuuccuugauaaucugccaaauaaaugguucagguugccaguaugaagcuucuuuaauuuuuggcaaaugggagcugguuauaugcauacauacacacaaaacuuaauagaaagaguaaaauaaaauuuugacugucaugagauugagaagaguagagauagugaaagucuaaauuuucucuuuuuuucugcuuuaaacaauuuaaugagaaaaauaaguguacguaagauucuuaacaaaaaucaaauuaaguuuuuuaauguauuugaauauuuaaaguaggauugccacaaauuaaauuugccaaugauuuuaacuauguguguuuuuuaagaauguaucuauaaauauguuuacugcaauacauaugcaauaauguauguuauguaauuuuuauuuaauugaaagauuguauuuuuauuuuuggucaguuacagugaagagguuaaucaguaauggcuuccacuuuaucuaucaguuuagagggcaagauucagccaaaugagaauaagaacuguuagaaagaugugcagcaagucaaugauuaccaugugauucauccauagguuaucaauacuugaucugacuugaguuuacaugagauauucgaauguauuucuuagcauaaaaaucccauuuuaauuuuuuuuuuuuuuuuuuuuuuuuugagauaggcucuuacucugucacccaggcuggagaacagugaugcgaucauggcucacugcagccucaaccuccugagcucaagugauccuccugccucagccucuaggguagcuaggacuacaauugugcaccacgaugcccagcuaauuuuuuaauuuuagcagagacgaggucuuccuauguuucccaggcuguucucaaacuccuggccucaagcguuccuccugccucgaccuaccaaaguguugggauuacaggugugagccaccacuacuggcuccuaucuaguauuauaucuaauuuaauuuauggucauugagcucauuucuuagcaacaucacagaaacaaggcuuuagucaauuuuauuaauaaaaagagacuauaauaacuuacaguguuuaucaaucaauaagguuuuuaguuuuaaaaaccuuauugauugauaauuaaauugauaauuaaauuaaaacaagcugggccagcacuuugagaggcugaagcaggaggauuguuugagcccaggaguucaagaccagccugggcaacauagagagauccuaucucuacaaaaaaauaaacuagccaggcacgguagcaugcaccuguagucccagcuacuggggagccugaggcuggaggaucuguugaaccugugagguugaggcugcaguaagcugcaauugugccacugcacuccagccugggugacagagugagauucuuucucaaaaaauuaaauuaaauuaaacuaaaaacaaaauguggacguacuugaaacuuugacucuuacauugauucaaccuucaaaggaacuuguccauuugugaaaguuuuccuuuuauauaagucuuucuuacagucaaauaaguguuuacuaagugaaauacuacauuuuauagugcaguggcacucaaaggaaacuauuuugcagcuguagaguuuuuucuuuuguccuuuuuacuuuuuccaaggcaagaugccuggugggagaguugucuggaggcaggaugaucagaagcaggaccuggccagcuguucgcuuauuucagucuguaugaaaucaucugauaugcccauaagagagaugugucaauuggcuaaugggucagaguauugauuuuauguuuucagauugcugacagagagauuaggcuuccagauacaagcaguuccacaagucucuguuuucagacaggcacauaauuaaaguaaccacacaguucucugagguuagaguuccaugcugugaugcaagccucucuauuugguauuuaaaagcaguuugaagcuguuguguaaguaucacuggacuuggagucaacugaccuaaguucuagccuuggcccuucuacugucuuaacaguggauuaaaugaugaggcuuauuuuaaagaaucuugaaaacuauaguaauuucaacaagaggagauuaauugaauauauuaugaaacaucaagauaauugaaaaucugugcugccauuauugcaugucaaaggucauuuugauacacuguaugugcaaaagcaguuuaccaaacagaauuacauacaguguaauccuuuuuuucuuauauaggaaaauacccacuuccccccacuuaaaaaaauaccaaacaccacaauguguguauguuuagccuacaaaucauauuuuuuuugccuaggaaguauugaauaauuuaaauauuuuauauucagauagcuaaagauggcuugcugagauaaaacauuggagcccuguguuuggugauagccguggguuucauuuauuuuuacugucuuuauccucuguauuuauugauaguauugaauauuuauuuucagaacuauuauaguguaucuguuucuaugggaagaaaugaauauuugaccacagaugguuuucauuuuuuuaguauggggcacguggauugacagccuuugaaacuugaaugcuguguaauauucaggugcuuuuauuguuuauagaaaugccuaauccuuguuugaaauuuauuaaaugguaugccaucuguaagccccucuaaauuccacagauuaauuagccuuuaaaguaagguugccuuuugucuaacuuuuaguauaaacucuuccaucugggaacuuucacuuuuaugucccuguucaguguucuguguacuucagcacucuaguauuaauuauggacacuggcauucuaaguaacaugaagaacacuaaaaauaaaaguagacugaacaaaguggcaauguccggagaauaguuugcauuuggugaauaaucaauccaucauggcuuugccauugcucuuuguaugugcgugcgugugugugugugugagugugugugcaugugcguguuuagcauuacuuaagagugagauaguuauucuucagggaaauuuuuacagaugaugguuucacaaaaaucagccuuuuuguaguuuaaauaaaaaaacacccuuuuugacauuucauguaacauuuccuuguggguucugauuuaaagguuguugaaaauauuugguguuggcagaucacuugguuggcuuuggcauacuucucuuucuaggaaauguaguaucagggugggaauuguguuguuguuuuaaaagaaauagauuacaggcuggcacgguggcucacacuuguaaucccagcacuuugggaggccgaggcgggcggaucaggaggucaggagauugagaccauccuggcuaacacggugaaacccugucucuaccaaaaauacacaaacaaaauuagccaggcgugguggugggcaccuguagucccagcuacucgggaggcugaggagggagaauggugugaaccugggaggcggagcuugcagcgggccgagaucuccccaccguacuccagccugggcaacagagcaagacuccaucucaaaaaaaaaaaaaaaaaggaaauagauuacauucuuuaacuuuauuuacuggucucaguaagaguuauugaacacucuagaguguuuacuuuuuaaaguccauugcaaaauauauagaaauuaguaauucaaccaucuguguacucauacuaaucaauguaauauagguuggcgcuuuuuaugcacuuaauuuugccaccucucucacuuccccaaagaaauuagacuaauguauaacaauaggcuucauaacuuaauuuagaaaacauaacaaaaauaauuucgcucaguaaguuucuguuguaguagauauuguugguauuaaacaaaaaaguaggaucagaugugguuuggcuuucaagguauaaaaucuagguggggaaagagagagagaguuaacauucuugaaacaauugagagcauuagaguguuccaguauauccuccaaauucuaaggguauaagauguucagagaaaauaaaaaaucaggguggguuagaauaauugaguucaaauggaccuuggaauuagguuaguggaggagauagcauuccaaauggaaauaaacaaugcgaauaaggaaacauguuagacauguauggagauuaugaaguagccuuaaaugauaagauuggaggaguguggcuugaauagcuguagauuuagggcagaaggucugguuaggccgugggaggucacaauauggaagaccuuaaaagaaaagauggguagcagggauacaugacuagcuuguuuuugcaauugaguaguaagauaaaaauauuuucuuaggagaaguuaucuuagaaaugguggacaggaugagauggaacacaauugaaauaggagucuguugcaguaguauagggaugaguuaaugagugccuguauuaggagaguggaagagggaauagagagaaaguaauuacugagacacauuuucacuggaauaaauuuggucauuaguauauacuuuuaacauauucaaugagugaaugagggauugagaaggacugaauauagugaauaaaguaaaauaauaguuacuauugauagaaaauggauagauuuuuaaacaaucuaguuagagggagauaguucaguuugcacauaaugaauuugaagugguaauaacuguaagaaguggccuuauaauuaauugaauauaugguucuggggcauagccauuuaagggccagagauacagauuuaagauguauguauauaugcauauauauuuaaagauacuuucugagggaguuucuaaggggaaaauuggaagauuaauaaacgagccuuagaaaacauaagaagaaauuauuuaacauuuggguuuuagaaggccuuauuuaaucauuugauuuuaacuuauuuaguuugagcaguguguuuucaaaccucuuuugaaacaacuaguaaccuaugcuuugaaaaaauuguugguuaaaauaauuguaaaaaugaguauauucugaucuauuuugaucugauuuuaaaaccaggguauucugauucauuauaacuuuuucuagauugcugugcuaaggagacagcaacguaugauaaaaaaucgagaauccgcuugucagucucgcaagaagaagaaagaauauaugcuaggguuagaggcgagauuaaaggcugcccucucagaaaacgagcaacugaagaaagaaaauggaacacugaagcggcagcuggaugaaguugugucagagguaaguguuaguaauacggcugagucgagaugggcuaaaguauccucuggauuaauaaauagagaaacuuuuacauuuuaaauuaaauuauguaaaauaauagugcuaggaaaaggaggguauaauaaguccuaaaacauuugcaguaaggauaaagcauuugaaggggacccuuugaauuguacuccccaaucuacauagaaaaguugucuccuuuuccuagguuucuccucauucauugccuuagcacccucuuuucuggcuaagugaaucacacugaggcuucuaaagugcccugccauauuuucccuuuuaaaaaagaaaacaauauaaaaguguuuuuauuuuuucucaguccaccuaacaacuaaugugauuuuugcauucuguuacuaugcugacuccaagagguuuuaaucuccucaguucuauucgggaaauuugcuguuuucagaauuucucacugcagugcugaaccauauagaugccuacugaauggggcuucuuacacucuuuuucucuuggcccugaguacaugggaauacuccuauauuuuacugaaaacaaugauuuaaaagguuagggaggcaaacuauagaagugacucaaaauucuuuggggauccguaaaaauauaaaaaauguugaauucuggucgggcgugguggcucacgccuguaauuccagcacuuugggacgcugaggcaggcggaucacaaggucaggagaucaagaccauccuggccaacauagugaaaccccaucucuacuaaaaauacaaaaguuagcuggguguagugcacaccuguaaucccagcuacucgggaggcugaggcagcagaaucgcuugaaccugggaggcggagauugcggugauccgagaugaugccacugcacuccagcuuggcgacaaagugacacuccgucucaaaaaaauauauauacauauauauauugaauucuuuccucuugggugaagaggcaacugcaauggaguggcugcuguguuuuuuucucuucugcuucucuccuuuucucucccugcuggaaaagggaaccuggaagucucugcucuagucuugaaaaguguuauuuccucaccuuugauuuuuuuuuuuuuuuuaaauaagacaagguauuuguaagacaagagauuuacguaaccgguaaagaggaaaauucuaaucuuaagcguugcuuuuucugaaaucgauguuaguuuaauuguauuuaauguggucauuuccuuuagaaccagaggcuuaaagucccuaguccaaagcgaagaguugucugugugaugauaguauuggcauuuauaauacugaacuauggaccuaugagguaagugaauagauauuuauuuuggacacuaaugcuaaaaacuuaaauucucauuauucuuuagcuuuugucauaaacuagagaaaaaaugauuuguuuuucaagauguguaaagaguaaugagacaggagccaugccuucaaagaucucaugauccagcugggaggagagacaaguagaaggaugacuaugguauaaugugaugaacauaauaauaacagugugaaugaguccuaacauaauauagaguacgaguuccuugaggugaagguucuugucguauugauggguacucgauacauuuuuuguugagugacugaguuauaagggagauaccuacgaaggaagcugaacauugaacuguaauaucaguuugccaugugcaaaguaugagaaaggcaugccaggcaaagggaacagcauguuuaaaggcacaguuaugaaauggcaugacauguucauaaaaaagugaaaaguucaguguaucuuguauauguggggagugugccugaggcuagauauaugguuagaaguauaggugcugcuguguacaaugaggcaucccuagcuuuuagguggaggguaacauaaucagcuuugcauauuaggaagaggacuuuguguguuguauugaguauagacugcagugaggagaaacuauuggcagagaaagcauuagaagacuauugagguguuucagguaauaaaugagagucugaacuuacacuaugguuauaaaaaggaugagcaaucuuaggguaccucucugauguagcuuuugugggauuuguuaacugguauaaugugggacaugaggaagaaaagagggaaguuaaggauaauucaaaaauuucuaccuugagggaccgaaugguggugcugucaucggaggaagcaaacauagacagauggauaguuuuaugaagaaagacaauaguuuuuauuuuaaguauaggaaguuuguggcacugacuagauauugagaauuaacauuauagauagguagguagacugacagacagauaauguuagugguguagaugagauuauccaaggagaacaaguagaggaaggaaaguaacaagaaucugggggacaccaguaugaauaguagauagccuugggaaaagaaacucacagcauauuaggggcagaacugaaagaaaguagcuuuuugaagccaaaguaaaaagagcuucaagcaggucuugggcagugguaucacaugcugcugagagcuugggagauguagaaagcugaauuuggcaauuaucaggucaguuguaaucuuggaaagcagauuuaguagggguaggcaugaagucuguauuaaaauugguugagaaauugaaaggaguuaaaauugaaugaucucuuuuuuaaaaaaaaacauuuuuuaugaagauuuucaaacauauaggaaauuugagaaaauaauaugaucaaccccuugcucucaugaaauuuauaaucuaauauaggugacauauacuaaucaaaaugaucacacaaauaaaugcaaaauuguaacaauguuaggugccaugaaggaaagguacaugauaucaugaggccacauaauagggucacuugaccuaguuagggaaguaaggcaagguuucucugagaaagaggugauuguguuaacaucuaaaagaagauuaggaauuauuuagguaagauacaggaagaacauuucauauagaauauauaaacaucuauucccacauuuguguugugucuuuguguuuauauguauuuaguuuaaaaauuuugguuuuacaugaaacaauuauauacaaauugugcuuucuuuaaaauaugugaauacauuauucucuuuuaauacuacauaguuuuuuguaguguaaaugugccauaauuuagcaauucucuuuaggucuugggaaccccuuuguacccuuaaaaguuaccaaggaucccaaauaauuuuugauuuugugguuuauauauacugauauuuauuauaugagaaauuaaaacuuuaaaaauaaaaaauuuuuaauucauuuaaaaauaauaaaccguaaaccauuacuuuacauguuaacauaaauaacauguuaaugaagaauaauuauaucucccaaaccuccaaaaauuuagugagauacagaagagugguacuacuuuauaguuuuguaaaaauauuuuuuuuggggggaagcucaaauacaucaguuuuaguuuuucucuauauacacauuuauuugcuacuaaaaauugaaauagcauauugaaauuuccuuuuguugcaauccaaaauuuugaaaaccagaaaaccaaauuaauuauuauuaugcuguggccagacuacucaguauuuucuuuacauucuuuccuccaaguuacuuuccuucaaauucuuaauguuggguuuuaucucacugacuucaggcuucuaaaacacauggggauacuugagaccuauuguugcuucuuuaggucaaaucaauaguuucauaaaaaucuuugauguccgacuuaacaggaucuggcaggauuaucuguuuuuucauguaaucuguuaugauauauuguuuggguugaaauaaaugaagaaaauuuagacucacaucgguaugcaguuggaaaagggagaacuuugcagacuuugaaagacuuuuaggauccccagaguuccuuggacugcuuaaaaccccagugcacacuugcccaacugcugccguaauuuauuuaaccaucuuuugauaggcagcuaggguauuuccaguuacuuguugauauguguacauaaaauguauuuccauauauuuaugugucuguauguguaugauagaaucuagacuagagcuagagguuacgauuaucugaaauugugauagaguuugccaaauugccuuccaaaaagacuguauccguuuacauucccacuagcaggagagaggaguauccauuuucucgcauuuccuaacacuggauauuguauuuuuaaaauucuugccuaucuuguggaucaaaaauguuauuguuagccugucacauuggccugugugcucuuccucaaacacucuaagccugcuagcacuucauggucuucacuuucauucccacugccggcagugcccuucccucagagauucuuucugucagguguuaagcucaaauaccauguaccccugagcuucaaauaaaaguuuuaaaaaagugauuaaaaaacaucaaguuuuuuuggucaaaauuaaaaaaaaaaaaaaaagcucaaaugccaccccugugaggcuuuccuggacuaccuuuucuaaaugucuaucccagcuccugccauugcauucccuaucgccuuucuuucuucauuuuucuacauagcaccucuccccuucaaguaugcuauguaacuuauuuauuuucuuucucucccuggagguauuuuuaucucuuuuguuuuccagugcuuagaacaguggcuggcacauaguaguuacucaauaaauacuuguaguaugaaugaaugucucccucacccaauuaguaggaauuauauauguucauaaacuauuucucaaaaaacuguguguucuuuuaguuccucauuucuuaucugguauacgugguacuuauuuauuuagucagacauacagcaaauauuuauagagcacuuaauguuugccagguacugagcaaggaaucaaggaugcaaauaugaauaaaaguacagucuaguaagagaaucagauauguaaacaacuguuguaugagaaagaauuauauggaugucauauaaacauauaggcauuaaaaaaaugaaaaacuuuuuguuuacacacuucugacaccagauauguggauuuucuacacugagcaauucuccaauucucuggacaccaacuggauguccuacaauuugacucaauucuuuuuuaaauuuuaauuguaaaauauuuuuuauugagacagggucuugcucuguugcccaggcuggagugcaguggugugaucguagcucacugcagccuccaucuuccaggcuuaagcaaucccccgauccucagucuccuaaguagcugggacuacaggugcaccucaccacaccuggcaaaguugcucaggcuggucuugaacuccuaaguucaaaugauucuccuuccuuggccuuccgaagugcugggauuacaggugugagccauuauaucuggccaauuuaagucauuucugacacuaccuggagcuagcacaggcucccacagguuaagggcugaguauccaaagacugccccugacuucagucaccaguugcaagucccagguugugaccuguaacuucugacuaaguggcuauaaguugaggguucccacaauucccucuugagguuugauaauuuucuagaauggcucacagaacucaggaaaacacucuauuuacuauuacugguuuuauuauaaaggauauguggggcaagcuaaaugggagagacgcauaggguaagguauaggggaagagugcagagcuuucaugcccucuccaggugcaccacccuccuaguaccuccuuguguuugcuaaccuggaagcucuccaaauuccauuguuagggguuuuuauggagcuucauuagguaggugugauugauuaaaccauuggccauuggugauugcacuuaaacuccagcccccucuccccuacuuggagguugagggaugggacugaaaaucccaacccacuaauuaugugguugguuucucuggcaaucagccuccaucauccaagagucaccucauuagcauaaacucagguccagcuggaaggggcuuauuacggauaacaaaagaugcucuucuuacccccuaucacucaggaaauuccaaggguuuuaggagcucugugacaggaaccagaauaaaaaccaaauauauuauuucuuauuauaucgcaaauucacaggcauauucuugagggaacauagaaguaaccaguaacgcugcuaguggcaaucaugggaggcuuuaugcaguaguacucgaugaaggaauaaagaggauuagauuaugcuacaggaagugacagugggguuaggggggacaucucauuguggaagcccucaugaaucaauagaauuuuaggaaagaaaagacuggaacaaaaaaaauuuuuugagugcccccacccaccagacaaaaaauuuuuaaaaaugaauuaaugaucuucacagcugcugaaguaaagguggggauggaucucauuuccaugguagauugauugauuaugaaaggaagagaugauggucccuauuuuaucaagaagugguuuguguucaaaaaggaguuaguagaaagaggggauuaaaaaucggagaaagcuuaaauauuugaaaaucuugaggaucaaucaguuaagaucuguaucuuucucugugugaugcuuuaggaacagccagcgaagaaguagugggaauauuaggaacuauucaaguuaaaaaaacauguuaaaaggcuuaacuugaagaaaagcaucaaggagaaaagcuggaaggaaugaggaaguguaggaaaguaucuuaacaagucagaauaucuuugacaccaacaaggaaauauggaggaaacuggcugugaaauuuauaaaaaccaagaacuauuucuuguagacaaaauuuggcaugaacagugaaauauuaaagcccagagaacaacagugauuugaaagacugaaauuugucccugaaucaaauguugggaauugagauguuucaucauuuguguuauucaaaagaauuuuuugauuggccccauuuuuuuuuuuuuuuuuugagauggagucucagucuguuccccaggcuggagugcaguggugcgaucuuggcucacugcaaccucugccucccagguucaagcgauucuccugccucagccucccgaguagcugggauuacaggcaccugccacuaugcccagcuaauuuuuuguauuuuuaguagagacaggguuucaccauguuggucaggcuggucucgaacuccugaccuugugaucugcccaccucagccucccaaaaugcugggauuacaggugugagccacugcgccuggccuguuuucagucuuuuuacugcaaggcuaugaucuucucugguccgggagucugccagaggagcaggaacuucccaguugaaccuuauuaguaaccaccuggaagauauuuauugaacaagugucacaucuguagucuuguguaucuagaaaccuuaagcaugcauuauuauguuuuaauuggaaaaugcauaggcuuuaaaaaaaaagauugugagcucuaucugaacuuuuguuaaguaccacaaaauuaaguuugucagacaaauagacauuugaaucagagauuuccaaaguauuuuaaauuuaggaaccuaaacucuuuuagaacagaucacauuaccgaguaaagugauuaaugugguuucagauguucagcguagaacugaauguuugugccuuauugguaugggccaaaugaaaaaaaaaaaauaaaacacacaaguuugccaaauauugguaugccuuaaacauuuccugaaggcauuuggugaugaaauauaaauauaucuaauguauaaaguaagagaguuuugucaaagguaauaugcagcaaagcugacuaguuugaagagguuuggguuacugaauagacgucacacaggaaaaaaaaauaaacuaaauggacuuauaaggguuaauuuuucugaccuuaucgauauuuuguggauaguaaagaagucaucuagcuauuuuuggcauaggauucaaggagcuggcccacucuggguggucuauaaauaguaacucuagguagcagggacuggcuaaacaggacaaaugugaauugguuaaaaagaaaauccucuucuuauuacucauugggguuaauucuaugauuauuagucauauuuuauuguugagaaccugaaauuuaacccagguuuuuuuucuuuuuuuuaaauuaucacuacagacucugccuuuucuacuaugcuguaaaguguuacuuuauuuuauuuuuucuaccuuaagguuaaggaaccuuaaccuuuuguuuuuggcaauaugguaggcuaaagguacaggaaacucauugcaguuuagcacacuaaaaaaugauggauugaaaaaauaaaucaaaacucuuauuuccuggcuccacuggagacaaaguaagggcuucucagaggccagaaauaauaaaagauaagaugagucuauaaugauaagcuagcauuggaaguggugcuuguucuggauauaguuccugauccuugcggcguagugucuggggaugggaaagaaagcuguggacccaagugaggugggaagucacaacugaggccucccuuuuccucuacccaaauaaagccagaacuuccaaagaaugacacucuugguugccaaaagaggggaacaaaaguugcccuaccacucagggagacuguuauuaaguaccuaucuugguuuuggcuuuaguuagaguggaaacaaaugaaaagucuuuccugauaauucuuuacucaaagccccuaccuaaucagguuagagccuaaauuuauacuacuagugugauccccccaaaaucaagacaaaaaugcaguuuaggugggcuuauguugguggugccuguaggcaccugagggaauugaaugcaaauucuucucagaagagacacuuuauaaaagaaaguguccauccuagaaaaacuggagacccaucucauaugcagagacacacacaggcucaaaauaaagggauggaggaagaucuaccaagcaaauggaaaacaaaaggcagggguugcaauccuagucucugauaaaacagacuuuaaaccagcagagaucaaaagagacaaagaaggccauuacauaaugguaaggggaucaauucaacaagaagagcuaacuaucguaaauauauaugcauccaaugcgggagcacccagauucauaaagcaaguccuuagagaccuacaaagagacuuagacucccacacaaucauaaugggagacuuuuuuuuuuuuuuuuuuuuuuuuuggugagacggagucuagcuuuguugcccaggcuggagugcaguggcgcgaucucagcucacugcaagcuccgccucccggguucaugcauaaugggagacuuuaacaccccacugucaacauuagacagaucaacgagacagaaaguuaacagggauauccaggaauugaacucagcucugcaccaagcagaccuaauauacaucuacagaacucuccaccccaaaucaacagaauauacauucuucucagcaccacaucgcacuuauuccaaaauugaccacauaguuggaaguaaaguagaccaauaucccugaugaacaucgaugaaaaaauccucaauaaaauacuggcaaacugaaucuagcaacauaucaaaaagcuuauccaccaugaucaagugggcuucaucccugggaugcaaggcugguucaacauacacaaaucaauaaauguaauccagcauauaaacagaaccaaagacaaaaaccacauaauuaucucaauagaugcagaaaaggccuuugacaaaauucaacagcccuucaugcuaaaaacucucaauaaacuagguauugauggaacauaucucaaaauaaaagagcuauuuaugacaaacccacagccaauaucauacugaaugggcaaaaacuggaagcauucccuuugaaaacuggcacaagacagggaugcccucucucaccacuccuauucaacauaguguuggaaguucuggccagggcaaucaggcaggagaaagaaauaaaggguauucaauuaggaaaagaggaagucaaauuguuugcagaugacaugauuguauauuuagaaaaccccauuaucuuagcccaaaaucuccuuaagcugauaagcaacuucagcaaagucucaggauacaaaaucaaugugcaaaaaucacaagcauucuuauacaccaauagcagacaaacagagagccaaaucaugagugaacucccauucacaauugcuucaaagagaauaaaauacuuaggaauccaacuuaaagggaugugaaggaccucuucaaggacaacuacaaaccacugcucaaugaaauaaaagaggacacaaacaaauggaagaacauuccaugcucauggauaggaagaaucaauaucguggaaauggccauacugcccaagguaauuuauagauucaaugccaucuccaucaagcuaccaaugacuuucuucacagaauuggaaaaaacuacuuugaaguucauauggaaccaaaaaagagccugcaucgccaagucaauccuaagccaaaagaacaaagcuggaggcaucaugcuaccugacuucaaacuauacuacaaggcuacaguaaccaaaacagcaugguacugguaccaaaacagagauauagaccaauggaacagaacagagcccucagaaauaauaccacacgucuacaaccaucugaucuuugacaaaccugacaaaaccaagcaauggggaaaggauucccuaaguaauaaauggugcugggaaaacuggcuagccauauguagaaagcugaaacuggauccguuccuuacaccuuauacaaaaauuaauucaagauggaucaaagacuuaaauguuagaccuaaaaccauaaaaacccuacaagaaaaccuaggcaauaccauucaggacauaggcaagggcaacgacuucaugucuaaaacaccaaaagcaauggcaacaaaagccaaaauugacaaaugggaucuaauuaaacuaaagagcuucugcacagcaaaagaaacuaccgucagagugaacaggcaaccuacagaaugggagaaaauuuuugcaaucuacucgucugacaaagggcugauauccagaaucuacaaagaacucaaacaaauuuacaagaaaaaaacaaccccaucaaaaagugggugaaggauaugaacagacacuucucaaaagaagacauuuaugcagccaaaagacacaugaaaaaaugcucaucaucacuggccaucagagaaaugcaaaucaaaaccacaaugagauaccaucucacaccaguuaaaauggcagucauuacaaagucaggaagcaacaggugcuguagaggauguggagaaauaggaacacuuuuacacuguuggugggacuguaaauuaguucaaacauuguggaagacaguguggcaauuccucaaggaucuagaacuagaaaugccauuugacccagccaucccauuacuggguauauacccaaaggauuauaaaucaugcugcuauaaagacacaugcacacauauguuuauuguggcacuauucacaauagcaaagacuuggaaccaacccaaauguccaacaaugauagacuggauuaagaaaaugugucacauauacaccauggaauacuaugcagccauaaaaaaugaugaguucauguccuuuguagggacauggaugaaucuggaaaccaucauucucagcaaacuaucacaaggacaaaaaaccaaacaccacauguucucacucauaggugggaacugaacagugagagcaguuggauacaggagggggaacaucacacacuggggccugugguggggucgggggaggggggagggauagcauucagagauacaccuaauguaaauggcgaguuaaugggugcagcacaccaauguggcacauauguauauauguaacaaaccugcacguugugcacauguacccuagaacuuaaaguauaauaaaaaaaaaaaaagaaagaaaaauuuccagagauacagagccaguugaacaugagcacaugucugcuucuuucccucaaaagucauuaaacacaccaggaaaccauaccaccaugaauaagaguuagaaaaaauaaacuacagaaucacacucugaaagacuauagauauuugaauuaucagauagagaauauaaaauauauuaaaagacagaauuaaagucugguaaaggaacaaaagacuaccagaauuggccagaacauuuugaaaaaaaaucuggaaauaaaaauuuaaguuaaaauuauaaaaacaaugaccagguuaagacagcaaaauagguauacuuggaauaggaacagcuccagucuacagcucccagcgugagcaaugcagaagaugggugauuucugcauuuccaacugagguacaggguucaucucacuggggagugccagacagugggugcaggacagugggugcagcgcaccgugcaugagcugaagcagggugaggcauugccucacccaggaagugcaaggggucagguaguucccuuuccuagucaaagaaaggggugacagacggcaccuggaaaaucgggucacuaccacccuaauacugugcucuuccaacgggcuuaacaaacagcacacgaggagauuauauccagcaccugacuuggaggguccuacacccacagagccucgcucauugcuagcacagcagucugagaucaaacugcaaggcggcagcgaggcugggggaggggcaccugccauugcccaggcuugagcagguaaacaaagcagcugggaagcuugaacuggguggagcccaccacagcucaaggaggccuuccugccucuguaggcuccaccucuaggggcagggcacagacaaacaaaagacagcaauaaccucugcagacuuaaaugucccugucugacagcuuugaagagaguagugguucucccagcaugcagcuugagaucugagaacgggcaggcugccuccucaagugggucccuaacccccgagcagccuaacugggaggcaccccccaguaggggcggacugacaccucacacagcuggguacuccucugagacaaaacuuccagaggaacgaucaggcagcagcauuugcaguucaccaauauccgcuguucugcagccaccgcugcugauacccaggcaaacagggucuggaguggaccuccaguaaacuccaacagaccugaagcugaggguccugacuguuagaaggaaaacuaacaaacagaaaggacauccacaccaaaaacccaucuguacgucaccaucaucaaagaccaaagauagauaaaaccacaaagauggggaaaaaacagagcagaaaaaccagaaacucuaaaaaucagagcgccucuccuccuccaaaggaacgcagcuccucacccgcaacagaacaaagcuggacggagaaugacuuugacgaguugagagaagaaggcuucagaagaucaaacuacuccgagcuaaaggaggaaguucgaaccaauggcaaaaaaguuaaaaacuuugaaaaaaaaauuagaugaauggauaacuagaauaaccaaugcagagaaguccuuaaaggaccugauguagcugaaaaccauggcacgagaacuaugugacgaaugcacaagccucaguaaccaaugcgaucaacuggaagaaaggguaucagcgauggaagacgaagugaaugaaaugaagcaugaagagaaguuuagagaaaaaagaauaaaaagaaacgaacaaagccuccaagaaauaugggacuaugugaaaagaccaaaucuacgucuaauuggugcgccugaaagugauggggagaauggaaccaaguuggaaaacacucugcaggauauuauccaggagaacuuccccaaucuagcaaggcaggccaacauucaaauucaggaaauacagagaacgccacaaagauacuccucgagaagagcaacuccaagccacauaauugucagauucaccaaaguugaaaugaaggaaaaaguguuaagggcagccagagagaaagguuggguuacccacaaagggaaguccaucagacuaacagcugaucucuaggcagaaacucugcaagccagaagagagugggggccaauauucaacauuccuaaagaaaagaauuuucaacccagaauuucauauccagccaaacuaagcuucauaagugaaggagaaauaaaauacuucacagacaagcaaaugcugagagauuuugucaccaccaggccugcccuacaagagcuccggaaggaagcacuaaacauggaaaggauuuauaaucccaaaggauuauaaaucaugcugcuauaaagacacaugcacacguauguuuauugcggcacuauucacaauagcaaagauuuggaaccaacccaaauguccaacaaugauagacuggauuaagaaaaugugacacauauacaccauggaauacuaugcagccauaaaaaagaugaauucauguccuuuguagggacauggaugaaacuggaaacuaucauucucagcaaacuauugcaaggauaaaaaaccaaacaccgcauguucucacucauaggugggaauugaacaaugagaacacauggacacagaaaggggaacaucacacacuggagacuguugugguguggggggaggggggagggauagcauuaggagauagaccuaaugcuaaaugacgaguuaaugggugcagcacaccaacauggcacauguauacauauguaacaaaccugcacguugugcacauguacccuaaaaccuaaaguauaauaauaauaauaacaaaacaaaaaaauagauauacuugaagaaagaaauagugaaugggacgauggaucugaagaaauuauauagaauguaacacagggagacagagagauagaaaaugugagagauauuggacaagagguuaugccaccauaacuaaggaauaaaguaacauucccagucaugagacauauugacaucugcagcuccugaugggaugcacugagaagggcacaguaucacuucuaugauguucuugucccaaaaaauguauaaccugaauugucuuuaauuuuauuuuuuauuuuuauuuuuagagacaggaucuugcuuuguuuuccaggcuggagugcagcagcaugaucaugacucacugcagucuugaacuccuaggcucaagccuccugaguaguuaguacucuagauacacaccaccguaccuggcucauuuaaaaaaguuuuuuugaagugaugacaucuuauuauguugcucaggcuggucucgaauuucugggcucaagugaugcuccugccucagccuccuuaaguguugggauugcagaugucagccagcaugcccagccuuacucuggaaucuuaaaaauauugcuaacugagcccuacccaagaccuaugaagucugauaggguaggucaaaggcauuuguuuguaaaccaaacauuuuucccaggagauucugaaguaugucuaggguugaaaacuguuguguguaguuuuguauuucuuucuuccuauacauuguuuuguauaguuuuguauuucuuucuuccuauacauuagccacuauggaaauuguaaaagcacuuauucauuagauuauaagauaauguacguaagggaaguuuuuauuaaaaugucucuagacagacaccucuguauagauagguuugucucauauacuugaggacauuuauggaccucuguuuuggacagaguaggggccacagcauaaucugugaagggaacuucuuccuggcacauaggauugcagauuauagauuccuuuguuauguuuuccccuuucuauuuuaaaggucacuauagucauccuccuuugcugcaaaucauaaaugaacauacuaaggagguuuuaaauauguuuuaguuaggucuuaaaaaaauuaacaaauguuuggaauugacagugcuuuuacccuguuuuuguucuggguuaaugcugcgcccucacuaggucuggaaucuuuauaguuugagacaucagacuuggaugaggaaggguaaaucaugcuacuagugggccaguuacucugugguuuucuuaugagacugugcuuuaaggaaaagguaaccacggagcauauggcauugaguuugagucauguggaacugguuagaaguaaaauguuucuauuccagcauucucugaguuugucagcuuuucauuauuuuauaggaagaauucuagcuucuuauccugagaugagcuugucuccaaaucugguuccaauuuuuuguuguuguuguugagcacauuucgccauaugauaucacuauuggcuguagguuaaaaguuaccguguaacuuaaacgucagaauucaaaccaccaaguauacacgguuuuguucagccagauuuuuaaaugaaaucuaauuugaguuuuuggcuaaaaguacuuuccacauuuaucaaagugacacaugaacugaagaaauacaauguaucugaguaccagguguuacugaaucuggaauugcaggaggguaacagagccaaaggcaguccuuuccucaaauagucuuaacguauucauguuugucaaaaaugugucuacacaaaguaauugguucucuuuucucuguagauuucauccuuuguugaaaaagaugucuuagaaccuaucaagugcagagcuggguuuugagggcauggaaaauucuguugaugcuuuucucuaguuuuggcuuucaugugaguuguacauagggaggcuuauaaggagcauccuaguggcuuuaccuuguaucacuuggcuacuuuuuccccacacuucauuguuguaaugaagggaaaggcagcugaaaccagaaaccuacaucccuugccaacuuaagagauaaaaggaaauuuaucucuucugcuuucuaccuagugagaaggggucggugagaaacuaggccaggugagaaaacuacuaucagaguuuaaguugaguacuucgauauguucuucagaccauacaucuuaguuaacauaaaacaaggacuaguggauaguuugugugaaauagcauuuucaaccaccauuuucaguacuuaauauagcuggguggaaucaugcuguguaagugcugcagaacauaaauaauaaaggaaauaaacaucuuaauuuuguaacaagugaaggucuaggcuaauauuaaggguaguauaggauacuuuugaagcuuuugaauguacagaaguacauauguaauuauuauauauugcuuagacuucuaggcaguuugccauucaugucuuuuuugucuccagauugagcuguuuugucacauuagugagcauuugaaacauaauuuuaagugucauucuacaaaugguucuuaauugauuuaugacuaaugucaguaugaacugcaggugugugccgugccuuuggacuuuuuggugucuguguguucugaacauaaauuggccuuaguauguuaugcacacugucaguuuaucacaauccauggccucugaggagccagaaguacggaauguacagacgaucuauguaccuuauauuauuuucugucucagcccuuucccagaauucccaauaaagcagauuucucaauuacuugcuuuuauuuuuccuuucucccauuuuuuuuuuuuugguaaauuaacaaugagagauaaauggaaauaaggcaguuggaagaaaagaggaugaaaacaggugaagauucuuaguuguggaauaagcuagguuggcuauggguugauaccaugugugcuuggguaguaaagguagcuaguuuuuucugcguguuguauuaagccauuauuuaucaaauacuaauuacguuuuaugcacuaaauacuaguccaaguauucuauuugauauauggauuaauucauuuguuccuccuagugccaugaggcagguauuauuauuccugauuuacagaugaggaaaccgaagacacagcuaauauguggcagagaucagaaucacaaucugccucuggagccuuggcuuaaucacugacagagcaacagccacucaggcagagaaaaaggaguuggcauuuacaguuagaggaguuaggacuuuaguaacucugcccguuucccuaaagcuuaggauuggcugugauaggggaaaguagcuuaugaauugacuggauugauguaaguauaacagaaaagagagauuguacucaaauuuacagccauguuuuuugacauuuagaauaaucagaggauacuuuucuguagugagaaauauacaaagaguuguucacacacacaccuuuuauauuaaacacugacucagugaugucagcaaucuaauuacuauagaguaucaguuaucuaauacuguggaacaaaccaccccaaaaccuaaacgcuuaagacaacagcaguuauuauuuugguaaagaaaucugcaaauugggcagaguucaggacagacaguucuucuuugccuccguggaguguuagcugggguggcuuagguuggaggacccacuuucagauuggcucauucacauggccaguaaguuggugacggcuuucagcugggaccugagccugggaugugggccaggguucuugguuuuucuucauuuggaccucuccacagcugcauggguuuccucacaguuuagugucuggguuccaagaauaagcaucaucuauuagaauagugcuugcuuuauaauugcuuauugaaugaaugaaagaaucucagguuguuuucuugcucauguuggcccauuuggcaaauagccacuguaaagugcagguuucuucccagagcacgguaaucccuggcucugagaacugcuauuuagaggguucuuuuaucuugacuugaaggucuauuucuucauuuaaccacauuuauguuucuaauaaauuacccccaguuacuacuaggcugcaaaaaucaucucugaaccauucaauaaacagagaaaagaaaaccuuuuuaaaauuuggaaacuaccuugaaaacuccccauuuuuuccuccuuuuagucucaguugcauugaaaguuaacauaauguucuguuccuggaucuggaaaugguguaauagugacuucaccaccugccauucuugaguuguggguuaguuucccuaaaauguagaucuugacaagaggcagauggugcaugaaguuuauuuauuuguuuauuuuuugaaaaaggaauaccucuuaugaaccaggaacuagaacaccccuuagcuuacauucuaacaagaagagagacaauaaacauaaguaaaaugagaaaauuauaaauucuuuggacaaagggauaaaguauaguaggguaaaugguuuuacauguugaaggguaguuguugggacuguaguuuuauuuacuuauuuuuaauuuuuuuugaggcaaggucuugcccuguuccccaggcugaaguacagcaaugcaaucacggcucacucagccuugaccuccugagcucaagcgauuguuccaccucagccuccugaggagcugggaccacaggcacacuccaccacacccagcuaauuauuguauuaugauuauuauuaucguagagaugagguuucacuguguugcccaggcuggucucaaacugcugggcugaagcagucugcccaccuuggcuucacaaaauuccgggauuacaggugugagccacuguucccugccaggacuguaguuuuaaauggugaucacuguaaggcagguguuugagccaaggcuuaaaggagaggagaggguuagccauauggauaucugaggaagaacagcauucuuggcagaggaaacagccauugcagggauccugggguggaaaugugucuugcauguucaaggaaaaacaagguggcuuugcuaaagagagaguaguaggagaugaugucagagaggugagauacagggagaggucaauugagguaagacuucugucguuuuaaagauuugggcuuuuaccaugauagaaaugggaagccaucagaagguuuugagcagaggugacauaauaaucugaccuagauuuuaaaaggaucacuuuaguuacuauguugccacuagccugaaccugguaggcaggaagacaaguguccugcucugugucaucuuugggcuuuauaaaccauguuccaucuguugucucauuugaaucucaggaaaaccuugugaaauauuuguuauuuuucauguuuuacaugugaggaauuggaggcuuagagaaguugaccaaguaucccagacauacucaagugagcagucucagaguaacaucuugaacccagaucuccugucuccaaauuuugugcucauuccacuauuucacauuaaaaccugaagaucucccugcucuuuucaucuuaacguaauuucagcuuuuuguguguggcucuccaagccacagagcagcagcagcuuuugaggauaagaagcaguuucuuuuaaggauaagaagcaguaugguucuuaccugguaagauggcuugaauucaaaauugaccuacuuguaccauaagaaagcagguuugcaaggaguagaauagacuuggagauaugccauuuuuuguucagcuacuugguaugaagacugaguaucugaaaccacacuguaaggauuaaguggcuucauaaauaaucuaaaacaguuguuggcuuuuagaauuuaauaaaugaaaaaguaagguaacaauucuuauaauacuuuuuccagacuuucggggaaauugaaaucauuuguguuuuauuaauccaugcuuuucaggaccaauggcccauaaugugagcaagguuuauugguguaaugauuauuuuguggccuaaaacuacugugacucuuuggacuagcauguuucugaucauagagacagcuagagacuucuucuuuuuucuuaauauuuguagcuuguuuuaaacguacugaguagaaccugauuuaagcaauuauacaaaguuugguuagauugcuuuauuaauauuaugaacuagaaacagucaccaaaugcgcauucauuauacuaauccuuacuaugauugagucauuucuuugaguucuuggaaaucuaauuuuucuaaaauuaacaaaaggggacauuugaaugaugcaaaagcacucauggcaagaaucuaaaaguucauauaaauaauaauuuucucauacucuuuuauacauuugaccauuacaagaucugucaaauuccuuucaauauuugugaugucacagucguacuaaaacaaucuugaauucuggcagcgaaaugaaguucuuaccugucuuucagauguuaauaaaaauaagggaaauacaaaccuguaguuauucagaugguuaaaauuaguuucugugggucauuucauagaguucaaguauuuaaauguuuuuuuagcugaauuggacaaucaacuugucuguaauuuagcuuaagagaaauuccauuuuaagacaaaaaaacuacagggaauguaggccaaaaaauaauaacaaccaaaaacaaacaagugaaaaacguuaaaagauucuuagcagaauuuauuaauauauuaccucuucaaaauauauucuagccaauggauagauaauaaaauugagacccacagacuauuuggauccuaaauuuuguuucaucaugacucccuuguugaaaauacuuuauugacucuguguaauguaaauaagauaauuuuugugaagcucauugaaugcgucugagcuccuuaacucaaaaaaggcuaaaaguuacugaaauagcuaugguuaaggguauauugucauuacaaugugauaaucauuaccaaagugggcacuuggaaaaauagugaccacuuaugagccaaaccaaucaacauuaaaacugauuuccaguaaguacagcugccaagugauuauagagcagccuggauacagaugggauagacuacaaggauaguuaagcucaaagcauuugccuguuaacagccaugaauugugaggugaaaugccaguuuacauaguguuaguaaaaucauuaaaagaacaaugauuaguagaagaauucuuuacaaaccuuaaaguaucaauaguucugaauuaauucaauuuauaaauuauccauaagucauacaaauagccacuuuguacuuuuucaugucccuccaaacucccccagucccuauuuccaaacuguccacuucuguugaaucuauuguaaaaauguguaccuuuuagggaacugagauaggaaagaugugaaaaacaggauuaguuuagaauaaugguucucaaacauugguaaagucaccuagacuaguacaaccacugcggaaaacaguguggagauuccuuaaagaacuaaaaguagaacuaccauuugauccagcaauuccacuacuggguuucuacccagaggaaaagaggucguuaaacaaaaaagauauuugcucaugcauauuuauagcagcaaaauuugcaauugcaaaaauguggaaccaacccaaaugcccaucaaucaacaaguggauaaagaaacugugguauauauauaugauggaauacuacucagucauaaaaaggaaugaauuaauagcauucgcagcaaccuggaugggauuggagacuauucuaagugaaguaacucaggaauggaaaaccaaacagcguuauauucucacucauaagugggagcuaagcuugggauauaggugcaccaaaauaucacagaucaccacuaaacaacguacucaucucaccaaaugccaccuguuccccaaaaaccuauggaaauaaaaaauuuuaaaaaaagauaauuauuaauccaguuuuuggugaaucagugagugacagugguuauaguaguggugguuuaaaucaaggaauaaauguuuucaaagugaaaggagcacauccuaccacacaguucaaaaacaaucacaaauauggcaggcuugcugagagcuuucauacaucauuuauugucaugcacuuguaugauuauuguauacuguacacauuuuuauuuuacaaugauuuguauuuuccaaugcguuuauugcaguucagugugguagauggcuggagccuauccugguagcucggcgcacaagucaagaauuaacccuggacagggugccaucccuuugaagggugcacucacgcauguuccgcacacucauucagacuggagccauuuagacgugccaguuaacuuaacaugcacaucuuugagaugugggaggaaacuggaguacccacaggaaacucaugcagacuuggggagaguaugcaaacuccacacagacagugaccuuggcugggaauugacuuuuuuuuugucaucaguguuaucacaaaaugacauugcaugaaccagcauuguuugaagacuugcuguauucugauuuuuuuuaucuuucaucuuugagucauuagcaccaaauauaguucuuggaacauaauagguauuuacuacaugaauaaauuaauggaugaaucauucauucugggaaauguugucaacauagugcagugauggaauuccaauccugaauccaaauccugacuuucuuaguuauuuagagcauaaacuugggcaaacuguuuaaacucuuugagcuucaacuuccuuugagccuucauuuccuuaguacauaguagguacucaaaagugguagcuacuguuaaaauauacuguauuugcaucuuagaagagcauuuaacauucuugugauaucuuuauggucaagaugggaaauuuugaccuaggugguauuucaguuaauucauaaguagauaaaccuacguuuuuacagauuuagaaggagcuuuuuauuuuaauaacaacucaguacaggauauugauggcaugcugauacuuucuuggaagaauuucuuuugcuaaugaggagccuaaaaguucuugauugauuaguagguaaguguuuuuaaaggaauugauauaaauuauucagcuggauccuaaaacucaguuacacaaauucagaguugaggugggauaggaagagaagcaaaaguaaugguucaaaaucgauuugugugaaaggacuuaggguuuuaauuacacugggcucaauauaaauagaguguaauauaacugccaggaaagccuaugcgauauuagacugcaucaguagaacaacagugucuagaacaaauggaggaauuauccuuuuccauucuguaguggucauacuaccuaagaaguacuguggccaauucuggacauuaccucugagaagcauguuuauaggacagugaucaaauaugcuaaaggaacuucagacuaugcuguaaagaggagcaugugaaagaaucaagaaacuauaaucuugaaaaagaaagccugggguaagggggauguuagaugucuuuggacauuagaagaaggcuuacuuagacuuguucuggauagccacagaauccagaacuaguaucaaaagguggaaguuuuuuuguuuuuuguuuuuuaaaaaggaagcacauuucuaguuaaaacaaggggaaacucuuaauaauuagggugguagagauacuggagggaucagggagugaguacuuccaccaaacaggaacauuaguauauggauauuucacuaauaacaauagcggggucaguagggguugaauuaauugagauucucuaaacuuaggggaaaguucuuaacuuugauuuuauucauagcuuacuuucauaauuagaauuuuuggcaccaugcuugaaagaaaaaguaaacacuuuuuuuuuaaaguuaguuuccuaaagaagaaauaaaauuucuuaguugucaucacacucuucauuugacuucccucccaaauugcuauuguuuucugcuucucucauguuuucuuaaauacucaucagggugacuuuucuuaaguuuagacagacauuccacuaggucucuuaccucauuuguggcaagguuuauauugaugugugacugcucagguaaaccuuuagucugaaugauacagcuaugacaaaauauagccucaguuguagcaaaauuaaauguuacacaauggcuuuaauuggugguacaccuuugaagaguuugcaguaugcccaagugcuaaagcauaccaugugagaaucacuggguagcaaugauuucugggggugaagaauugaggagaauggaaaauauauuaagggaucagaaaaauauucuagagaggugugucugcuccccguuuucccccaacacugauuuccccaaauuuggagacaaacuacuauuaucucaaagaaccgcuuuuccuuuagaaccacaggcuccuuaacuacccuuuuucauuagccuuacuuuccucuugcauuuuaucccuccaaauagaaucuuuugugcuucucuagggagauucccuuuguguugaauuuuaugaguaguguaaauuguguggguugcaucauaaaacaaagugcgaacacacacacaaagucuuauugaugagccaaguuccuaagcacuauuaaugaguuaaaaguguuaauuaaggcugggcgcaguggcuuacaucuguaaucccagcacuuugggaggccaaggugggaggauagcuuuagcucaggaguuugagacuagucugggcaacauagugagaccucauuucuacuaaaauuaaaaaaaauaaaaauuagccagaugugguggcacaugccuauagucucagcuacucagaggggcugaggugggaggauugcuugaguccaggaggucaaggcuucagugagcugugauugugccacugcacuccagccugggugacagagugagacccugucucaaaaaaaaaaaaaaaaaaaaguuaaguaggcaguauuugcuuauauguauauauuuuguuguuuucuccaaaugcuuaugccucugaagaggauauacauugaugagugaagauauuagggaggguagggagaaagaauagaaguuuuuacauauaaauacaaauagaaguauuuaaaaaauuuuuuuuucuuagcuuuaucugauagccugccuucuggaauugugaaaggcuaacaaugaauuugacuuuuauuccuacuucauuugaaguauucucucauugaaaacaccaguuugcaccauccaggaggccuucuuauuucaguuauuauuggaguuuaaaauuuguuuuuaggugugucguauuuauuucuacuucauauauacauguaauuaucaaguuuuuaaaacauauagaacacuacuauuguuuaaacaguuuauaaauaagguacuuuuauacuuagaaaaauuguuuuugauaugugcagguuaccaugcuaaggauuugaacaccuucaguacccuauuuguacuugcgucuaugccuagcauuuuuguuacgugcauggaucugcaaaggaauugugguuuguuucacagcugcauguagcaggcauaugugugacauauuuuuauuucagcuauuauuuccuguuuuuuauuuucagcauguuggaacaggauuccaggagaaugaacccuagugugagcccugcaaaucaaaggaggcaccuucuaggauuuucugcuaaagaggcacaggacacaucagaugguauuauccagaaaaacagcuacagguaagauggcaugcaucuaucuuuuggccuaagugauuuaaugaagcugaaacaagagaauuaucuguaguauaacauugcaucuaaauuguucguguauauuuugaguaguagaacacauaaauuacugaaaccauuaauacauuuuacuuuuaauauuguaaaauuaaauuuacuuugaaaccuuuuguaguuuuaaaauuccuauagagauguaaucuuaaaaucucaguuugugugcauuaauauacauauugaaauauauacauauuauauauaaugucuuuaauaauuauuuuaucuaucauguguuuauacauauaauacaucuaauauuuguuacugucucaccuguggauggauaugauaugguggaauaacaugauugaaccuauuugcagucauuagguaaaaucauuuauacucauuuauugugaucuuuguugaaucccucccuuguugcaauuuaauaaugacuugauaaauuuccauauugcuugucaauagcaaaaggcuuuaauuguauaaaaaugcaauuucuauauuauguuaacuagaagaagguauaguggacauuuuuauaguuguauacuuuuugauaaacauuucccuguguuauuuagaauuuguauuagagccaaauggagccagguccuugacuaacaaggcaaagggaggucacaguaugguaacuauugcacaguauaaugcuugaaaauuauuacagauuuguuuacuuuuaucucuuuaaggauuuguagguugagggcaaucuuucuuccugauuuuuacuguguuacauccauacuguugaaagaugaucaccacaauccugcaggcuugucuccacuuagccuuccugaaaaaacuguuauuuuuguggaguacaguaugccaagucaguggaggacccaaaggauuuuauggcaguagcugcaacgcaacauagcaaugauagaugucauaauguuggaaaacauagcauuuccugcuuuuuuacaugccaaaauucaucauacuucuuaaaauauucaccuugaugaucucuuaacggugccccugaauauugguagaguuuaauaguauauuuaauuuucauaaguaauuugugcagguuugcccuacguguucuauaauuuugaauucuguuaguguccacauaagauccaucaaaaauuaaauuuaaaucuaauagccuuuggauuuacgagaguugagauagcgucuugcuaaagaauagaacaaguuauggauugaaugcuugaaauuacaguucagguaagcuuuacaagaauauuauuuauucugcacuaacugcagcaaguagaagccuuccacauuagcauaagauaacaugguggcucccagaaagcauaguagucugaucauacuaguucaaacuaaaagucugaaugacuuucuggcugaaauuuaucagcuuucagaguaguacaugggaugcaagcuauuuuuucccucccuucuccaaagucaccauugagugaauaaucuggguuacuggucuuggggaaaaaaaaaaaccaaaaaacaacccaggaaagauuauggauucuugauuccaugcaaguccuuugaaauauuuuucagcaacuugagagauuuaaauaaaugucaguccauuaauuugauguucuugauuuuaucaguauaaauacugaauaaaagauaccaaaaaauguuugugaaacauuugaaagcaccuaauauuacuuuguucuguguucugaacugaauuuuagauguuuuaucuauuuucagccgugauaccuauacauuuuuuuuaaugcagcuuacuuuauguuucuuuuucuaaggagagcuaugagacaugguucaaauaaaaaaugaguagauucuaaucccauaguuuauaauauuguauuagccuaucauuuaguaauuaacugcuuauauuuuuucagucauagaaauguguggcauauaaauaguaugaccauauaauguucuaucaaacugggacacucuuaagaaggaaagguagugcuaguaauaauuacaucagaauaccaguacugcugucuuggauaaaugagaaaggauggucacccuauauaagaugucacccagaacugaucuuuacuccaagaauucucauuaacucuagcucccuagcacuguccuuuacuuuauuuacuuuaaugauuuauuuguugaauuuuuuucucuuggcauaaaauguuugcaagcagacucgaacucugacuguuccugggcuaauguuggucuaauugucuccagauuguauguuggcugauuuucucucuccuuuaacuccacccaauccuuguccugguauuucuccuaucagacuuuuuuuuuuuuuuuccaaagaauauuuuuggcugauagaacaaagccaguuagcacagaugugcagaaaucauuacuagaguucagaucacaaauauauuuucaaaagcaguuuuggacuuuucucauggacuacaguguuuguauuuuucuaaguaugcaggcaugauuuuuaaaauaaugcguaugucauagauuuauaagaagagguguuaagcagccuccucuuagaggcauucagauuuaucaaacacaagacagauacuuuuuuuccuucucacucaaugcuucauuuuaggcugauccuuuuguguuugcauucauuaccugugcaccaacaugucuguuuuauuccaaacaacuuaaaccuacuuaacccuuacagccacaagagaggacauugagaauauuccuggugcaaguugcagggaagaauguucuauauauccucugcuauuguuucuuuucucucguguguggcauaaauagcuaucucuaacuuuuaacuugaaguuagccuuccacucugccagaguuauuucuguuaaggggccagugcuuucugccaucuuacuugcccuuuccucagcauuuggcugugugggucauuugcuccuugaaagacuuuccuuuuguguuacuaugguuuuuuaguuuccuuuuuuuauuggcugcugcuucacaguaaucuuugugggcucuuuuuuuacccaacucucaagguuuggaacuguaaacuuuuuuuauuuucuuucugccuaggugacucaucuauaauuucaugcacaguucauaucuauauguccugaugacucucaaauuuauguuuucaguccagacuucucuucugagucuccagagucacauauccaauagucucuuugacaucucuguuuuaacauuucaaacuuaacaugugcacuguggaacucaguuccucucccuguuuuacuuccaaccaauuuucuacaacuguguuuuuuccuuuccauugcuuaagccagaaauccugauuccugucuuucaacaaguguuguugauacucuuccccaaaauugucuugaauugguccacuccucuccgucucugcugccacaaaccuaguccaugccaucaucaguucuugccaggauugccauagcucuuuccuaaucagugucucagcuuccccuuuugccuccauugaguccauuuuugguaccauggcaagguaugaauguaaauugaaauauaucacuucuuuauuugaaacacuuuuaugacuucuuauuacauuuaguaauuccuuauuaugaccuggucuuuuauuaugaccuuauuaugauuccuuuccagccucauccuguucccucucuaccuccccacuugcuugcaacucuucagccaguggucuuuuuaaaguucuuugagcccaccuuucccccaccugccucuuuuaugccuagaaugcucuuaccccaguuucuauagaggcggcgucuucucaucauuuaggccuugauguaacuaccaucuccuucucggaccauuuuaucuaaaguauauacuaccauugcuuuuccauuucaaccauuuguuuguuucuuucauagcacuuacuagaguucggauuauuuuaugcauuuauuuucuucuauuugguccaucuuccccauuaaggucuuuggggacagaaacuuugauucucucauucccuacuggauucucagcaccuagcacaauaccuggugcacaguugguaugcagcaaguauuuguugaaugaauaaaugaaaagugugagucucacuauguucaguuuuauauguuuacauguuuucuuuugagauauuagcauaucuaguuuucuaaauccagaucauccuauauaaagaaauucaagagagaugcaagcuuuguuagugagagagauuaagauugcagacugaagagcauaaauaacaguaauauccccaucucaaauucuaacuuucaacuccaguuuugcucccuacgucacaccuuggauaugaauucacaugaucuacaucagugcgauggcuaggaaaguauauauuuuugaagcaaauggaguaacuaguuaaugucagucacucuguuguuuuauuagugauucacauucuuccaugaucccauaguuuauauucggcuuuucaacucuuucacuuuucuccugccaagcauuuuaugucucacccuauccuuaacauacacacacacacacacacacacacacacaccccuaccuguuuuacagauacuauccaguuuuaucauagaauugugucucacccuauccuuaacacacacacacacacacacacacacacacacacacacacaccccuaccuguuuuacagauacuauccaauuuuauuaucauagaauugugaaugaccccuaaacuuuagucuggucacauaauaccacuugauuuucgccucaauuaccccguuacuguguuacuaccucuguaccagcagcauugugcaugucuuaagcucauugaagauaugaugaaccauguguuauuguaucgcuuauuccaaauuaauugcucaauaaauggugauuagacaaaugugaauuaccauccugucucuguagaaaaucagaaaaugacauuucauguaaaauaagguuuuguauuuuauacuuuaucuugcaguauauucuguuuacuauauuuuuguuuccaugaaaaguuaacacuaaugaugauuuucuuauagcaaacuucuuaggaauuuaagauacaaggaaacaaauuuugugcauccauguuucagauaugaucauucuguuucaaaugacaaagcccugauggugcuaacugaagaaccauugcuuuacauuccuccaccuccuugucagccccuaauuaacacaacagagucucucaggugaguguuguagauuauugcagaaacaucugaguugguucccauguuuaguuuuggaaccuagacaaguaauuggucaaguucacuaagugacugagagaaucucugaauuauuuguggauaacuguaggcauauuaguuguccaguuucuccaccaaccucauggagauggugaugggucuauuuuaugugauaguugcuuacuuaaauaugucuucuuuaaaaacuacagaaugaaauuaauauuaaaauuucaugguguuaggcuuacaguugguaacauucauagcagaaaguaccuuuuucuuccaauuaggaagauaauaauuuguggguaugugauucuggagauacuuuaccguuaguacacacuucuuuaucaauuuuucccuugaauuuuuuuuuccugugauuuuggaccuuacccuuaaaaccucaaaaacuaccucagauuuuuugugauauguaguaaucaacuacaguuaaacauaguuuaacaucuucacagcugcuguaaaaaguaagcaaaauaagggaaguuauauaugagcuaugcuuuuauuucguguguugaaaaauuugaauuuuuuuuuaccccaggcaauugaguucauucuuuuucuucucccaaaagagcaugauuuucaagagguuuuaaugcaucuauuuguuguuagggguccuaugacuuguuaaguucucuacaaugugucucaaauguuuguguuuauauagcccaagaacagaaauaggaaauacuuuuuauuuuguuuuguuuuauuuuauuuuauuuuuagacagggucuugcucuguugcucaggcuggugugcaguggcuggaucauagcucaccgcuuccccaaacucccaggcucaagugauccucuugccuucgccuccugaguagcugggacuacaggcacaugccaccaugcccaguuaauuuuuuaaaaaaauuuucuguagagacagggucucacuguguugcgcaggcugaucucaaacuccugggcucaagcagucuucccaccccagccucccaaagugcuaggauuacagguguaagccacugugccuggcaaggaaauacuuuuuuugguggaaaaaccuuagcauccaguguuuauauuugggagguauuuagcuguaguuuucuuugaaguuugaaugcaugguugacagguuuaccauguaaaaaugcaugucuuauuaaaaacaacguuaagugucaacuuuuucaaaucaaaaagcaauauugagucaucaggcacuuggaaugcucuuuggaaccuacaaaugauuagauucauuuccacccacagggugaaacauccauuucuauguuuaauuaauuucuauguuuaauuaauuaaacuauauuuuauagguuaaaucaugaacuucgaggauggguucauagacaugaaguagaaaggaccaagucaagaagaaugacaaauaaucaacagaaaacccguauucuucagguauguuucuguuugucuuugaacaauaguuggcguauuuguuggaaggcuucucccagcuggguuacucucuucccuagaagguugguaaacuugagcuuuagccucuucccacugucuccugcugcuuccgaugcagcuaucauugccacugaaguccuccucccagguuuuauagcacuaguuuagguuuuauaguauuaguaguucccugaucaggcaucgugcuauuucuugcucucaccuucaaauuugcuuucaagccaggaguuccuaugcauggauaucuauaucaaaugucuuugucacaaugguauaauaaauaauacugcuuaucuccucuuuucuuagagcuuuucaaaaagagaauguuaagaccuggggcaguuuggaaaugaagacauccauuucugaacuuagacauuuacuacuaugguuuaaugacaggucuuacuuagaaucuguuaaguggggguuccaucucaauguuguuugccacaaaacaccauuaagucauuccgucauucaucaaauauuuguuguuagaauuuagacuagcaacuggcaucugcaaguucccaauaaugagccaaggacuguucuugauccugaaauaaaguaauggguaugauaaagucccuaccuuaauggagcuuacacucuagugcagagcuaaacaauaagcaaauaaauaaauacacaaauacacugaaaauuagagcuaaguucucuaaagaaacacaaagcagcauaggagguuagaauuugaauugagaaaugagugacuagacugaguggucagggaaggcuucucugaagaaguuccacuuuaagacaacauuguuaagguaauuaaugcuagcuguuauaacagccccaaaaucucaguagcuuaauggaauaaaauuuuuucacuugcacaaaauuugacuucacuuucuaggauugcuuuucuccaagcagggaguaagggauccagguuccuucuauuguguagccccaacaacuugaaauucuuugcuucuugcuugagauguuagggaagaaagaguuugguggauugugcaaaauguuuuaagaaucaggccuggcuuuuagccaauguuuaguuggcuaaaacucugucacuuugcccaaacuacuguuagaaagacugggaucauguaucuuucugugugcucgagaagaagacaaggguuuggugagaacauugcuuuugccauaggcagaaaagucacugaaauaacaauguaaagauuuaggggaggcugggcgugguggcucacgccuguaaucccagcacuuugggaagcugaggcugguggaucacgaggucaggagaucaagaccauccuggcuaacacagugaaaccccaucucuacuaaaaaauacaaaaaguuagccaggcgugguggcgggugccuguagucccagcuacuugggaggcugaggcaggagaauggcaugaacuugggagacggagcuuggagugagccgagaucacgcaguccagccugggugacaaagcgagacuccgucuaaaaaagaaaaaaaaaaagauuuaggggaaaaucuggagaaagagcuuccagacagagggaacagcaaauguaaagacccucaggaaggaacaugaagaagcugaguacgacuggaaugcaggggcugaggggagagugguagaugagauuggagaggcagcagauguaggcucauagcaaacuucauaggcuuugaugagaacuuuggguuucaucauggguuugaggggaugccauugaaagguuugaguaggggagugacuugauaugauuuauauuuuaaaaaauuaguaguugcuacauaaaguggaccaugguggggaguaugacuggaaguagggagacaagaagccauuuuagugggcuaggugagagaaauuguugugguccauacuggugugguagucgugaagguggcagaaaguaccuggaugccaaauauauuuugaaaguaaagcugauggaaauuguugauauaaugauaaauccuaugcuuagguacuggaugauuggugauaccauuuacugagaccaguacuggggaaggagcaguuagagguggaagucaagaauuuuaaguauguuaaguuuguuauggcuauuaggcauucaaguggagaagucaaguggacaaucaaauaucugggucuggaguuuaggagagagguugaaacuggaaguuuaauuuguggugcuacuagcuagagagaaauaaagaggaaagaaaacagagugagguaccaaguucugggccaucuccaacauuacagguugaaagagaaagaggaaccaguacuugaaaaggaagaagaguagcuggccaguaaaauaggagaaauuguagggauaguggugucccaaaauucaagcaaagaaaguuuuuaaagaaggggauguaacaguuaauuacaggggcuaagagagcuaagagaugcugauucagauaaagagugagaaauuacuuuuggaauugaccaucagaacuuguuagugaccuucgugaaaguucuuucauuggaguggugauggcaaaagccaacugaaguggauucagggaaguaauaauagagggggaagugaagaaaauuauuucagggugaucccuauacaugggaauagagaaauggaguagcuacaggagucaagaaagaguuuuauuuuuggaugggaaauauuucaccagguuuacauguuuacaugcuaauggaaacaucuuaaacuauuuaauuauuuccugacuaauuggaagcaguauguguuauguucuaaaguacauuaaaaggauaacaagaaacauggguuuuuaaccauuauggaacuguuuucauacauaaaaugagggcuagucuaggugagcucaaacucugacauucugaaauucuguaauuaucuacugugugcuucucuuggccucuccaacuuuuuucaccuacuauaguaggcaacuuuauugguuguuaauacuaauagaggcugcagacagucauuaacaaugucacauguaccccaaagucccaaagcugcuuauuggcauugguauguggagccuaguacuucaaaaauucaugucugccaaagccuacacgucagcugcuaccauggucagaggaaaaauggacccucucucccuucugcuuuccacaucugaagcaagugcaucuuauuggcagaaucuaaauuauauccagagcucugguggcaaaauaguuugagcgauauagguuucaggcuuccauccuuugcuacacagaggaagagcacaggagucaggaauagaucauugccaguagguaaucccacacagcuaguauaauuaacuuaaugaaaaauuagauuaaaauucuugcccuaaaugcuuuuuuuuuggccuuaucauuagauggaacuugucauguuuuucuuuccuagucauuaaaugaauagagcauuuacuguggaaggggugcuugguauucuuuauucuuaaaggaauuccaaugcaagaaaaagaauuuuguuuuaauuuuacugucuuuguucauuuggagauguguaguuuaaagucuuauuucauucugugcuauuuuggguacacuucuuucuguagggagcuuagauaugcucagaaaugugagaaucuuagcuacuauagaagggaaugauggggaagaaucuguauuugucaguaguauuugucaguaguaaagaaguuccugguuagaggaaggagaagaauuauucugcuuuuaugcuguugucaaugccaaagcauaucaagauuuuaaaaaaauucuguuucuugguguaaagagccuguaacugcucuccuuuuucuuuucucauuucaaccuuuuuuucuuccgguuaccucuuucaguugcuaagaguaucccaaacucuuauaaaauauucuguaauuuuagugaacugacauuucuuugaaauaucuguuguauuuaagcauuaugucuuauaaaauauucuguaauuuuagugaacugauuucuuugaaauaucuguuguaucuaagcauuaugucuuugauuugacuuguccuguuucauaguucuacccucuuccuagacuuugaguuuuuagagaagguaaaggggaaaauuaaugaaauaucuuucaaaaugaaggcaaaauaaggacauuuucacauagagaaaaccaagggaauuugucuccagaagaccugugcuauaagaaaugcuaaagauauuuuuuaaaagacuuggguaaaugauaccagauagaaccccagauuagcaggaaggaagagcaucagaaugggcaaauauuuggguaaaaagaacaggacuuuuuaaaaagaaacuauauuuaucuuauguguguguauuuaaaugucuuuaaaagacuauugucuuuuuaaagcaauaauaauggcaauuuauuaugggguuuacagcuuauauagaaguaaaauauaagacaauaagaacacaagggggggagggauaaauggaauaauacucuuaauaaaauuuuuauguuguucgaauaauauuucaagauugacugcaguaacugauaucaaaguauaaucucuagagcaacuacuaaaagcuaacauaaagaaguacagcuagagccaggcacgguggcuugugccuauaaucucagcuacuagggaggcuguggcaggaagauugcuugaguccaggaguuugagaagcugcggugagcugugaucacaucauugcucuccugccugggcaacaaagcaagacccugugucuuaaaaagaaaagaaaaaauauagcuaaaaagacaauguaagaaauaaaaauggaauacuaaaaaauaugcaguucagugaaaagaagacaggaaaagagaaacacauaaagaacaaauagaauaaauuaaaaaugcauaccaagaugguagacuuaaauccaaccauauuaguaguuaaauucagugggcuaaacacaucaauuaaaaggaagaaauuuucaaacuagauuuuuuuaaaaaggaaagauccaacuauauauuguuuauaagaaauaacacuuuaaauaugaagacacugacagauggaaaauaaaggugaaaaaggauguaugccaugcaaacaugaagcauuaaaaagcugacauggcuauauuaaucagaaaaaguagacuuccaaacaaagauuauucuaagagacaacaaaagaaauuuuuuauugauaaaaggagcauacaaggaagauaaaacaauucuaaaugucuaggccccuaauaacaaagcuucaacguacacaaagcaaaaagugacagaacuugagaaaaagaucuacagcauaacuggagauuuuaacauccucucauuucuguguaaaugccucucacauuuuugucaauuaugaucuuuugcuaaacccauacagcugaaaaugcaaaagcucaugacuaguuuuucagagguuccuuaguuaauugguauaaaucuuggauagguaaacggaauaucuguuuucuguuugccugauaucucuguaacuuggcuuuuccuaaggccuacccauugcuuucugagacuagggaaauaagucuggcuucuuucaaacuucuuugcucauuucauaugggccaaaguagcacuaaucauuuaaaauucaccaguuaaucuguucauuuucaaccuuauauuuaucaacuagcuauaauuuaguuuugguuuuauuuacuacuuacuggauaacuaugccaguaaguauaguauuuuauuauuuaacuguguucuucuuuucauuuuauuggugauuuuuuucauuuguuguuaaacagagcauuuauugaacaccuacaauauacaagacccacauuagauuuuuauaaaaugagauccuugacuuguuacagagccagaagugggaaccccuauauucaucucugcauauugguuccauccaccaaacaaaauuguuuccuuuucuuuucucccuuaaacuucuguacaugcuucuguuuuagcgcuuaucgcauuguauuguuuuccuauaucugucuucccaguuaaacugcgagcuucuuaaaggcagaagucaaauauuuaauuuuguagcuugggcacauguaggugcuuugauuacugaaagauggauauauggacacaguaaugaacaaaugauuaaaaaauuauuuaaaccauuguuugacaggguaagauuacuuucuaaugaaauagaacuugguaauaugcccuugaagucugauacccugacaaaccgcuucugaaaaucagcuuacauaacuaccagggagaauaaaaaggcauagugcaaagcaaaugcugugugaaagacagguuuccaguguagcauaugugggccacuaauggguguagauugaacuguucucuugccaagagucaucaauaagaacucuuuaaugauggcuuaguucauagauguauuuuggcaugaagaucucuguguuuaacucaguaaacaauaggaucuaguuucauuauggacuuuucauacuucuuaggaacuugucauugggaagauaauuauuuuagacaagcagacauuguuauauguucaguaacacuuauauagcuuggucauaaaauuuguggugcuuggacuagcuuuugggcucuuucuuuaaacuuaauggaaagugccuuaaaugccuuaaucuccauaagacacuucucccagacuagaauggaccuaaagaguucuaauaucugucaguguuuaauuauuugaacugaauaugucagaaaucuuagcaauggaaguuuaacaaauuuaaguauagaaugaaccaguauaggaagauuucauauaauuuugugauacaguauuaaacuuuuuuuuuuuuuaauauuccagggugcucuggaacagggcucaaauucucagcugauggcuguucaauacacagaaaccacuaguaguaucagguaagacagugcagaagcucuuggccaaggaauuuaaaauagcugguauuuuaagaaaguugaaauucacacuucccuuucaccuuaaauuuguucucaucuaugaguuuuauauuagucauauacucuaagauauauauauauauguauauauauauauaacauacuacugagcaguuggaauaaagccagauaauuucaaaaguucaacucucccaaaucccuuaaauacaaauuuagucagaaugcuguuccaucauaauuuugaugaaaaucuugaauacccauagcuuucuugcccuugauuugcaucuguuucaugaaccuagggaagggaauguuauuuuuugagugcucuguaccagguguccugcugaguguuuuacauguauuuuaucuuuaaauccauguaauaacuaaaaguuuauuuuauauauagaaaaacuggucaaaucauuuauuuuuuuuguaauuuucagagucauaagaccuagugguagacucagaauucagaucauagcuguuuuacuuacaaugcauuuuucacuacacaauaauacuuaagauuuugaaagauuucaaagagaaugcuguaucuacagguuuaaaugucuucaaagggaaauauaauaugggaagcaauauggugucaugguuaagaugcuagcuuuauuugcccuguugggcagaguucaaauuauaacucuaccucuuacuuugugggcucaagcagauuacaugcaauugaaguuuucucaucuacaaaaugcuggcugcacagaguugauauaaugguuaaauuagauaauauauuuagagcacuuagcaugguacauaagugccccccaaaaugguaaaugauaaugaugugaugucauugacaacaguaucacugaagugaaauuugaggaucucagcuucuaucuguagcucuaccacacauuugcaguucacuuauaugaauuuaacauuuacuuagaauauacugugugccaguguucuaggcacugagaaaaaaauauagauagauagauagauaguaaaaaugaagucaaaagcuauuuuauucauuauacuaauaacugagaauuccuauuaaaugacaaugagcagcauaucagcaaucaugaauguuuaaaauccugagauuguauuauccuguugaaauugauaauucaaauauguuuaaauaauaacuaaucauucucugcuaaccagaauauaucauucaauuacauuuauuuuaaaaauauaucaauuuuuggaugcaugguuauaauggcaugguauuucuucauuaguuaaaauguuuuagugaauuacagccaauuuucauuauuuguggauuccauauuugcuaauucaccuacuaaaaucugcuaaaauguauuuguaaccccuaauauuagcagugcuuuugucaucauuugcaaacaugcguagaugcucccuggugagguugaacaaggcaguguucugccuuuuagucucagcuauauaaacaagguccuuuucacaguccacauuuuucauauuuuugugcuuuuuguugguaauuuugcuguuugaaauggccccgaggcauauugcugaauugcugucuaguguugcuaagccgaagcgggcugugaugugcuguguggagaaacuacguauguuagauaaguuucauucaggcaugauuuauagugcaguuggcugugaguucaaguuagugaaugaauaauauauguuaaagaagguaucucuaaacagaaacacauaaauaagguuauauauuuaucacuuaacagaaauauuguaaccagaggcuugcaggaaccuaacccuguauuucccccaggaggaugguuuaggauucacuaauucauugcuggcagugacuuuuuagaacauaacuaucacaaaauagcaagaagcgacuauauauucaaaauauuguaaucagaaauggccuagugaacaaauggaguuauuucaaaggaaauucuuaugacucauuuauuacuuccauuuaggucagucuuuuucuccucuuaauaauauuugauugauacauacaaguuuucucuuugaggaaaaaugaagcauuuuuacaggaucccuuuaacucuuccagauauugguccuaaacccuagaaaauccugaacacauuaagaacucuauuagaaucauuugacuguauuuuuuggggcaugaugugguuugagguauuaucauuuuaguuuuuaauuuuaguaaggcacauacaugguacuuuuaauaucaaugacuagcaguuguugagugacuccuaugggacaggauccaugcuuggcacuugacauauaacaucuccaguaacaguccuacaaggguugugugguuauacucuuuuuauugaggaggaaacaguuuguucauggagggcaauuuccccaggagugcccacuugagaagugaagcaggaauucuaaaccaagucugcuuguuuucaaguccuaagcuuuuuccaccuuuuugcacagccucguaggcaagcauaccuucauauauucgacaggguggugaaaaaugacuuuuccucagauuuaauuuguauuacuaaaaaaauuaaaaaucguucaaaccuaugcagaaaucucucuauuuucugauacuuucauuauuuuuacaugcuuugcaauguacuugaccaucuaguacauuuuagagccuugauucagaaaucagaauuuuagcauaagugaauggguucuuauaaaauauccugauccuugggcuuugcaaaauauuguuauaaaaauuacugccaaagugcaacuaauauuuugguugagagagauucuuagaauucagacauagccuuagaaugggaaguauuuugggaaaacaggaaacuuuuuauuuuaguaauaccuuauauuuuucuuacuuuagcaggaacucagggagugagcuacaaguguauuaugcuucacccagaaguuaucaagacuuuuuugaagccauccgcagaaggggagacacauuuuauguugugucauuucgaaggguaaguucaucuugaaagaauagagcaaauauuuuugagugcuugccguacacaagacauugggcugaauauuguggaaaauacaaagaugugagaaauaggaagcaauauaaaauaaauuaugugaguggaacagucuaaguacuguaauauaugcuuuacuuugagcuguugaguauuauaaagaugaacauggaauuggugucagacuaugaguuuguauuuaggaaauauaaacuacuuguugauuuuuauuguuuguaauccugauagccaugcuguuuauaaaaaaaggaaaaguaaaaacauaaaaauauucuauuuaggcuuuuccuauuuaggcuuuuaaaccaauucccauuugguuauugagaaacagacuucugaaauguagguuugagauggaucaugggcugauuauuaauuguggaauguuuggaucuauguuccuaagaaucucuauuccucuuuuaucucuucuuaauuaaacauuugguuggugaagaauguguuagauaaucaguuagcuuauguaaaaguaaauguuuauacuagcacuuuugaauguuaugaauguuaggcuaaauggaaaaaaugcauagcuguuuauauuucaucuacuuuuucuauaaaaugaaaauauuuucuucauagaauugccaugugaauaucucuguuagagugcuguagguuaacccaggagcacaugaaugaauuagaauuccucaguggugguuucuaucccaagcuguuuuuucuuucuuucucucuguuuuuaaacaagagaagggaccucacuguguugcccaggcuggacucaaaccccugggcucaagugauacugaguagcuggcuuucuuuuuuuuuuuuaagaauacacuggguaugguuagaaguaaguacaguugacccuugaacaacacaaguuugaaugaagcagguccauuuauauguggauuuuucucaaccuuagcaggaugccaaacccacuuauaugcagggccaacuuuucacacauguagauuccacagagcuaacugugggacuugaguauguacagauuuggaguuauacaggcggcucuguaaccaguccuccacauauacagagggaugagugucuauacuaacaauagaaugagcaaauucauucucugauuauuaccacucacugucacugaaauucucaguuaacuaguuaauucuuuuccuaagguauaaauaucuagcagcucagguuuuuaggaccagagaacuuugauacuugaaaacuagggagaucaaacaucuuauauauuuucaguuauuaaucaaacaugcuaagagauuuggaacacuuuagccauagcgucucaugaucacugccuuuucacaaaauucccuguguucaccuuacucuaucagacauaacugguauguuucuguacaggaccagccucaaaguuucuuuucagcagcaagggggcagcugagaacaauguuuccugcaaggcuccaacuguacuggucuaugaaaacaaaguauuucccuuacuauugacacaauuauguucaaaguaggagaaaaaaaguaaacuuuuaagaagauucaguacuaugaagaagaaaccugcuggguguuaaaaugauuguguugaaguauauuuuauggaaguuacuguaggagaauguuuuuaacacucaaauagacaguuuuucugagguucaggauaauuacuguauuauuugaucaaaacaguauaacagauauuagaaguaacacuugucaagccauggauugaagucaugguuaguaauguuuuucuaagggaagagaacaaguauuuuuuauagagaagacaauccuagcuuuuuuuuuuuucuuuugagauggauucucucucuguugcccaggcuggagugcaguggugccaucuuggcuuacuacaaccuccaccucccagguucaagugauucucuugccucagccuccugaauagcugggacuauagccgcaugccaccaugccuggcuaauuuuuguguuuuuaguagagacgggguuucaccauguuggccaggauggucuccaucuccugaccuugugauccacccgccucggccucccagagugcuggaauuacaggcaugagccaccgcgcccaaccaauccuagcuuuaaacagacuguauuuuuauaaaagacagugaauggcgguuuaaaaaauauauaugcauugcauuuuuuugcauuuguaaaaagugauuucucauuaguuugcuauaaaagugcuguuagaaaauuauugauuuccacuccucccuagucccuugauguucauucaggaagacuguuaggacuggcucucacacaauuacuauuaggaguaugucuaacauucuguuucgauuuuucauuuucaaauuacugauuuaucacauuuugguguuuuauaucaaggaagaguaaagacaaaugaacugaauuagauaauaguaauuaagauaacauccuuuuuauuuuuuuuguuuuguuucaauaguagggaaaaggaaguuaauuuuaucuugaugacuguaaacuauguuaugggacaggaauuuuguucuuuaauaccuggauuguucuuuuugcucuugcugaaaugaaaaugaaauaauaaauuaccucaugcuuggucuucuuucaucuuucaauauaaaauauucuaacaguuucauuaaaaaggugaguggcaucauuucuugugcagaaggauguagacuuuuucucccacuuagguucuuaauuuuauuggcagaaauuauuauaauugauacuacauuggaaauucagaagaagauuccagagccccagguuucggcuuagcaugaaccagacauuuauaacaaagccaauaagcaagcuauguuauuuuauuuuaugaauggacauguauuuaacaaaauauuuuaauaucuaaagauguagaaguagccauugacuguuucguacuguuauuuaagccacucucucccaaacuuacacucccucacacccugcauuccuguaccuuuuaaucucuuuacaguugagcgguugaaauuauuuucucuaaagcagacacacucuuggauaacuacugaguuccuguuauagcucagcaagaaaaaaugcuuaugaucccaguacuccagacaaagguccaaagugcuucuguucuuuugacucuccuuaaagaguuuuuaccaccaacauaguaaucuauucggcuuucuuugcuuaguuccaguuauuuguagcuuauuuuccuguaaauacuuugccuuuuucuccucucuuugauuuguuuguuuuaguaugauuuggagagggagguuggagaauaacuuuuucucaaacuuccaagucacuuugaguguagaauaacugauacauuaauaagaaaaaaauccaauuaaguuuaaugccuuuuuuguuuguuuguuuguuuguuuuaagagacaaggucucuguugcccaggauggagugcagugguacaauuauaguucacuucagccuccaacuccugagcucaaacaguucuccugugucagucuccagaguaucugggacuacaggagagugccaccacauccagcuaauuuuuauuuauuuuuuguagagauggggucucacuuuguugcccaggcuugucuugaacuccuggacucaauaaugcuuauuuuaaaaauacuuuuguggccaggcgcggugacucacgccuguaaucccagcacguugggaggccgaggcggguggaucacgaggucaggagauugagaccauccuggcuaacacggugaaaccccgucucuacuaaaaauacaaaaaaauuagccgggcgugguggugggcaccuguagucccagcuacucaggaggcugaggcgggagaauggcgugaaccugggagacggagcuugcagugagccgagaucgcgccacugcacuccagccugggugacagagugagacuccaucucaaaaaaaaaaugcuuuuguaugauagucuauuuagggagggagggaggagguugauuaaauaauauaacaaaauuaauucaagagcuaagacagaaacaaauacucaggaaagcucaaauaaaguuaagaagaagaugauuuuaaaagggcagaaaagaaacauugagaagaaagauugggaaaugauauuaauuuauuauuucaauacacauuuaaauaccauccuuacauguagcugucucauccacuaauauauaaggaaagaauuucuuccuggggcaguuuuucauuaaaaacagguucucuuugaaucagauggcugugaaugucaguuugccauauuaucucuacuuguuuaauauuuuucuuuugcaaaugagauggaugccuacuuugggaacauuuuuuauuucuauuacauuuucuguuuucaguaccugucucaaauuguaaguaaacacguaaagugucuuuucaucaguuucaaauacauacauaauauuacagaagaaucugagcuauagccauaugacugccugagagaugucucuuucuccucucuuuccaaguauuuuauauauucuagcaauaguaccauauuuggguaugcaccccuuacuggucccuuauaaaaauuauuaacacugucauauauacggcauggauuauaaggguagccuuaaguaauagggacuuauuguaaguuaugugagauuaaagaagcacaggaaacuggcucagaauccaaauaaucccucugugcuugugcuucauuggguggaauguauacuagucuucauggagaauuggaauagugguuuauugucauuucugauuugacagcagcuccagugauuccacuuuagucuuuuuuuuacacuuuacugauucauacuccucaaacacaaagaucugauuggguaguucuggucaccaucucuuacgcagagaauuacuauggcagcuuuggcuuaugauccacaguuauucauuugugacaagagaaaaaccuggggccacucuucugagaaaaugacuuuggcaggcacugggagcuucauaaacuacuauaccacacagccuguuuuuuuuaauuauuauucuuuuuuccccguucuuaguaagugugcauuaaauucuuucuuguauugguuccuaauuguuugaucuaaaaggcccaucuucucaucuauaugauaagccuuuugaaggcaggaaauaucguaugcuuuugugacuaccccugacacucagcaaugccuaccacugagugcuuacugaacagaaugguuuuagacaugagccauugagagaagucacagugauggaaguuuguuguuuuucauaaucauuuaaaagguuuuuuuuuuuacauuguuuugcuuaaagaaauuggaaucuauuuuacugaucuaagaaguaauauaagcugugcugaaugccaguagaaaguuuaguuaaagaugaucucuguuuuguccauuuaugauuugcacuagccagauaucaucagcuuauucuugucucugaaucuaagcuguagagcuaaauaauucaccugaguguaguguuuaacagcuuucuaugucaguaaguagaacuuugagauacuugcaucuucauuuaaaauuauuuguuggcagcauuuuggaguagauuguuguuagaccucacugauuucuuuuuuggagaagggauggguucuacuauuuguacagauucaagcaguaggagccagaaacuugaaacuuuggaaacacuguaggaaauacugugauuauugcaaaaaaaaagguugacuagugguguuauuuguucaaaauguuugccagagguuuagucccacggaugggcauaaaaacgaauuucaaaaauagcaaugauauuuucuaacuuaauaccuagauuaauaccuaacacaugaagaauggcauauuuucuuaaugccuguuauuuauuucuuagaaauuuauguuuaguuuauaugcauauauaaaaauucaacauauguauauauauaaaaauucaauuguauguauauauauaaaaucuucagaggcaggaggaauuucuuuaguaucaaaggaaauucauuuauaaagucuacuucaaaaggguacagcuccuucuuuuguuucugagaccucaaaacuugaguguacacauagauguuggaguuuggccauuuucuuaucuccacuuucauggccuuugagccaaauucuagcuggaaaaaaaagugaauagaugaguuuggaaagauacuugcauuuuagaaaagggucuuaucucagaagagagauguuuuaaaaaaccuucuuuuagaaggcuuuuuaaaauuaauuuuuagcuuuaaaauauauucucauucaggucuaaagcacauuauaaaaaaauagagcagaguugacugaguacccuagguuaauaaacuuaaccuagauuuauuuaaucauuaugccaauaauguucuuuuuauauguccauuuucuauuucacuuuauuauauacaaauauuaacacuucaauguauacuaccuuuguaguuuacaaaccucuuucacauacauaaucuuagcaauuccuuacauauaaucacaaguauucuuaguccuauuuuauggcugaaaaagcugaagcaaagagagauuaaguagcuuaucuaaggacacaaaaaugguaagcauuagaacuagggcaauaauugauagauucuaauuuaauacagugauuuuuuuuucuuuacauuguugugcuuuuuucuuuauaucuggcacuuuuagauguauuacagcauauguaaauaaauuaaucuaacccuccaaaaucaagauauuucauugaaaaaucugcuggacaguuuuggcagauucauuacacaacuucaaaaauuguuuguuuguuaauuaccugauuauguuuguuuguuaauuaccuguuaauuauaauuauagauuaaguacuuuaauagauuaugcuuucauaaugcuggagaauaacuuaaugguuugaaauauuauaguauagcuucagauuucaagucagggaauagaauaaauaggccuugaaaguuucugguuucuuuuuaaaacagugucugaaauuuccaacaugguggaaaagaaaugucuuugcuuugucuuaaaaaggaaguaguuuagcaaaaacagaagcuguuuuaauuauugguauucuagagcuucucauagaaaagagugggguuuuuguguguguaaauacauuuuauuauggauucuguauauggcgugcuagaucuuugagaucagaagcauuugaucucaaacuccuuguuaaaugugaguuacuguugugugguuuuagaggauucaacuauuuguucuuugucucuauaacauugcuagcuaacauaaaaacauguuuuuuacuuacacuuuucaaucacaaagucuaaaauaacuugcuuuauguuugagaaaagauuguucaguagucuguaaguagacuuguauauagccacaaacagagaacuuauaacucaagaauaauacgaagucuucaaaauucucagaauggugggcagauccaucugagucaugauaauuuuucaaugguucuuauuuguuugcucuauuugguagucuuauuauuaugaaauguguuuuucauaugcauuuguuuaaucuccccuuuucagguuguaugcuuucucugugcagggauaaagucuauucauucuguuuugucuuuuacaagaucuauugcaaugcauugcaggcucggcagaguaaguccuaaauaaauguugacuacucagaccacuaacuguuuauuuguguuguuuacccuuauuuuuuauguccuacucuucaaaagauuacuagaggugggguuugcagaaacaaaggaggacauuuuucucaaugaauguuuaaaauuacuucggugacuuggauagcaaugaaauuuuuaagaauauauagucagcuuugguguggguggacuuuuugcuguggaauagaauaauuccugaaagacuucuaaaguuacuuugaaaaaaggcaggaauuagggugggaggugggagaggagcagaaaaaauaacuauugaguaaccaggcuuacuaucugggugaccaaauaauccauacaacaaacccccgugacaugaguuuaccuauaaaacaaacaugcacauguaccccugaacuuaaaauaaaaguuaaaaaagaagaaagguaggauuuaaugauugauagcuuaaaguucucaucaaauuuuuuguaaugagggaagaaaauauuuccccaaagcagaacugcauucccagaaagaacauuucuucacaucaugaauaugugaggaaaaaauguauuuuaaacaacugauagguacagacccuaggaaccugcauucuagccccaauguugccacucagugacaucugcuaugugacuuuagacaaaucacuuagucccucucaucuucaguuuccuuauauguuaagugauaaaguuaauguagauuugcuuuuuuccuucuggcuccagaaaucuauaguuuuuaucuguguguuugugugugugugugcuuuccucuuagaaagcuguaguauugcuuuaaacucuuugaaguuacuaagugauucaaucuaguggagucaguguauuuuaagaguuuugaaaaacagccauaacaaaaacaacaaaaugugaaguuacaagguggggcuauaaauuaaugaguuuguuuuuugaauagcuggcaguuuuguaauuuauuuaauaacacuuauacagaacacaauacgauaaucuuuaaucuuuauaauugagauaggugcaguuaucaucauuuuacagaugaagaaccugaggcagucguguccauugugaacuccaauaagaaagauuaaaaagaaggaagaaaaaguccgcuguagaaaugaaaaaacaaauuuauccauugugacaucguuuagaaauagcagucagaauuuaaccaagaaagucuggcucuauguucuugaucauuucccucuauugccuguuuaagauauccaaauaucauaucuuugaagguagucaacuuggaguuuaauuccguugaucucucuuuucaaaacauauuuugaguuguuucgggaucauuuuccagagacuaagacaaagcccuguggaaaaccaagccacauguuacucaaaguaauaguguaggaggaacaagagccagcagggaaacacagaggaaauuauuagaaauauaggagaauuggaagaguacagaugaaggaaaauaaaucaacuuguuuauguuauuuuaaaaccuagaggucaaggaagaguucagaaaacgaggcugucagugguaucagauguuauagcgcucccuaagaaugagaaaugaaagaaacucauuugucuuguguaaacauuaaaaucauugguaacuugagauuacauuuauuguagaguaaucagaacagaauccagaaaagagauagaagagaaugggaaagaaaaacaaugguuugguaaaucugacacuggaaggaaauggagauagccuagauauagauaaggagaagagaacuaagaguguguauguauguguuuguguuaaggacaggagagauauagggauaggguauaagguaaauaaggacuauuguaguuaguuuauauacauauaagaauagaguuuauguuuuaugcuugacagauguucuaaaggaaaauaaacaagucauuguuccuccucuguauuguuuucuguuuaaaguaaaagcauggagaaaguugaacaguuuuuguuuauuugcaguaggacuacagaaaagaaaaauaaaagagcguauggaauuaaaaccagauuuuugaaaaaucaaaucauauuuaaaguacugcuugagauaucaaaagucuuuuaaaucuuaaauacagagcugguuuuuaauaaugguaaagaguuuucaaaauguuaaaguuuauagaacuauuucucauuuaauuauauguaaaugguuuuauaauuuuuucucacauuaaguuagaaaacuagcaaaguaaccuacauaaaauuugguauaaccuuucuuaugaugucacaaaacuuaauuauggaggaagcaauuauuauaauuaggaaaaauugaugacuuaugaucugacucaggaucaaggucugaaacacucaugucauuuccuccccucuccuauauaguauacagugauuuguucauuuuggacucuuaauauuuuaacuuuugacaccaucagcaaaucuaaacacugacaguugguguuuuccugaaaaauguuaaggcuaauaauugugugauauuuauuucaacacauugcugcuagucuucuauaaagaucucauuauggguaggcuuugaagagauauccaguucauaauaugggcaucacacuggaagccugcaagauggaugauuggcugagaguaggaguguaguuucuaaauaauaauaagucuguuuccccugcuaggaaguacccugagggcaggaacccucuaucuuagucaugacuuuguucccaauacaugguauaucaggcauguagcagguauucaauaaacauugaaugaauaaaugaacaaauuaauuagauaccaaauccaucaguuugacacuauauucuaaauuaguuuauauagucaccguaaugugauaaagaaauugugauagucuaguuuacugagcauuguuaucaggaccaucugugucucauguuuaagucuagaaaucagucuuugaaaaugagugaauucaaaugcauuuuuaaaagucuaagugccauuuugcaugagggaaauuauauaccuaguaagaauuucucuggguuucaaagucagaacacugaucuugguaauacauggacagaaaggauuauuuuucaguuaggguguuaaacagauugugcuaucauuuuaaccucuggaaugaauaagccccagauuuaauaagcuccuuauguauaagaugccuguuauaaugugucuguaauguccuagaaagaugagacuaccccugcauagugcuuauuucuugcauggaaugaauuuaagauaagcuugucaaauuuuaaaucugacauagacuaucuuuugaauaauuuauuuggagucaucucugucugauuauaauaugcccuaaaauaaaucuugaaaaauuaaaauauaucauacagaauaaacagucuacauguaacaguuaacaguuacauguaaaguguuauucagauuacauuuuacaacuauuucuuuucugauuccauuuuuuauugaauagaaguucaauaaauuuuauucuguuaagaaugagucugucuuggagagggucagugucacauauuuacuuugaaguuccuuaaagagguuaguugaauucuccccccaaaaugugcuuugaauuagcagcuuuugaauaucuauucuaguagagguaggagcaauaugaacuagagagaaugauaugcaauaaaaauaauaauuuuucuuugacuuuggaaugaggauaaucuaaaccacagccauguaggcagacauuuucugauguauguagguauguuugcaugucugucuaucuauccaucuccuuguuuucuauauauuugacccuaaccuuucaggcuccuauuuugccaucagguccaaaaccaaacugagcgauaagagaguggagauccuuaaaucagugguucucaaacuuuuugguuuccacauuccuuuauguuuucaaagaaacauuaaugagaagaguagcauuuuguuaacauuaagaaaaaccucuuuaauaacuggcuuaauagaaaccagcuggauucuuauaucuguucuuuuuggucaaaauauaugaagaaaauccagccucacacagagauguaauuggaaaggaaggacuauuuuaaaagccuuucagauaauuguggguauucuuugaugcuacaccaaaaugcaacaagagguaguuucuuaaagguuaguugcaacacggaagccaaaucugugaacuuuuaguacucugaaauuaaaauccauugguugaucuugcacuuugaauggaucuuuuaccugugcaagguuuuguuacaucauacauuggucauuugaaaauacugguucacugaguuaugcagaucuuccaaauguugacacauuuuauuauguauuaaaaugucacauucuuuaauacuaucacaaaucuuaucagaaaagucuuuaaauauugugagcaguucaugguagcagauagaaguuuuccaaaauucuaguuuucacuugaggguucaaauuuuaucauugucaaaaauaugucaguuuuccuugaagugguagauucacuaauuuauuuucaagaacauaucugucagauacccaaggcuaaacaacuauaauuuaucagucuuucaaguaaaagugguguuccaugaagaaaguagcuagugcagcucacaacucaguuacacaagugguuuuccucuagacaacaauuguacuuugauaugcagcagaaaugcuuuauguguauuucccauuuugucguacagaauauuaaaaagacuucuacucaagggucaagauuucauaaaauuaauaacuuuuauugcuucaucaaagacuuccuucaauuacauugacugugugugguaugugcauguauaugaacauagggcaguaauaugaugaacuauauaauacaguuugauguugcugucuuaauucaugcuagggcaccaucauugcuuuugcaucaucaguguaaauaucaacacaguuguuucaagauaaaugaugagauuuaagaaaguuauucaacacugaauauuucaguacuguuaguguuuguugccaagcauuccuauaaaaggucuuuguuguugauuacuuggggcucauacugaauaaaucuaagcaaaacauaaaguuuauagauucuuccauuuguaaaacaaaagcacaauucuguaguugagauauuaacucagccuucguauuugcaacuaaguguaauuugaugaauuaacauaugguuggaaagugucaugauuucuuauacugacuuuucagcaggcauugagcaaggucgauuauccacaauuuuauuagucucucagcuauuauaugcacuuuuucagucauugcauuauauuaauaacuuacaauguaggauacuuccguggucuuuucauuuccaguaugauaagcuguaauagaauuuuuuuuuagaggauucuucacaccuguguuuaaaauauccaguuccauuuucuuugaacucuacaugauugguuucagaaugacaucacaacuuaauuggcaccauuauaguauuugaaagauuuuguugcauaagcgacaagaagauagauuauucauaugucugaaacaagagaaagauggcuuucaauguauggucauuuuuuauuaacaauuuugaccaguuucuuugcuagauuccaccuuuccgugagucauaaaauucucaaauauaucaguuuuaucuuuucuguaucuuauauguagacaguauaguuguggguuaaggaggcaaguuuucuaaucuccugucuuuuaagccagcaauucauucuuaaauauaagaaaaguauguaauagauuuuuauaugaaauauuaaaauuuaagaagcuguagauagauuuagaaaacuuuuccaaaaagauuuaaaaauaauauuauaaaacaaaacaaaguauacauucuucuuuguuguauuuagauagaaguuucaguaguggaguccauauaacuaagcuccauaauaauguguuucauaacuuucuccauuauucuacuacuagaucauagaaggcuuguuucucuuaagguuuaguuuuuucaugcacucagaaaauaguuuuucaggaaguauguacugaguauucugaggauaugcaaggagcauggguuccagugauaaauaauacauagucucugugcucagggaacuuauaguuuaguuggugcuaaccagauaaauuagcaaaauaauugacagauauaguaagcaugaugaaaacacacaauggacucagagaauaacaaggaugcucuccugagacagcgacauuuagcugauaucucaaacauggggggaauucaaggauuccaggcagaggaaagagcauaugaaggcaguuaaguaaggcaggaaagagcuuuauuugaggcacugaaagaaaaccaaugugacaggagacuagugaaugggaagggggaugaguaaugaaaaugagguuugggagauuggaaggggcuaguucuacaaagccuuaugagcuauaguaaguaguuuggguuuuauucugagggccagcaaagggauuuaagcagcagaauaacacgaaugauuuaguucguagaagauguucacugcuacauggacaaugcauuagagagagaccuauuaacaguaggagcagagagagcagagauaccaauuagaaggcuuuuucaguagcuccggcaaaaugaugauggcagcaaagugaugaauggauucuaaauacauuuuguggauagauuuagugagaauuggagagauauuagauguguucagauuucugucuugaauuacuagguagaaaggacuaucauuuuuuacuaagaugaaaauauuuggggggcacgguaauauguuugguauaaauguggagaguuauuuuuggauacauuuaaauuugaaaugucugugagacauucaagggaaugugugcaauuggcucugugaaucugggacucaagagaggauagaucugagcuaagaagaguaauuaagaauugucagcucauacacauuuauuuauuuauuuggagacgagucuuauuccaucucccaggcuggagugcaauggugugaucucagcccccugcaaccucugccuccuggguucagaugauccuccugccucagccuccugagaagcugggauuacaaguguuugccaccacaccugacuaauuuuuguauguuuuaguagagauaggguuucaccauguuggccaagcuggucuugaacucccaaccucaagugauccacccaccucagccucccaaaguguugugauuauaggcaugagccaucacacccggucagcuuacacacauuaucucauggauuuacaugggaauaauggagucaucaagaagagaguauauagagagaggaggguucaggaccaaauuagauuuugaauuggagaaggaugagagcagcaaaggacgguucaggaccaaauuagauuuugaauuggagaaggaugagagcagcaaaggaggaggguucaggaccaaauuagauuuugaauuggagaaggaugagagcagcaaaggagacuaaauaggagcggucagcaaauagggagaaaaccaagagaagagacuuuugaauggggaaggagugguuuauucuugaauacuguugagacguuagauaagaugaaggauugguuuucacuggauaugucaacaugaaagucacugauacacuugacaagagccuuuuagugaugacaugaaacauaaaaguuaaagauggauuaaguaguaaggaagugagaacagcauaacuauuuaaaaauguuugccuauaaaagaaaauagagaaaagguaggguuuugucuuauuuucaaacucuagauaucaauuauauauuuuaaaggaaugaacccauagauaggaagaaagcaauguuaaaagagaagucgaguccuugagaaggggcaaaaggguggaauucagauaacagguggaaggauggcccuuugcuaguaaggcaggacauuaugguagaggcaagaugaguucauagauaggaccuuagguuccaggaagauaaagagaagacacuucuaacaguuucuguuuucccagugaaggacaucucaacugaugucaucagcugaaaguaaggauauuagaggagguguagaagauuuaagcagagaggcacaaguaugaaguaguugucuuggccagugggauagugagccuacuagagacauuuggauugugaggccuugguggggugucaguaugccguaugcuuuaaagucaaaucucugcaacagaaugccagguguagaguuacaguugauuaauaagacacagccccuguacucaaggaguuuguaaucuagagaaugaaagacauauaauuacaauauggugugaugguugugaugaacaagguaaauauagggugucauaagagcacacauuaaccaaucuuggaggggcuguccuaugcaaggaggucuucauggagaccuaacagcuaagcuaagaccugccuguucugcaaguaccuuacuuaaagcuauuacauaauagcugcuggggaugaaaauauucuagaagguaugauagucacacuguauuauuauaucuuuaugcaguagcuuuuauuucugcugacaucaucaggcaucuuugaaauuucuuuuuuuuuuaacacuucgaaaugcugugaagcaaaguaucaucccucucuuuccucacccucuucucuuccuuaacaccuuucuucaguucuagcuguuggcagcuagaugcaacuuaauaaugccauuuuguuuucauuuggcaugucauucaucauuuucaaaauaaauaaacuuuaauuuugugcugccacaaucaggaauauuugaacauuuagugcuuaucuuggguaucugcccuuauuacuuucugaggagcugcccuuuauagcaaucagggaacuauaccacuuggaagacuaauugucuuuauacaaaaauaaaauccuuguguucagauuucugucuugaguggcugguuugaaucuaauuuucuguuauaugaagcaaagauuuauuauuuaacauaguuucaaaauuaaaauugauagugaaauuuuaugugccaugcaaugucauguguguucuuuuaaggugaagauucauuuuuuaauagcuuuauugagguauaauugacauauaauaaacugcacauauuuaacaccacauuuuaugugugauauguauguguguguguguguguguguguauauauguauauacuuauauaggugaaaucaucaccauagucaaaauaaucagcauccccaucagucccaaaaguuuuguuucucaugccccuuuguaauuuuucccugcccucucaccagucaacugaucuuucuguuacuacaaauuaguuuauaguuuuaaaaauuguauauaaagggaucuuaauuauauauauuuuccuuccagcagaauuauuuugagauuaauccaugguguugcuuguaucaguaguucgucuuuacugcuaauauucugguguagggauauagcacaauuuacuaauauauucaccuucuacuguuagcuacuacaaacaaagcaacugugacuauuuguguacaagucuuuguagggacaaaugcacucacuucccuuguguaaauaccuaggagugggauggcuggguuauauaguaggcauauguuuagcuuuuuaagaaacuaccaaacuacuuugguacaagugguuguaccauuuuacauucccaccagugggaauaagaguugcagugccuccauauccuuggcaacacuugauacagccuaucuuuuuauuuuuagccauucuaauagagguauguagugguaucucauugugguuuuaauuugcauuucccuaauaacuauauuaauuuugaccaacuuuuuaugugcuuauuugccauccauaaaucuucuuuggugaagggucuguucaaaucuuucccgauuuuuuauugaguuauuuucuaaugauugagauuucauuuugaggauuuuguguguguguuguuuuguuuagcagcuuagaacacacacauuuauuaucucacaguuacuaugggucaggaguccaggcauagauuugcugggucuucuacuccaggguuucaucugaaaguaacaaucacagucuuggccagggcugcaguugcaucucaagguuuuacuggggaagguuccacucauaaguucacaugauuguugguagaauucagcuccucgugggaugccgaacuaagggucucaguuauuugcucaguuggagauuccccucaguuccugccacaugggccucuugauauggcagcucacaacaugacaacuugcuucaugaaagccagcauggaaguguuuauguuuacugguuuauuaugauuaacaaaggauacagaugaauagcccgauggaagagaugcauagggcaagcuauguggaagggguauggagcuuccauacccucuccaaguaggcuaccuuccaggcaccuccucauguucagcaaucuggaagcuuugcgaguucuuuauguauucuauauacaaguccuuuaucaaauacaugacuuguaaauauuuucucccaguuuuuugcuuguauuuaaauuuccuuuuuaguguuuuucaaagggcagaaauucuuaauuuugaugaaguccaauaugucagcuuuuuauuuuauggacuguguuuuuaugguuuuaagaaauauuugccuaacuaaaggucacaaauauuuucucauauuuuuuuucuuaaagucuuacaauuuuagguuuuacauuuagguguaugauccauuuugaauuaauuucuguauaugugcaagguguauaucaaaguucauuuuguguguguggauauccaguauuguaugauauucaaugcuguguuuucaccuaauagcuuuuaaaggaagaauuaaagcaaagccaaguuaaauagguuauaccagacuguuaguuuucuuuguguuauccuugacuuuguuagguugcacauuuugcuggaacuucuuaaaacaguauccuaugauugaacuucuucaaccucaaauuuccagucuuuauacuuaaccaaugaaauguuauuuauauacucuuuggaaacauaacauauacuguagauaauuauaacaaaaguguaauggguagcagaagauauugccaaaccaaaauucuggagaccagaugagacaaacacauaauaugugccuguaugggucacagugcuaggaaauacacugaaaagugaacaaagaacuaaaaauaagccucuuauaagaaaagcugcuacuucugggcuaaucuauuaguaguuuguuuuccuuaauuugaaaaagagcuucagaaucagacucuagagugaaucuuuuaaaacuauauauauuaugcauguauacacauauacauacucuaugcauuggcuuagauaauauaaaaacagcacaggaauaguuuaugcuguaguauugugcagucuuauucagaaauaagaaaaauaguuuuuccauuuagcugugagucauuacuuuuuaguuucguggagaaauuaaguuuuagugggggucgauacagcuuuuuuuuuuuuguagaaaaucagguagcaugggcuuuggagucagacaaaucucgguuuuaauuuucaguguccuuaucucuaauauaguaauauuaauaguuaccucuuccuggguuguugagagguuuaaaugaaauaauaaguuaaguacuggcacagugcuuaacacauaauagguauucaagauauguauacuucuuuaucaucaggggauugaccuuggaagcauauggguacauagaaagaacccauaaaaggauaugacaaggggagaggaguuuguuuucauuagauuuagcaaauucauucuuucccccaacuccccagaaaaauucauuuuaaugcuauuauuuuccuuaucacccauaaacagacagaaaauuggcauguuucgaaagaguguuaaaacugcaagaguauuacaugguaucauuacacuaccauccauuaucuaacuggguuuauuuaugaagguuagauuuagauaauuuagacuuacccuuuuuccauuuuguggggaaagagaaucagaaacuugaaaggaagagcucuuccaaacagaaagauagcuagaaucucucucaauagucuauauaaucucuucuaauaaucuuuagcaaaagugacuuuugaguucuuuuaaauauuuccuguauugauucuaauucagugcucauuucaugugaugucuauagaacuacagacuuagauuacagucagaaaacugaguaacagcagacaccagguuuucagcuguuuuuaggguuuauucagauugacuacaucacauucauuuggauggauuuagugacaucaauugauaauuguaaagaaacuagccuuuaaucugacauuuucauauugauauuagauaggagccacaugacuaugucauggguucauucacaagauauaauaaacauuauuuucacuuguagcauaaaagcagucuuuaguguuaucuuagaagcauuaaaacacacacauauauaaaaucauauagauuaaaaaauucuaucagcauagguucuguaauuguuaauagauguaauugcauaaggucgcuaugcauuauuucucauuuucagaugaagccugucaccuugacauuuuuauauauaauaggaauccacagguuguuaaaaacauaaggaaauuaagauaauuugaauucagauuauaaaauaguucaggucuauucugaugaagcaaugucacuuaggucugaggcuuuugggucagcuuuuaaaaguuuaucuuauuuuucauuaaaauauguauguauaauacucuaucaugcaaagagaaauggucaacagaauuucugugcauauaugguugcugguuauuugaaagccauucuccuccuaggauuauuugaccaauuuuguauucagcuuagauuagggagaauauagugucuccuuagguaaaauacuuacuagaaccaaaaaguccagauuaaauuguuuuuauuuuuauuuuacugcaguuuugugcaguugaccugauuuuaaaauauaaaacuaggaaggcauauuuuucaucuaccaaaaugugaaucuuacuuucauuuugaaacaaacaccucugcuuuaagaagaugaacgguagugauaaauacaaaaacguuaaaauuuuuuaaaugaauagcguuuguugaucuuuaaagaaaacauaaaugugaaauaacuuuagagcuuaaaaguuuucuuccucaaaccuuuuaggaauugauuuuauuauccaaaacaacuuuauucauacuaagugugacuaucugaauaauuaccuuacuuuuauaguuuuuuuuuuaaaaaagcucuucuaacuguaauuauccucaaagaauuggauuaagaaauucaauaauuuucugucauuaguccagcgagauauuuacugaauagccauuacguuccuggcuguuaacacuacaaggacuccagcaaugagcaaagcaaacaagcccuugcuuuuccagagcccacauucuagagucagaugcuaaacaaauacacagauacauauauaauaaaauauugguuuaaguguugaaaagcaaaaucagaguaagaaggcagguagucauuuuaaauuaacauugagaaauguuuccauuuuaagcauauaaauucuuuggcuucucuuuuuaaauuugcuuuugacuguuuguugcuggcgaaaauuauuuaaaguaauuaggaacucaucguaaauauuuuguacacuacucuaaaaaucuaauuccaacuagugaauuuagcauuuauaaauggaggugucuauagaggaauaaaaucuuugguuaaccacuacuuuacuuuuagcaguaaagucugcagcucaugaaauuuguaauucuggagugguuucaguuugcaccauccccuggggagccuguugauacagcacugagcuacagauuauuauucagcuguagaaguuuuaugcuuaggcauuuucuuacaucuucuucucucagucaguugaaaucuuguauuuuugccaaauaaaacaaauccuauauuaauaagaagcuauaaauaaacaguaggagcaugagucagagccagcaucaccccauuccuuguguguaccucucuaguacuccccaguauguuccuuuugcacaaacauguaguacugcguaacuacuguucuacagaugaacuccaguuauuuaagugaggccuguuuuuuagaacuaaguaauacuguaacuaguagaauucuggcauguuaccacagucaaaagcagaaugugaagcuguaugcuauugaugggaggaaaaaagaaauauauuuccuaccuuuccuguauaaagcccagaagauuccuguuagauuuccaaaauggguuuuuauauaauauaauauaauucaacauuuuuuucagaggaaaaaagaaaaagauaaguugcuugaaagucccaucucuuuugcuagucggcuucugucugauaaaauuuuauucuguuuugcuucauuguuuauucauucaguagauguucauugaacacuuacuguuaccaggcacugugcuaccauagacgguauaaagacaaauaagcuaaaauccuuguucucaaggaauuuauuauuguagagaaaagugacuuguaaauccaaaauuucauacugggauaggaacuauaaaagagacauccugcagaauacugagauuauaaauaaaacuaguauguuugaagcauuuaguguccuagcuguuuuauagaagucauuucauuuaauccuuucaacagcuuuaugagguagauaucauuacacuauuuuacuugugccaagagcacuacauucaucaaggaaggaggagguaguaucaaauuuuucagaaaacaagagaguugguuauagaaggaugaguaggguagagaguaggaggaagaugaggcaguguggcauuucagacagagaggugaauauguaagcacacaggaugagugagagaauuguuggaauguagucaguucuaggaaauaaaagauggcaggguccagaucaugaaguuugguucuuaaccuguagaagacagaaauaugaucagacuugcauuucaggaagauaacucuguaauuguuugcaauuccuguuaaacgaagaaauuuucuccagcauugacuuauguuuauuaaauacauauaaaaacuaaauucuagaaacaucuuauacaguuauacaucacuuagcaaugggauacauucuaggaaaugcauugucaggcaauuucuucauuguacaaacgucauagaguauacuuacacaaaccuagauguauaucuuuguuuauauuuauuuuuucauauggaaaaccaaauuucuuagccauguuacugaaugucagucauuucccuuacuugaucugcaucaccaacauuaagugccauguaucagauuucuguauauguuccauuauaaucucaugggaccaccauaguacaugcgguccauuguugacagacacaucauuauguggugcguaaguguacuuauaguuuuacaacuacaaagugaagcacagagagguuacauaacuuagccagugucacacagcuaauaaguagcaaagucaggauucgacauguuaagccaacuucauggacuuaaccacaguccuguauugccacuccucuucauuuaaaggcaugcaugcacauauuagauuuggagacaguucuagagacacugaauuggcaacuacagucgacaaagagacauugcagcaaguaccucuacguuguuuguuucuguacccuuaacuugcaguggucuacaagaaagaaugaaggaagggaagugauauauuugucaacccuaacuacauuguaaaaugaagcuuuuuuuuuuucuuuuuuugagagggagucucgcuuugucacccauacuggagugcaguggugcgaucucagcucacugcaaccuccaccucccggguucaaucuguucuccugccuaagccucccgaguggcuggaauuacaggcauaugccaccacaccuggcuaauuuuugugcuuuuuuuuuuuuaguagagacgggguuucaccauguuggccagucuggucucgagcuccugaccucaacugauccgccugccuuggccuccuaaagugcugggauuacaggcuugagccacugcacucggccugaagcauuuuaugaugcucacuaccaaguguucauaagcgguaaauaaagcccuugggcuagguaauguaagauccauugcaaccuggagaugaagaacuuuguaaaggggauaauuguuaucacccaucagagcaucagaguuuuaagaugaucuagauuuagucccacuaauuauauuucuccuaacuuuuauagacagagaaaucagugaaaaauauguauuucuaaggauuaaaucccaauccauagcucaaggcuaccuuuaugucuaauaguugugauauaauauguugcuuagaauagguucuauaaauggaauucacacauaggaccccagaaucgcuucuucacaggguuucagaguuggaggacauauaaaaggauaaaucaauccauaaaucucuaaguauuccuaaaagaagaguggugugucaguuauuggcaccaguacaucaugaauccugcugggcuguggagaaaggagaaacuaaccugaacaagacuauacucuacacagcugucccugacauucuaccaccuguuagcauucaguauuaauuucauggaucaaaucaaggcaugcaagugcauuaaauaacuuuuuaaaaaacaacugcugauugcugacgucuaugagggaagaaaaauuaggggcuguuauuuuccuaucaaccaucacucucauuaacaagaacaggaaacauuacgaauaaauaaaacucuuacaucauaccagaaaaaagaacagcugaauccccuaaaggauuucauauucuaucaucagacaacgaaagaaaauaauuccauauaaauggcugcaugaaucauugaaagaaacuucccugcuuuuuuaaaagagcaacuagaaguauuuacuuuuugaaaauagaguaaccauuuguuaaaccguauauaccauugaagauguuuuggguauaaaagggaauuuccauaauaauuacauaguaaucuuuuauagccaaaguuaugaagaagaucaggauuugggaaaauuguggucaauauuugauuuuccuuuucuguuugauagccuuaucuaaauuccccuagcuugaauguaguaaauaugaguguguaaaaauguguaucuaauucaccucuugggggagguuuaauguaacuauaaauaaaaauucuuuccccagguuaaaaaaaaaguuacauaguguuuaauucuaccuuuucucauuucucuauauccaaaacuaucaccaaguacuguuaauuuuacuuuauaaagcucucuugauaugucucuucaaccucaucaccacugcuuuaaaugaggcauacuuccucauuuggauuauggcagcagucucucuuccuuuagucucuccuucaaauccaccuccauccuucauaucauccaucauguauuuuucccugccuaaauuccuugguuggcuucuauuaaauccaaguuccuuaagcauggcaaacaggggccagcuuccacgagcugguccauaccucuccugccuuauuuccugacacuuucccuuauaccuugagauccagcuugccaguauuuccccaauaccuccaccgcauauacaaccacauacauauacacccuuauccccucccucauguaccacccauauauaauucucuuuaccgcauccuuuaucacacuccuacaagccuugaagcaaucugaacauagaaaccaucuuugauuuucaacuccuaauugggacugaacauacuugucuugaacacagauugcugccuuguuaguauagguauccuaauauggcacauguguauaguugaagcuauaaugcauuccccaaguucccuuucaggacuaaaggguuauuucccaacagcuggaaguccugcugccagacagccuucuucaggaauugccuuguccccaacucaagacaacccugaaggaccuuucccaguuuuccaugggguccacugaggccuugagauuguacugaagucaacuucucccucugcugucgcuucccuuccacagguguuuaucacaagaacaauccuuaauaaacuuccuguaagcacacucucagagucagcuugcuggggaacccaagcuauaacaacauguuuaucuuguucacacuuucuucugaguucuaaaucaugggaaguuacaguuauccaaaaucuuacuaauuggaagaucauuucaucagacguguauugagcaccugcuucaugucaggcauugugccagauacaauggaaacaaaucaagacuuggccucuguccuugaguuuacagucugaggugacaguuacauaugaaccuaacuguauuaaagcaucuugagaaucuuuuugauucaaaugucaauaauuuuaguauaaaauucaaaagcauggauuuugugguguuacaaagaacaaaaggaaaauauuucaggggaaggaaaaugaauauaaauaaguagaaugaaauuuuagaagagcacagaauuugucuuuauaauucugaaagccuuuagggaaaagguaauuuuuucacuuuuuauuuugacauaauuucaaacuuacagaaaagucacaugaauacugaacucccauacacccuuuaugcagauauaucaguuuuuaacauuuucccucauucuguuucuuuacacacauacaaauuauuuuugugaacucucugagaacagguuaaauacuacauuauaucacuucauaccuuaaaaauguaguauuuccuagaaacaaggguauucaccuccauaaccacaaugcaguugucaaauucagguaauuugaccuugaucuuuaaucuacaguccagauucagauuuuguuaauuguccccaaaaagaugaguuuaggaagagucauauaacuuaacauuuguaauguaaauuaaagaucucggaaguuugcuaaccugauuuaaauaccacagugaaaugaaccacuucugauuuucuacggagaaagcaaggguuagguccagguuaccuguaaaggugugacuuagggcuccccagaagugaaccuugcucuggagaccccauuuggugagguucuuuucaaaagagauuguauauuuuugacccagggauugucgauuuguugagcucccauguaaguaugccgccuugccauugacaggucuucacaaugcuuucuuaaacgacauucuuuggaacugucuuucauagucaggcgacccgccagccaggccgccagguagguggaagggcggcuucgggaacuagauccggcugguucucugcuaacaugugguccucgaugcucuagcggauuggccccaaaccucagcacacagagcuuugguagggcuggggaugcaggucagccugcugaaggcgucuagaggacuugggcgggggcgugacuuccugcugcaccacuuccuuuccagccacgugggcuucugggacccuaugacauaauuucuggaguggucuguugggaguuguggcggcggcgaggcccaagcacagcuggccaaggcggguguaaaacgcgggucguguccaccccaaagcucgacgccucuagaagccauggcuuuucugcugaagcuagagccggacaugcaggggaaaguagauuuguuucgagcccguaucgcccaggaggccgaggaucucguguccaccuucuuuccucagaaggucuuggagcugaauagccgaguucaggagcuccggcugcaagaccuguccagaauccauucggugccaaccucggagccccuggccaccccaggcaacaagggagaugggcccaaccaaaaucugccaguucugcugacucaguucuccaucaaggucccagcacugcuuggcagcgagggacagcuucugcggagcaaccagcaucugguggaguugacugagugggugaaaccugagaucaagcugcugagagagaaaugcaacacagugcacauguaggugcacccgcuuauccugaaggugcaggacggcaacaacuucagggugucuauccaggaagacacuguggaccagcuguggaccguggauagcacagcggccuccucucuaugcggcuucuccaccuacuacaacacccaggccaaguugguauccaagauagugaaguacccccaaguggaagauuaucgcugcacuguagcagaggucgacgaaaacgaguaccugagugugcgccagauccugcugcaccuacggaacgaguaugccaccuugcgugauguaauccuuaaaaacauugagaagaucaagaucccucggagcaccaaccgugauaaccuauacugauagccuuucuccaccccauuugccuucaggaguuggcggagcuguuuaggcaccuagaaggcugguuauuaaugacucuacaggucaugaaauuacuggaaauguguguuaccauuuagaauuucauacagcuuauccucauacugaaucaucuuuugguguaauuuuuauuugauuuuccuuuugugaggagaauggggacaaaccaucaaaaagaaaagacugccauuuuuaaaagcagcuuuauagauaaauguuggcccaagguuucuuuauuauggccuuagcgacauugaaugguuuuaggggcuacuuaaaaacuaaaucuuaaaguuaaaugaaguuuuuccuaaaguucugcuauccguugaacuuuguucaaacuuacagaaaugcuccuuuuacagcaucauuuuucuuuuuuugcgaggaacggaguuuaaagggauauguuuaggucauuguaugccuccaguuuaacagauugaaauaaaacuugguuauaaaauuuugugauggccugagugugcuuaucugagcuuuaauuuucggauguggacaauucagaugauaauuuccuacuucagguggacucauacacuugauauuuuucaacucugauggguaagaaaaguaagcaaagaguaauguauuuuaauuauucuaaacaaauggacaucuacuucccuuagaaugaaaagaggaaucuguggaaaaugacuuccuuccauaaucuucuaucaucucaggaucuucauuucuuuuuacacaauuuagaauuccuucuguauauccguuugucucuuuaagucucugcuaaauccaucaagcuguguauccuguaauacuuuuucccccaguugauuuucauugcccuuucuuuuugucucuuagauauuucuuaaagucccucauuagcauuucccucucagguuauacaggucauucuuuuuuuuuuuuuuuuuuugagauggagucgcgcucugucauccaggcuggaguguggagugcaguggcgugaucucagcucacugcagccucugccucccagguucaagagauucuccugccucagccuuccuuaguaccugggacuacaggcgcaugccaccacacccagcuaauuuuuguauuuuuaguagagacgggguuucgccauguuggccaggcuggucucgaacuccugaccucaggugauccacccgccuuggccucccaaagugcugggauuacaggcgugagccaccgcgccuggcgggucauucuuuaaagacccuaaaauguggcuuuguguucuuuugcuacgucguugaggggaagccauugucuucucaacaguaagcuauaugguugguauuuuuaaaguucagcauuuccagauuucauuugcagguaagauaaauuacugcacugugagucuauucuaaccuauguagauuagaaaaaucauacacugguuuagcggaaacuuuauuuucuuucuuucuuucuuucuuuuuuuuugagauggaguuucgcucuuguugaccaggcuggagugcaguggugcgaucucgacucacugcagccuccaccucccagguucaagggauucuccugccucagccucccaaguagcugggauuacaggcaugugacaccaugcccagcuaauuuuguauuuuuaguagagacgggguuucuccauguuggucaggcuggucucaaacuccugaccucaggugauccgccagccucagccuccuaaagugcugggauuacaggcgugagccacugcgccccgccacggaaacuuuauuuucaaaguaaacuccugaaaaaugauaacaagugaaacuauucuuuugucgaccuucugaaaagccugagucuuucaaaucugugcuuaaaaagcaacaacagcaaaagguauugccuaauagaaagacgucuuacuuccuuccccuucaaguaaaaagaguucuuuuuauuuucccuguaagguguucuaucugauucagaaaagugcugggaacccuaaaucaguucauaccauuugacaggcuuuaauugcacacaaguguauaauggacaauguaagggaagaacaaauguugcuuaauuuuucaacuaauguuaaucaucuaagacuuaacauaucuguuccucacauaauauaaucaucuuuugcuuguuucuuuuacucaaacugucaagcuuuaugacagauugaaauaaauuuucuccaaucccuggcaugccuuuuacugagaaaauauguccuuuguaguuaaagauuucugguauaugcauuuuucaccuuuuuccaacucuguaucaaauuaaguuggcucuggaauacuuuauaaagucccuacuucugcaaaaauuaaucucuuugugauuuuccccuuucuugcaaaugguuggaaaaacuuuuauaauaauaaacuuaggaacugguguuacaauaugguauccaaugugaaucauuugccuguuauuaguacuuguuacuugaagccacguuuuuguuccuuuuaagauggcagcugaauugagcagguguuuuuuuuuuuuuuuuuaagaaaugguuuuaaaaacuuauuuuggaauuaaguaauuuuaguuuuaaauucuaaaacuaaaacaugaagaccacuaaaauuugauuggaaguugaaauuaguagaucuaauuuuuaugauugagugaaaugucuuaaaccacauaaaugauggagaagagucuuaaaguucuuaaacuucaaacuucuuaaacguuugggcuuaguuuuaaaaaauuacugaaucguuuauaaauuuuucuuugguuauuagaggcaacauuuguuuuguagucuuuuuuuuuuuuuuuuuuuuuuuuuuuuuuuuugagacagaguuucacucugucacccaggcuggaguguaguggcgugaucuuggcucacugcauccuccaccuaccagguuuaagcaauucucugccucagccucccgaguagcugggauuacaggcgcccaccacuaagccgggcuaauuuuuuuuuuuuuuuuuuuuuguauuuuuagcagagacgggguuucaccaucucagccaggcugaccgggaacucuugaccucgugagccacccgccuuggccucccaaagugcugggauuacaggcgugagcugcugugccuguccuauuuuguagucuuuaugagguuuacauauuuauauagaauucuuaccaaguagucucaaccauuaauagauaacugugugaucaauuuaagugauuuuuaauuucaggccagaugcaguggcucaugccuguaaucccagcacuuuggggggccaaggugggcagaacacuugaagucaguucaagaacagccuggccaacauagugaaacccugucucaagcaaaaauuaccaaaguuagcugggcauggugguguguaccuguagucccagcuacucuggaggcugaggugggagaauugcuugaacccaggaggcagaaguuguaguaagcugagaucaugccacugcacuccagcuuggcugacagagugagaaccugugucaaaaaaauaaauaaauaaaaagcuuuuuaauuucaaaaguaccaucucaauggucagaaauuugaaaaguauaaaaggagaaaucaccuaugguuuacuagccuaacaaaaucauuacuauuuguguguguuuuacuuauuuuaaaggaugcauauauguuuuuacaucauugcaauauaguauaugccuacuuuuauagaggauaaacaucugcauuuaaauccaaucuaauauuauaacuucguuugauagauauccccugauucagauaacagauacauccauucccccaaauauuuuuaaggcucuguuuccuaauugugaaaaugauacuugucugaggcaggaauugugauuagaguauggaacauagagaucaaguagcugggaggaaaugugccuauaugacugugagaaugucuagauauuuagaauaggguuuuacucugcuuuuagguuggggcuucauaauagcuuuagcaacauaucugaucauuuuauuacucagugcuuuuucccucccccuagagcauuuaauuaccucuaaaaauauguacaagaaagcauucaugccuuauacugauuagaugaacuguuucagcuuucaugauuugguaugaguaggagggaauucuacuuccucugucagcacuuaaacauuucuggaaaaugcuguagugcauugacaucaggcauuuuuaaaaaauuacugaucuuugagaaaaaauaaaggacccagugaguuacagaaauagaugcuggaccaucccuguucucugcauuagaaaacuauacugcuaacacauagaaauaacugcucaccuugaacugaaauuauccaugggaagccaaauacauccgucuaucuauccaucaaucgauagauagauguauuugucucauucugucgcccaggcuggagugcaguggcacaaucucggcucacugcaaccucuaccucccgguuucaagugauucucccaccucagccugccaaguagcugggacuacaggugugugccacaacuuuuguaauuuugauagaaacaggguuucuucacauuggccaggcuggucuugaacuccugaccucaagugaucugccugccucggccucccaaagugcugaaauuacaggcgugagccaccaugcccagccuccauauuggaugauuauacauuuguauauauuuuucuuugcuugcuuuauuuugaugagucuucaagucaguagcagaauuuuauuagugaaguguaguaaucccaguuacucaaauuuaaaauguuucacuaguaaacugaauuuaacgaauucucuuucauagagaauguuguguuauuuuuccuuauuggugaaaaccuagcuggugcagaugaacaggaaucgaaccuauuaucaguaaaauuagauuccuuuuacaauuuggccauuuauuuuagcuuuauuauuuaaucucauuuuuacaaaguuaugcaauaguauauuggaaaaauaauauugcuuugaaagugugaaguauuuagaauuucuuaaauaaauauauaguuuccaguuuagauguuugagauuuagagguguacuuuuagccccuuguuuuauagaugaagaaauuuagaaucagagauauauauggcagcacacaacucaucugugacaaaacaaggucuagaagucaaaucaucuuccauuucaggcuagugcacuuuucacugcacuuuacuauguucuaaucaguaaauaaaauuacauuagaagagaguucuuucagaaauacgcaaaccaguaaaauuucaacaaauuaacaucccuuucaaguuguguguuauuuuuuucugcaaaauguaagagaaguugaaauguuuccaacucagaauggacuauaauauuuuuacugaauuaaauauuauguaaagagcugggcucgguggcacacaccuguaauccuagcacuuugggaggcugaagcgggcggcuugccugagcucaggaguuugagaccagccugggcaacacgaugaaacuccaucucuacuaaaauacaaaaaguuagccgggcaugguggcaugcaccuguagucccagcuacucacaggcugaggcggggguggguggaucacuugagccuggggaaacagcgauuucagugagucaaggugccauugcacuccagccugggaaacagagcgagacccugucucaaaaaauaaaauaaauaaaaauauucuacuggccaacuccucccccaccuucuaaccuucagcaccaaagaacugcuacauagauuugucauggcugcugcuccuaaaaaaccuacagaauaaaaggggaaagaagagcuguaguuuucuguucgggaggaagccugaaagggucauuucccaaaagaaguuuaucuuuuagagcuggacuggucaguacaguagucacuagucuugaaauguagcuaguccuaacugagaugugcuguaaguguaaaauacacacuagauuuugaagacuuagggugaagaaaaaguaaaauauuuuaauaacgcuuauguugcuuacguguugagugauaauauuuuggauacauuaaauaaaguagauuauuaaaauuaaauuuauauguuuccuuuuacuuuuuuauuuugugugcccgaaauuuuaagguuauauauguggcuugcuuauaugccucacaguauauuucuauuaaacaacacugcucuggaacuaagauuucuaagguaacugagaugauccuuggaguugagccuaaaccugcucuugugguauauuuuggagauguggguuuccauuaaguauagauuuuuuugacuccuaguaaauuuuuauugauucgucaucugguucauaauguacaauucaguaaaagccauucagagagaggcuaaacauuguaagccaaaccuucuuacagugcaacuuggucuuggaacuuagaaugcuuacaggaauggauggcuagcaugugcuuuaugcaagccuuuuaaauaucauauccaggcuuuuggugagagacuagaguacuaauauucuguauugcuaauucagggcugcuccauaugcuuuauaaaccaaauagaggguagauuuagcaugaauauugagacauuuacccaguguuuuuaucuggaugaaagaauaacguaccucuggugccucgagaguaccuauaggcaguuaggcuuuuucucaaggagcaauauuugaacacucaauuaaauccccaugauuucauugaauucccauaauauaguuauauaguacucauuguauucuguguguguguguuuuuuuuguuuuuguuuuuguuuuuuuuuugagacagagucucacucugucacccaggcuggagugcaguggugugaucucagcucacugcaaccuccaccuccuggguucaagcaauucuccugccuuagccucccaaguagcugggacuauaggcgcacgccaccacgcccagcuaauuuuuguauuuuuaguagagacaggguuuuaccacguuggccagaccggucuugaacuccugaccucaggugauccucccaccucggccucccaaggugcugggauuacaggugugagccaccgugccaggccuguauucuguauuuuuauguauauccucacuaaauaaguuucuugagaauaguguaggguuuuuuauucacccuuuuuccauuaugguguuuugcauaugguaaaauucuaaaguauucugaauuaaauugagcuaaaccaaaccuggaugaaacuaaagaaaaucguuucuccccuuucuuauuagaggaggcacuuuguuacaacagaggauauauguggauaaguguacccaggaauauguaacaauguugagacaucuacaaaucugauucagaauuaaacaaaggccaaugaaguuucuacacuguuuucuggcuucuaauuaaacauuuuuuucauaucacaauaauauaaauauuuuaaaguacuccaggcaguucuccuucaguauucccaggaugucauuaagccuauucacccugcaacagcugcaaguuauuccaaacauuuguacugaaucuuuacacucuacaagcccauuugaaaucaacugugucacccuauuaacagcuucaguaauucucuauuacuuuucuaaccaagaguuagggagaaauaagucuaguauaucagaaugaagaauccugaaaauugcuuuucaaaaccgauucucuguggucacgaacauaauguuuuuauuuacccuuccagauuuugguacuuaaaaaguuaguuucuuaaauguguaaaauuuagaucauuugauaaaugauuaaaaagaauuucccuuaaguuuauuaagucuuauuugguaguaaauauaaaagacaaaacauuccauguaaaaauuauuucauacauuuuaaacaguuuaaauaaaguaaguguagucaacucaaaacuccacugccuuauuccucugggucuugcauauuuauugguggaaauuuuucucugcuauuuuuuuacauuuuacauugugggauaggcacagaguuauugaaccuaugaccuauauauuccacagcuuacuucaaugcuucuauuaggcacccguccagaguugaagaaacgucucagaucacagcagguucucaaaaaaugucauuuuguuuagcuucauuucaauauaacauugaugagaaaaaaaaucaguucccagcugggaccacugucuguguggaauuuucacguuuucuccaugugucugcacagguuuucuccaguuuccucccacauccuuauaacuuuugcuucacaaacauuuauugacuuaacuuacaucacuacgaccaccaucacuuacugauucaccaaaaauugcauaaauuaucuuacuuguuuuuauuaguuuuuauuaaauguauagcucacauuuauuucaauauuuaauauuagaagugcuuggggucuuuauuuagaaguuuggugauguuuuuauagccagaaauaugcuguaggaacguaacucucauuuauaucaauuaggcuaucauaaaacugguuuccuuuaugucauuucgcuuaaagaauuuauggacgacgugaggaauaguacucaacuuuugcuuauaaauaauuaacagauggcaugaaaaauaauuaacagaugacaugaaaagagaccucuuaggaagcaauuuuuacgagccugcugaacugggaguuaacauuuucaauaagaagccauuaagucaaauauaaucuuuugcauuuaaacucuacaucauuauauuacuagaagucuaaaaaccaaacaguaugguaggaagaauaaaauguuacuuaugaauauaauuucugauuauacuuuuagaaagaggauuaaaaguauugacaacaaaugaagucagaauagcuugauuaaaguaguuuauuuaaaguaucuccuuaauguuauaguguaugcuaauuauuugcuuugcauauguacacaucaugacauacauuuaugcauuagcugagacauguucauucuguaaguuuuguacaaaacuaaugaucuucaguuacacaagaacauuuaaaaguuuuacauuugaaauagauaauuaagcaaugcugugugaaacugaaaaaugaaaacuuugauuaaaaaaaguauuuucaaauauaggauaguacauguauaugagaauacuuuuuuggguauaaucuuaguaacaucauuaugguguuauguaaacauaugacauaugacauauaaaauuauaguagauagaucacuguguuacccacuuacacauucuucugucguauuaagcaacaaacauuauucuuaucuauaauaaagcagauauuucugucugucauacauaugaaauauuuguauguauuuauuggaaguaauuuuuaaggcuagucuuuuuuuauaauuucaacuuuuauuuuagauuugggguagaugugcagauuuguuacauuggcauauugggugaugcugagguuuaggguaugaaugaucccaucacccaauaaugaguauaguacccaaccaguuaguuuuucaacccuugaguagacauugcuccaaaggaagauauacaaauggccaauagcacauaaaaaugugcucaauaucauuagccauuaguagaaauaaaaauuaagaaauguuuaaaauauuuaauguuuuauuugaaaaaaaaaacaauuaaaauuuuaaauaacauuuuuaauggaaaauaauuauaucucccaaagcaaaaaaaaaaaaaauuagugagaagaguagcacuguuuuacaguuuugcagauuuuuaauaugugauuuaauggaagauaacaagauucuuauauauuucuguauucagucuguugcaauauauuguuuuaguugaaauauaugaagaaaaucuacccucaugcagguaaguaguugcaaagggaaggaguacuuuaauagccuuuucaaauaauugugaauuauuguuuugauacuacauaaaaacucagcaagugguaauuucuuuaaagauuaguugcacuauagaaucuaaagccauaucagugauacuuuuacccucuguaacauuaaaaauccauugaucuaucuugcaguuugaauggaacuuguacccaugcaugauuuuguaacaucauucacugcucauuuggaagauacugguucacuaagaguuaggcagaucuucuaaauaugaacauauuucauuauacaaugucaaaaaaucacauucauuaauaucaccacgaaucacaucaagaaggucauacucauggugguagauacaugguuuccgaaauucggauuuucacucaaaaucccaaauuuuauaauuugcaaauacugucaaguauuuucuuugaaauaucaggcuuacugcauuuuuaaaaagugcuuaauggguuacccuugccugaauaacaauaauucgccauuauuucaaguaaaagugguauugaaaaaaguggguuguucagcuuguaaaucauucacccaagugcuuuuucuugagauagccauuaugcuucaguaggcagcaaaacaguuuuuuauguucuugcccuuucaucacagagaauguuaauaauuuuuacugcuucaacaaggauauucuaaacugaaauuggcuuuaaaauauuuuauucauuuauucauuuguuggcugauucauuguuacuguauguggcggugaagaauacagugacugcuagacuagcuuggugccacuacauagauuuauacuaaggccuagcaguuuggcuuugcuuuuucaccaacagaguaaauuucaacaaagugcaaaaaggcuugaaaauaguuugaccugaaagggucuuagagauucuugccuccuuagggaaaaaacuaguuaaaaaucuauuauaauagcucuccuuuagcuaguuuacauuauaaaucguuugugguuaccuacuauaugaaagguuguaguagauccuggggauucaccaaugaacaaaacagaugaaaaugucugcuguuauggagcucauggagcucauuuauaaaggguaacgauauauaauagguguuagagagaaaaguaaagcagagaaaggaaaggagguguguuuggugggaauguguguguacaauuuaacuaagguggcuaggaaagaccucacugagaaauugacauuugaaugaagaucugaagugggagcagguaaaggugugugccucuacaaaggccacagcugaggccgcccuucuuuaucuaccucuuuucaucuuuccaacuuccagaccuuuuuuuucugcugauaacucauaccuuuuaauuaaacuuuaauuuaauuuaauuuaauuuaguuucuuccaacucugcucuccaccacuuccuugccccuagcacacacacaauuaaucagcacuuacaaaaacaaaaauuuaccucuuuacaaaagguacagggauagaguagaggcuuugaauacuugugcuucaauuauuuuucuccugucaucuuuuauauuaaaggaaauaaaauauaggggugucuccuuuuccugguugaauugguagagaauaucuauggcaguuagugcuaauguuuauaaaaaggaauaaacacaagugagaucaugauggagagagaccaaaucaguagggaccaaauuauaaagagauuucauuucuaggcuaaagaguuuggauuggucaugugugccugucauccuuuauuucauucaguaguggaacaauggcucucaacuaugugguugagggaauaaacuuaaacaacaaaucuaaauuuccuauaucaguugcauuuaacuguugcguuuccucagggacuucacucuccucaaacuuuuuggucccuuuuuuuaaaaaaaaaauuauugaacacuuauaaguguugaaauacuaacuugucuaaucuuuauaaacaaucggugcaauagguguuguuacugucccuauuuuacuaaagagaaaaugaggacacagauuaaggaacuugcucuauauccuacagcuagaaauuaagugauggaagcagaauucaaacccaggcagucuagcuccagaguccauccuuuuaaucucugucugugccacucuggccaguguuugugaaugcagaguccuggaacuaucugcaucagaaucaccagggauacuuguuaauagugaaaaauucuggcccaccucagacuuaccauguaagaaauuguuuuucaagaguugaggaauguggguauuuauauuauaaaauccugcaggugauucugauauguaucuuuuguuaagaacuucuguuuuagaaggaccuaccauuggcacuguuuuugcuucugaucccagcuuccuaugauuaaaugcuuucugaaagauacauaguuaguacagaacuuaauacuauuauacuauucuauacuauuuuaccccaguuugacuuuuaagcuguuaccaccugaaauuuaaaugaaauccuuuuuagaacaauacuugaccaaacaauuuaaaaauuguauuuccuacaaaugcaucauaccuuaaaaaugcacuuuaaaacugaauggaagccagguauggugacucacgccuguaaucccagcacuuugggaggcugaaguggguggaucaccugaggucaggaguucgagaccagccuggccaacauagcgaagcacugucucuacuaaaaauacaaaaauuagcugggcaugguggcgggugcauguaauccuagcuacucaggaggcugaggcagaagaaucacuugaacccaggaggcagaguuugcagugagcugagauugcgcuacuguacuccagccugggugacagaaugagacuguauaaaacaaaacaaaacaaaaaaacaaaaaacaaaaaaaacaaaacacacacacacacacacacacaaaacugaauggaaacugagaacuuacuguucuauuuaugaugaaagaaaacugguaggcuuuagaaaguacacccuaugugauaugaaaagugaacucuucuagauuguggaacagcuuuauauaguaucauaccuccaucuuuaacuaggauugcagcuggcaauaaagcucagcuucuaaugcgagcaaguguugaguuuggcuauuuuguuaacccaagauccugagagaaaauuuguucacugauguacauaaagcauauuaugguuaaaauuucuuauuccacuuuguaguuugccuuguuaagacuagucuuuccuaaaaugugcuuuaggggcauuuuauaguccuccauauuucuuuaugugacgccaacaucaaaauugcuuugaaaaggaucaagaucuggagugaaggcuggaggaauagcuagacacugaggcucaugcaaggagaguuaacuuuagaaauauauauuacaugaaaccccuuuuuuucuccccuuccagaaauuuguagaaucauugauaugaaagaguuggcuaguauaucucccuguguucccuucccacccugcugugcuauccacacaaacacaaguggcauuugagguaacuuuugagauucugcuggguuaaaaaaauauauauuuuuugucucaacccaauauguuccuuuuuuucaacaaaaaguauaaugauucuccuauauaucuauguuuagcuuuuugcuagaaguguuuccuaauaacuuuucucaggaaacuuguugacucaauuuacuguagucauagagccuccuaccugacccccuguggucugcuuugguaacacaccuguaggaggcaauguaaucuucaggaaauucacuuccuaccaguaguccugaguaaagugaauuuucuaaaaugaaacaucuuguaaacauuauauaugacaaacucccaaaugguuaaacucuuuaugcauuuaguguuugaucuuuuuccuuaagaagacuuuuuuuuggauugcuguccuguuggcacucaacaaauuacaauugcuaauaaguuucagaggcccuaacuuauuuuccuaaaucauauacuucccaguuuuugaaaaggcucucuauuauagcuaacaaaguuuugaacuuugauuaacucaaguguuuuuguuguuguuguuuuguuuuuuguuuuuuguuuuuuuuugagacggaguuucgcccugucgcccaggcuggagugcaguggcagcgaucucggcucacugcaagcucagccucccagguucacgccauucuccugccucagccuccugaguagcugggaccacaggcgccugccaccacgccuggcuaauuuuuuuguauuuuuauuagagacgggguuucaccauguuagccaugauggucuugaucuccugaccucaugauccaucugccucggccuccgaaagugcugggauuauaggcgugagccacugcgccuggccaacucaaguuauugaaugaaguaauaugaagcacaugggcagagacuuccugguccuauaccuguccaaggcauguaaccaacauuuuguuuaagagcuuucccuagggagaucaauccugaccugguuuagaaacauuuuuuccugaaacucucaugaaaagagaagaaugauuuuggaugcuacugucuuaucggaaaguauuuacaagaaaccauuuugaccaagaaacucaaaauuaauucugguuuuuaaaaagagaggcauauauuacucuuagauugaaccuuaugaaauuacugauauuugacucaccaaaaugacaguuuuuuaugguccaaccuaauacuuuuugguguuaauaaaaggggaggcaggguuaguugggcaguuugugggggacauccuacagaguuugacaugaaaaguauaucuuaaaucaaaacuugaauuuguacuuauuaggauuucaagcucauuuuuccucuggugaccuugccagcauuaucagauuuguauuaagugucaaaaguuuccucuugucaaaguguaaaccuuggcucauucuugggccaucuguuguacacuaauaguuuugauuuauucuucuggcugacaugcguauuaaugguacagaugcaagcuuuauauuuccuuuuaugggucuguaguuuuauugcauacauuaguggcacaaauacagcauucauauuagcuauuuauaugaacuauuucuaguuuuggggugacuaauauacuuugcuuauguuuuuacuaugcugagaagcccuguaucguagacauuuuaauagacuuuaaaugauuacauucuacuuaauuuuaccaccccuaauuuuguuuuuuguaauuuuuauuuucaggauaugucaugauguaugucuguauauuuuuaugauuucaaauucccaaauugccauugcuuuaaugaaugagcacauuugguuuuugaucaggaauuacuauaacuacuagaaaacaacacuagugcaaaaugugaauuuagauaaauaacucugaaaggccuacuucuaguugaugcuuuggcucugauuuuugaggguuaauauguucuucaacuucuuugacagcuugaaaguuaugaaauagagugauagaaaacaaaagcucucuaggacagggacauagguuagagaaaauuuaauacaaagcuguuuuugaaauaaggcuaggugcuauuuuuauuuuugaucugcuuuuaacaguuuccuauauuggaaaaccaaacccaucucuggaauccaguggauaugggccaaauauaaaauguuaagaggcugguguuacuauuggucugcuaugcaaaacuuuuucccuaauagaggucuguguugaucugugugaaagcugcucagugucacaagugcagccugaguuucauucauuucuaggggaaauuaugauagaaauaacauuccuuucuauuaaagauaaagggcuccaaccuugagccagaguuuucuaauacaguagaagccaucuuaucuauauaguggguacuaguagauagucuguuaauaaacaauacuggcuaaaauaauuuuuuaaaaagauauguaucuuuauuucauuugauuauauuaaugugcacucauuggcuaguuuuguaugcagggccaauuucuuuucuuugaguccaaauccacucuucagaguuccauguugccauucuugcauaaacuauacucacaaaucagcaaccauaauuuccagucuugguuacaguuacuguauauuggaauaagaacuuaaagguacuuguuaagcaaucugagggcagacuauuaugauuuuuaugguugcuuugcaaggagagaacauuuuaaaacuuaccuuuaucuuuuugcucucuuuucacacuauuaguuuauguaauauuuuauuacacaauuauacuaauacaauuaaugaaaguagucuugaaaaaagacacaacucaacuagucgugaauguucccugugcuaugggcaccagucagugaguuuuauagggggaaugggaagggucauuuaaucagucuguacucuacauagauacguagaaucaacauuugauaacucucaguagggccugaauuuuauugugaguuaccauaauuaauuucaguggagcaaaaugugguccuuuucuuuugauaagccagucuccaaugcuuuuguuuucuuaaaaagacaagaaacguaacuuugaaggcuguguuauacacuaauauucuguugguuucuaacaaauugcuuggaagagggaauugggagaacuauaugaaaguagcauauuuucucaugcacaauauugcacaacauuagaaaacugaugcuuuauuuucauggugaaauguuuugauguuucuccccgcccccuccccuccauguuucucuaacuuuuucugggaauaagaguaacaauacauugauuauaauauuuguccacaugauuucauuccagaggaaauccuauaguaucuaagcccuacggaaagccucauaaagacauuucaggaguccauucgaagaugucuuaaaauuaaugacauuguuuugagugacagugccgaaauauauuucuuucuauggcaacauucuuauucuacuauccuuuuuauuuuuaaguaguuucauuuuugucacuguuggguuauuuuaaacaauuuaauuggagggaaagaaauacaaauucaucaaauuuuaccuccagaauugaauuuccuucacuaguuccuuaauaaguauuuaaguaaaagggggugcaauaucaagaagacuaaauuauaaauaugguuucuaugcuguuaaaaaauaacaguccuguccuuaauuaaccauuauggagauuccucuugaccaaauaccuuuagaacuguuucacagauuuauaauuuaacuaguaauuugguuuagguuuagguuuaagugacagaaaauccaaaauaauaguggcuuagauaaauuauaaguuuauuucugucucauguauaaguuucagagaucuaaugauagcuacuuaaucaucgggaucccugucuccuucugucuucuugcuccauaauccucaacuugcagcuucugucucauggaacaaagacggcuacuccagcucuggcagucauaucugccuucuagcuagcaagaaggagaaagggaaggaggagggaagccuuccaccauuaccaccuugaagaaguugccauuucuucuuacaguccguugaccagaccguguagccuuauuugguugcaaaggaggcuaggaaauauagucuuuauucuggguggccuugugcccaacuaaauaucacaaguccuguugcuauuuuaauguuacagaggaaggagagcauauauuggguaagaaaaaaaaaaaggcuguuucugccacaauucaguuuccccaacaaaauaaaaacuuggauuuauauucuuuaaaagaaaauauccucuguagcacagugcugaauacaugacaggacacugugcucaguaaauuuuuuuuaagugaacaguaagggccggucacagaggcucacaccuguaaucccagcacuuugggaggccgaggcgggcagaucacgaggucaggagaucaagaccauccuggcuaacauggugaaaccccgucucuacuaaaaauacaaaaaauuagccgggcaugguggcgggcgccuguagucccagcuacucugcaggcugaggcaggagaauggcaugaacccgggaggcggagcuugcagugaauggagaucgugccacugcacuccagcuugggugacagagcaagacuccaucucaaaaaaaagaaaagacaguaagaggccaguaaauauuuauugagugauuacagcuccuuuguuucugaaaaugugacucacaguacuaaugaucugaaaaagaguaagaugaacacagagagaaaguaaugauucaggauucauuguugugagguucaagaaacauuuauuuugaggaaguggagguaaauauucaaugaaguuaacuacauugucccagauauauagauaagauagauaaaauguauauauuauauagacacuuauuuuuauuauaagauauguacuguuagaguugguaguauaccagcuuugguucccugcagucugauuuuugggccucuugguaaacaaguacuuaaaaacuguuaccccaguuugcaaaccuuuaauaauuagagacaaggcagguuaacuguaauaauucguaugcaugcaagauaugauucuucuuuuucauaaaucauaccuaguuuuuagcuuucugcugcaaaaguaacuaguuuguuagaaauuuagugaaaagaaaaaguaggagacauuguguucagaagaucauguuuaaaaacaacaauuaguauggcaucuguaucuuagcaggaaacucagaauuaagucugagccugaccuuaacccaugaccaguggaaucuaaguuuguuuauuuuuacaauagccuuaauuuggggcuugcaaguuuuuugguuuguuuucacauucaauuuagagacccugaagcaguauuuuaaugauaggaauuaagcuauguauaacuuucauggcuugaagaucagcaaauucuguuuuuucuugguuauaauguuaucuuaaucagaaaugugugaucuuugugucuaacaaugcacuuaaaaaaacaaaacaaaaaauucccuugcugcaaugcuggaauucuaacagaauuuacucaucuucucucuccuccccaauuuuuaaaaacauguucucauggaaauguugccuugaauuacacaaaauacaagcaguuacuggaaauguuuucuacacaguucuguucauguauaucaauuucaauuuguuuuucacuuuuuagauuuuuuucuuaguuuugcugauaaucacacuucauaaucauaucaacuuugaacuuugaaguuguguugaauuuuuauugcucucagcuguaucagauccuacuuuuugaugaguuauuucauauaguaaguuuguugaaugaauggugaaacaaugaacacaggaacaagaaaagaaagcaaaaugcaucaaacuuagguuuaguuuuaucuccaguuuaaccaugcucccuuaaauggaaaugcuaauauacuucuuuuuuucuuuuuucuguaacaguucauauguuuuugcuaggaagaagaggaguuacugaaaacaguaguuaauaucaaagucauaagucauuuauaaucagccuuagaaugccuacagauguauauacauuuuucaaaacacuuauacucugccuuuucugaagccaagcuucucuuggcuuauucuuacuuuuaguacuugugugcuggaaauuagaaaccucagaugcccugcacaguguaggacuauacaauugugcuaggcauguauuuauaauucuuuaacucuucuaccaaacugugugcuuuuuaagggcaaaaacuguacaacuucuuuagcaugcaccugucacuugcaaauaaaugucuaauucuguggucccuucaaagggagaagaggaggcuaagcaggcaaggcucuaggccuuggcccugcuucagucagaaucuuucuuguacauguugauaauuucuuucuucuacagauagaaaauuccugggauaagaauuuugaugggaaaaagaguuuauugccuuuaaaaaaaaaguuugagaaugacuguuuaggggagauacucucaguaucuugugacauuaucuagucuagcccccaucauuuuacaggacuggaaacugaaacacagaaaggauacguagucuuguccagauuauacagcuauuuaguggcagaauuagaauuaaaaucccuugucuugacugcuugaccaguauucuuuauaguggugcuacagcauauguguuguaaaaaccuaggaguuuuccaagaucacugcauagugccugacaacgguagacacucuguaaauguguauuacauuaaugaaugaaugauucuaagcugguuuguaguuaauuaagccaacuucaaauaaaaacuauaauuuuucaucaucccaacgaaauauugaccucuuagaagcccugaauuuggccuguucuaggacuaagccaauuguuauauauaacagauuguucuuuguuaauuuuaggaucaccugcuguuaccagcuaccacccauaacaagaccacaagaccaaaaaugucaauuguguuaccagcaauaaacauaaaugguaaguugaaauucugauguaugaacaauaugagauuucuuuguuuaaccaggauucucuucauuaguucaaagacauuuaaaauguucaguuaaaugaguauauauccguacauuauuucugaaacauuuuuccacuguuuuauuauuuuuaagauccauuauucuuuuaaaaaaaauuacuacaucccuaaaagaaaaaguagcuuucuuuuacuuacaaaauuggaaaagcuagcaucuugacugcucuacagacuugcaucugcgacccuucuagucauaaauguaguguaagaagccccugcuguguucugacagugaauuuguaaauuagauuuuuggaacucaaagcaguuuccuguguuaccuaaauguugauaucauccuagaccaugccacagaagccuguuuauguuuaauugauaauacugaugaguuugacacugauaguauuacuauugcauuuuguuauauuacuagcccuggacauuaaacaaaauacaaauaauaauauaaugcacagauguuaaggcauaauauaccugcuuauaguuuagaagaaaaaaaaagacaagcacaaaaaucacuguacuccaaagagaaagucacguaaguaauaugugagguacuaagaaaucuagugaaaagagauuacuuucagcuugauucuucauggagaagugaaauaacucacucccauuaccaguuguggauuauaaaugagcacaguguauguuauugacuaauugcuuucucugacacauuauauugaaaaucggagaguuggccaucuuuuucaaguuuguguaucucacauaauguagguacuaguaaauuuucugucugguagcaaaaaccucaguauaugaagaagauggaaacgaaaagcccuuugaacuaaccugcagucgaaccaguucacauuuugauugauaaauauaauuaaaccuucaaauacaauuauaaaacaaaacacuagaauuuuggggggauuccagauaaguuucaauaaaauuuagucuuuaggggaaaagugguauucaucauacauuuuaagaccauagaggaccuuagaauuucaugaucuguauauagacagcuuauuagaaaugcuuaggaaguaacuucauagacauaaacauaaaugggcuuuuuguuaaagcauaaaaauuacaauauuuacuuagccuuacaaagacauucagaauaaguuuaagaaaaacaguaacauugagaagaacaucucuuucuucaguaaagacauaccuuugaaguuacucauggaauaaucauuuacuaccugaagaagaauauauuccaaagugcauuuuauuacauuccaaagaauguauuuaggaagucucacuuauacucaaucuauagguaccuaaguuucucugccuaaacuagaauagaccaaagggucagcuuaugcucagaaaggcuauuuucuaagcuuuaucaaggcagaauucacuuaauuuuguucuucugauauuggguucuuaugcaagagaaugccuggucuuauuuuguaacagugagcuaucuuuauauuaagccaaaaccaacaagaugcuguuugacuauguuuaucuuggccaggugacugauuuuugaagaggagccuuucauggauuuggaaaaauccagucauuagaggaucauugucuuuuuaaucuguuucagacucuuuguaaauagucuuuuuaaaaacuucccuuuuuaggauaaguccuauuaaaaaaucaaaauucaaauucaagaaauauugauugaauauauaccguguuucaaguaccaugcuacauccucagccuuuucucuuaacagucuugcucugaggauacuucuuaaauuagagccugauuuuuuccccuuccucauguaccucaaagucugcagcagggcaggugguauccuugcuucccacuacaacuuucaaauuauuucuccuucaguccccuuaacaucuugcaaaucugucacaucacacuuuacuccucuaacccuuauuuguugcugccgucuacuccaccuucacugacgacuccuccacugccucugucauccugcugucuaacuucagcauccgcauagaggagucauuaguacucuagccuuuuuugauccagucaucuuuuauuccgcgccaccucagccucccauccauauggucauaaucuagaccuuaucaucaucaacagcagcacucucuuugaaaucuccuuuucaggcaucccacucucugacuguuacuuacucucuuacuuuaaaacucacacuccaacuacucucuuaacuuacaagucuacaguccuuugacccugccacuucuuuucuguguccaucacauccuuaauggccauacauuccuccuuacccagcuuaaauuccaugguccugucaccacucucuugugaacaccccuuacuuccuggcuccuuucuuaggucccacuuucuuggaaaaacugcuuucuagguaaacccagcucuucucucuaugccugcucucaagcagcugaaaauugcuagaaaguaccguucagugagaacaaguagauucacuucaaauuugugaccauuaauuucaaagggauauuuaauaugccagucauuacuaguaaauucacuuucccucucucugaaaaaaagaauuucucaccuucucuugucaaaacuccaacauccucucuccccacccccucagcugaugaacucaccaaauacuacacugagaaaauagaugucaucaugcaagagcuacaucauguuuccacuaccaccggcccagcugcaucuacacccacaaacucugccuucccucuuguugcacugaaagaaaagucucuuccauuggguucuaaaucccagcuuugcuacuugcuggauauguaucauugggcaaguuaauuaacuuuucuguaccucagcuuccucaucuguaaaagaagauauuaguaauaccuuccucuaagaguugaugugagaaugaaaugaguaaaaaagcuuuaaauaguaccugacuauuuugggguuagcugcuguuuuacugcaauaaucaucauugccauuguccuuaagacaucauugccaacuucuaagguaauuucuuccuuuuggacccugacuccuagcacuucucacagugcucaaagacuuuacucugcauuuauaccauucgucuuuuauacaguuucuucuucucuacugggucauucccaucagcauacaaaugucuuuuuuuuuuuuuccucgagggagggacucauucuguugcccaggcugggguacaauggcgugacccauggcucacuccagccuccaccuccugggcucaagcaguucucccacuucagccucccgagcagcuccugaacacaggcacauuccacucccagcuaauuuuuaaauuguuuguagagacagagucucccuauguugcccaggcuggucuugaacuccuaggcucaagugauccuccugccucagccucccaaagugcuaggauuacagacaugagccacugcacccagcccaaaaugucuuaauauuacuguuaccucugguguagggagacuucuuugacuucacauccuauuucucuguuacccuuuagagcagaacucucaaaagacuuacacucacugcuucuacuuccuuaccucugauucugucuucuuuucacccuuaccaagcuuuugccauuucacuucaugaaaugcucuugcccuuccacuccacugaaaugcucuugcaaaacggaagucaaugacaaauaucucgccaagucaaaggucaugucuccauggucaucuuacuugaccucucaacaguauuugacacagcuaacuauucccucuuuuuuuuaguccacccaauucuuauuuuuaaaaauuucaaaucuauagaaaaguugacagaugagugcaguaaauaucuagagacccuuaaauagauaccaccaauuguuaacauuuuucuauauuuguuuuauaucuaucuauguacacucaccagauuuuaaaaccuauuugagagugaauugcagauaacauggugcuuuaccccuaaauauuugaaaauacaucugcuauagaaaggacuuucucuugcauaaccacaauaaaaugaugauacuaaaaaaaauuuaacauugauacaguagaguucaauguauagcauauauucaaaucucuccauuuucccccaaaauauucuuuauaacuuuuugaauauauguuccaaagauuauacauuacacccacucaucauaccucuuugguuuccuuuaaucuagaaaagcuccuauccuuuuuacugucuuugaugacauuuacguuuuuaaaaauuagacuuauuuagguauaauguacauacaauaaaauucaccaauuuuuuguauacaauguaaugaauuuugacaaaaguaaaccauugugaagccaccauuucaaucaagauauaaauguugucacuacuucaaaaaauucccucaugcuccuuuccagucguuccccuccuguacauuuuugacaucccuucuuucuugaaauauguuauuuucuaggcuuucaugauaccaugacuugucuagguuuccuccuguaucuccucagucagcuuauccagcuucuccucuucugucaggauggaaucuuguuuguuauguucgccacuuaccaccauauccccagccccuggaacaguaccugguguaggaaaccuugaaagaugaggcacuuucauuuacauuaacucaugucaugcugagcugccaguuaagugcaggcuaacuguucuuuauucaaaugcugggaucauguggugugaauccauuggucaaaaaggaaagauaagaaggacaaaaugcaugggaccagaauuauuucagauuuuggauuguuucagauuguggaauauuugcauauacauaaggagauauccuggggaugggacccaagucuagacaugaaauuuaucauuuauguuucagauacaccuuauauacacagucugaagauaauuuuauacacaauuuuuuuuuuuuuuugaaggcagagucucgcucugucgccuggguuggaaugcaguggugcgaucucagcucacugcaagcuccaccucccggguucacaccauucuccugccucagccucccgaguagcugggacuacaggcgccugccaccacgcccggcuaauuuuuuguauuuucaguagaguuaggguuucaccguguuagccaggaugguuucgauguccugaccucgugauccgcccaccucggccucccaaagugcugggauuacaggcgugagccaccgcgcccggccuuuauacacaauuuuucacaauuuugcucaugaaacaaaguuaauauacauugaaccaucagaaagggucagguguggauuuucugcuugcggcauuaugucaacacucaaaagguuuuagauuuuggagcaauuuggauuucagauuuuuggauuagggauacucaacuuuuauucucuuuauuuuuuauagauaaugccucaagaaaguaauucauaccauuugcacaaccacuauauagcagagccaagauuuacauacauuguauaaaauaucuucuaauuaauuauauuguuaauucaauauuaaagacagaugugcaaggauugaaaauauuugggacuccaaaauuuaagauagauuuuauaccauuuuauuccuacacuauaaggugggaaagauucauugggagcaguauaacauaauacagucauuugaauuugauagguauauguuuguugaauaaaagaauaaguaagguaaauguuauuuggugauaacuuugugaccacuugaaaauauuuuacuaguuuaauaauauuuuauauaauuaauaauaguuagcaagcacagauuagucuaaucuuuucaaguguaaaguaauuaaaacauauacuaggcuaccuuucuaccacauugagauuuggacuucagagugaauugaaauuauuagccuccuuuucagcaauuguucuauaaauaaaaccaugcaaaaaguuguccuauaggaaacuauaauucuauaggauucuucaagacccagagauaaauuucuuuggcuuauuagacuuauggauuugacaaauuauauuauaauuacauaauguauaaucugaagaguuuaaguuauguaggcacaaaaaguuugaguaccuauuuauugaaagagcagagacauugugaggcuaucccuaauaucagaguuguucauucugagcauauaaggguuugagaaaguugaauaaaauacauuuucugucauuucugaguuuaaaaguuacauacaacuuggaaacaaaaaugaguuguggaggugaucccucucucugacucaaguggagcuuguaaaauuuuggagaggguggcaaaggauagaaagugaagacagaaauucagauuuuauugagcaacugguuuauguaauaugcuggauggggauauuuguaagaugaauuugauuuuccaauuuaagcacaguaaauuacauuuccaggucaaugucuggucuuaaacuguaacguauuaugauuauacuuugugguuuuaagccauggaagaaaguuucagaaaucgcuaaagagaguaggauaugggugugaaauuaaugccauuuagaaaucacgucauaucaucuguguucuccaugccaguuuuauuuuuguaauuuauuguuuuuuacuuugcauucuguuuauuauuuaaauuccuuuguuucauaagagaguugaaaacagguuagugaagcugcaagaaaguaagucuuucuuugucugaggaaguugucacacaagauuauugaaauaaaaauagaaugcuagguaugcuuugaaaaggcuuuuuuaaaaaaggauugcaugguugguggaacaguggaugauggacuaaaagcuacugauuucuuuuuuuuaaaggauuuuggaaguucuacuaguaguuacuguaagcuaacauuuccugcuuucaaauuauuucuacuuauguugugguaaaacuguucauuuccuuucuuucacucuugguaaauaauugaacaagauagagcauagaaaaggggguuuuuaauuugauuuuuuagugauauguuuguuuuuuaaugguagauagcuaaacuuuguagauaucuuucauaggggaaugaauucuaugaacaagccaucagcagauauguuucauaauuuggccaacauguucauugauuuguuuuuacuguuucccuucccuucugugugccagguaccuguuugugugguacauguguaauaaaaauaaacaacuguuuauaacuguuacuugaauuaagggcccacguagaugaacaaaugacuaccaggcuaaacuguaauuauauuuaaucucaagguaauuuccauccauauaaagaaaaucuagaagagcuuaauagcaaugguugcaaauacuagugccagcacaugcaacacauuuuuaguuggagaggucguaacagaaggguaggaagcaaaccaaccaaauaaauguguugguuuuaaaaauaaaagaauauucauauaacugcuuuugaugaucacaguuuuuuggacuaucccaaggcaaauauauuuggaaaccguccuauucauucugcucaagcagccugguuuccuaagcaggucgagaguuuuuccuuuuauucuucucaauauauuucuccuuaaaggucugcagguugucuauuuuuuuuaaaaaaguauuaucuaccuugcauuuucauuguaauucauuucauuucaguuucauauaauugcauccagacaguugaauggagucuucacuuaaaacuauguuuuaauuuuuaaaaaauacauaaucauaguucucuuucucucucucucucucuuuuuuuuuuuuuuuuuugagacagagucucgcucugucgcccaggcuggagugcaguggcgcgaucuuggcucgcugcaaccuccaccuccuggguucacgccauucuccugccucagccucccaaguagcugggacuacaggugcccgccaccaugcccggcuaauuuuuuauauuuuuaguagagacgggguuucaugauguuagccaggguggucucgaucuccugaccucaugaucugcccgccucggccucccaaagugcugggauuacaggugugagccacugugccuggccaucaguuguuuuuuguuuguuuuauuauauugagaaguccacagcaaagaaucacagugaaugagccaguugcuguguugagucaacggcuuaagaguggcuaaggccgagauugcagaaauucuuuuggccuuucccagaugaucacaaagugacuguugcaguucaagccaucauauuuguauuacaggcagaaaaaaggaggugucuaucaagaaagcagacauuuuccagaaauuucuagaaagcucugcuuaugucuuauugaacauaaacugugucaacuauuuaggccuggcuucaaaggaggcucagaaagauaauauuuuaacuaggcacauuaugauuugaaaaaaaauuuggagucuuuuuaguaaggauccacccucggccucccaaggugcugggauuacagguaugagccaccgugccuggccauccguuguuuuuuguuuguuuguuuuauuauauugagaaguccacagcaaagaaucacagugaugaaccaguugcuguguugagucaacaacuuaagagcagcuaaggccaagcagcagcugcuugcugcagcacuccaucauaugcuaaauuggaauugagcaaagugucugggaagagacaguaaagagaggauucauguugaaaagagaaauaaauauuuauuuauugcaugggaugcagccagaugauuuaggucauuaaugaguugaggaaguaacuuuaaacuaucaaacauaagaauaauacaaugaagacucuauuaagagauuauuaaucuggcuaagaauuguauauagaaaaaaaugaagagcgaagaugagcuaggauagauacuaggauagauacuuuggaacaaucucaagaugaggugauucaaagcuuggaaugggaagaaaggaaaaauuuccaaagaaauuccaaaggaaaaaucuauagcauuuggcagcugaugauuuauaaaggagagagaaggaaaagcugauuccaugauuuugagaccagaccacugagagacuaguacugccauucaaagaaauggauaaaaugggagggacagugugagauuuaugcaucuugaauuagagaugucauugguggguauuuuuguguaucucuuguaacagauugguguguauuucugugugucucuuguaacggaauaccaaguaauuauugacugaugaauuucauuuucuuuccuuuuuguuagauacuaccagcccccucacaaguuagugucccuuuccaucuguuguauugucuuagacuucuccucauucaccaccuugaugcuuuuacaagauaacaaagcuuauggagauaggcauggggcagcaagaaauauagagugggaaucugcagagaaaagaaagaugagcccucuuucuuugcuuguuuucccuguuuguuuguuuguuuguuuuuucucugcuuugccuugggcaugauugggauuacugagauuauuccucuugucuauauuguugcauuaguauuuuaacuggugucccuaauuuauuauuuuuccaucuuaauuccuacaauucacccugcauacugcugccaagaugagucauccuuacauacugcuuuuguuauaucauuauccuucuugagaaccagcgguggauuuucagugucuaucagaugaaauccaaaugcuuuagccuggcaucuaaggcccaggacagucuguccccacauuaccuuuucaacucaguucuaaccaaacuguucuacuaacaguuccuugaaucuguauucauuaguucauuuaaaaauacucauucacugauucuccuuuaugccuaaugcuggagauaccaacauagaauaagguacccaugauuuguacuuuacuguagccucuaagugcaagagacagaagaaaacaaaaaaaaauuaacaacccaaacaaaacaauugcagcuuaugacaguuugggagaaagaaagaaauauggucccuucaugaaauauggugggagucagggguagagaagaccuuuuugauuggguaaugaggggauaacaguuaaaccaagaucugaaggaugagaagaaucaacugugaagagucaaggggcagaagauuccaagaagagggagcaacaagagagcagaggcccugaggcuggaaagaauguguucguuuuaggauuugucagaagaccaguaaggcuagaguaggacccaguagggagaggaaggaaugauacgagaucagaucgggaagguaaacaggggccacaucagacagggaauuguaggccacggugaagaguugugauuuaucaauauagugggaaggugcugaggaguuugaggugggaagugacuugaucugauguacauguaaagagaucacucuauuuuugcacaugugguguccaugucuuggauuaccuguccucuucccuccaggcuaucuccuacccauccuucaaaauccagcugaaauccuaccaccucugcaaaacuuuugcuuuacuucuguggaccacuagaauacuucuguagguccuagaauaaauagucuuuccuccacugaaccuccuuaauguaaccaccucucauuuauggcuuuaucuaacacuacucaaagauaauuaccuugaagguggugguguuuuuuuuuuauuuaacugugucucuuccuccucuucaucccaugccuaaagaaaugcucugauacuuaauuuuuaauauauacuuagaguugggaaauuuuugccuuuuuaugauucacaaaaaauagcuguucuauagcuguaucuuaccucccucauuuccucugguuggccuuacuucccucuuauuucuugaagucauuaguguauccauuuuuaacucuucccaaaccauuagauuuucucccacuuagcagagccucuucugaacucucuacuauaagguaaaccuggaaauaaauagauuucuuaaguggaaaaaauaggguuaaugguagagcugccuuuauauacuuggaauguuauuacuuugcuaagaaugauuauuguguugaugauuuauuggcaguugcauggguaauuuuuccaugaauaguuuauauucauuguauuugauuuacuaauuaauuauuuaguuuauuagaaccuucacaagaccccagagguuuagauucaaucagcuugcauugauccuucuaggauauuaguuacuucuuugacccaaaggagccaguugcugagcccccuguaccuaagugaccuucagaguccuguuagcuuucagugagaucacauucacucuuucugccuuauggcaaaaaucuguuucuacucaaacagaugguuuagcuuucaacaaauaaaaacuagagaucagcaucuacuuaagccaacagaguugguuugagccucccacuaacucuccaaagucuguuauuuuuuauuuuuuaauguuaagcuccuccuaauggauuuaucuuuguacggggaaaucaagaaccuugcacuuugucagaagaugagccacuucauauaaucucaaguuucuauguuuuagaagaauugcuuaguaagcacagguucgacugcucugcguucucucuuuugcaguuacaccaacuggaaacauuggggaucauaacuuucuguggaguguuacauaggugugucagcaguuacaugauacuuucuuuguuauuuaagacaucugcaagcugaggauggccagugucauuucagagauguacaugccaaagacaugguaguuuucauugacauugggaaauacuccuucucuugagcuuuuacaaauaaaaguuagagagugcuaagaaauccacauauuuaaaaaaaucuagaaucuugacauugaaaauauaaaugcagauuguuaauuauauguuccuguguuaagaaagcauucuugcuuuggggaucuugaguacaucagacaaaaguugccuuugaacucaaccaaguauccauagagauauuugccucuauauguauuauuaauuuuacagaaacaaaugccuagcuuaaauauaauauuuagauuaaauagugagacaaauguaaccugcacaauaguuugcugcuaggaaaggaauuguuaggaaggccauauaagcaguuucuuugaagauaccuaggaccuaucucuuucuuuucacucuauuauguaggacagaaccuugugggaaaugugaucuacuuggcaucauuaugguauggauuaggacaaagaaagaugcauuaauauuccuguacucaugccauaaaauaucaugguuaaaaaggcuuuaguacaaaguuauccaugguaacucccuucgagggauuggauuccuuucugcaacauguugcucuguggccaaccaguuuagauauaaucaccgccauguauagagacugccugcuuuaaauagcucuggcaauuuguaaauuguuccuuuucugucucuuaaauccacaggauuauauauaaauauaauauuucuuccacaugacaaaccuucagcuguguguauacuauauacccucugagucuucacaucccaagaccuuccgguuuuuggaagcuauucuugugaccuggguucauggugccucgauucuggucauucucuucugaaugggcucugguuuuuccacaucuguuaaagagggcugaugaaugcugagcauaguggaggaucuccuaauucuauauaguguauuucuauuggugaaaccaagguguuuuuuucuaguuacaucauacauuguaccuucugucaaauauagucuuuagcuuuuucauauauguuacuaccaagcuuuuuaauuuuauuugcugauuuggauuuuuggccugaauuuagaacuguguuuuuauccugauuagauacaguuuaaguuccuuacucaauaaacauucagagaaggcuucccuaaguccauggaauagguuaggaucccuucccaacuuuauguacccagaauacuccaaacuuucuuauuuuuguaacauucaucuuacuuguaaucaguaguuaucaucaacuucccugcuaaauuggaggcuucuuaagguuaggaccuuauuuauucaauauucuuuguuauuccuacugccugacaagaguaagugcuuaauacauaguagcugcucaaaaauguuuguugaauugaauuaaauauaugaaguaucuauauaagccaggcacuguccauuguaucuaagaaaaaaauguaauuaauuaaaugaacacacagugaaauuugaacugaaucuucaauacuggccaagugaaugaggcauucugagcauagggaacaguauaaguagggauaucagagaaagaaaaguacuuaguccauuuggggaauuaaaguuggacuaaagugcacauggaucaagguacagaugaagcugcagaggcaagcagaagccaguucaucauggccuuguguaggacaugauacagaguuugacuuaagccucugaguaauggggaacuauuaaaauauuuugagcagggaagaggcacaaacagaguuacauuucaaaagauuuccccagcagcaacauaaaagauagaugagaggggauuaugcuuuuauagggacaacaguuagaaaguuaucaucuaggcaauagaugauggguaguucauauuuaaaaaaggauucuuucuguauacuaucuauuguguguaacaaauuacuccaaaaccuagcagcugaaagaaaacaaacauuaucucagacaguuucugagggucaggaaucuagggccagcuuagcagggugauucugcuuccggaucucucuugagauugaagucaagcuguugacuggggcugaagacuugauugggucucagggaugugccuccacauucacucacgcagcagguggccucuuucuggggcugcucacaacauggcuuccccaaagcaacuguuccguaagagugagaaagcaagugaguaagagcacucccaagauggaagccacugucuuuuaaacuuaaucuuggaagucucauaccaucacuucugcugcgugcuguugguuacuuagaccaacccucguacauugugggaggggacuguacaaggguaugaauaccagaaaguggggaucauuugggggcauccuagaggcugccuuccaugcugcuugucaaagaauguaaagaguaagucuacaaguccauaauauuuugauggcuuauggagauaagagggcagaacacuccaccuagaaacuauccuauuaccuagagcagguaaauaaagucauuugcuugacugaaagguaagaggguuaaaacccaccauucuaaaugucaaguaauaguuacguugcagucauugcuuaguuuuauacuauaaauuaugaugauuugguuccauguuuuuuuuuaguauaaugugauugcuguucagcuuuauauucagcgcauagcacuaugccaaguaauguacagguuucaaaagaagacuaaaaugugauucaugccuucagagaguuaauuuacuggaaaacaaggcauacauagaucauagaaaaucuuagaccccagagaaaacuuaggggaguuuaacacaacagccucaugaaacagcuaagaaaacggguugagggaggugaauggcugauccagcccagcuacugacagagcugagaccagaucucagaccuuuaggucuguaggcaagcauuuuauuuaaauauaaaauguaauuuguuuacgauaccaagaacauucuuuuuuaaauauaauguaaaaaacauuuauagagacagggucucacgguguugcccaggcuggucucaaacuccugggcucaagcaauccuccugccucagccucuuaaagugcugggauuacaagcgugagccaccacaccaggccaagaacauugucugaggacuuaaaucauuuuucuauuugaaaucagaaugacuuaguauuugauguggggaaaggcaagacauaaauguguuagaagacauuucugucuucucuugaaagaccaacucauccugucacugauuacugugugacuuugagcuaaauuacaacacauuaguaaauacagaagaaaauaaugagcaaugccacaucccuugcauuuuuuaaagcaaggaccacccuaauugacagugagaucuuuauauuaauuuucccauuuaaaauagauaauauucaguguucgaugaagaaagaauuaugggguagauuaugaaauaauaauuggaauacuauuacuguuaauaguaaaaaaugucugaacuauacuguuggaauaauaagaguagaaaugaguaaaauuaaguauuuacaagguuuaaaguauuuuggaguuuuguuuccuuuuuuaaaaacaaaaugcuuuuuaacuguucauugccuauauuaccaaauaguuuuaaguuguacauucagguucagcuccccuuuuuugaguacccaccauuuauguuaaguauauuacuggguucuuuaacagauauaauugcauuugguccucauaaagccuaugugagauaaacauuuuccccauuuuacagcugagauaacugagaaauuaagagaaccacaacugaacuuucugcaugguccuuugaggucauuuuucugaaaagcaagugcuaacuuuuaauagugucuuuagccuuucccucaggcaacagcguaugacuaagucaagacagcagaacuaaauacgaguuuauguuaccauaauuucagaguaacagcuacuguuuuauguucuggucaucuauuacauaaauauuuaauacugagcacauaauuuggcaugauggcagcaaaaagaugucuauccuggaguuuccaugauaaaccagaaaggcuuuuuuuccccaccaguauguuaaaauauggagaaauaaauuaggagaugguaagcuauagcuuucuuaucaucuuaaguuuaccuaauuaaagcacuuuaaaauaaauucauuccauccaaauuuagcagccaucuauugcaaaguuugcuuccuuuuuccaugacauuuaaauauacaaaagccuuuuuuuuaaaaaaaaaagcauuuuuuaguagguaaaugucagucacuuucuuaaacuagccuguccuagaccaacagaccaguucuacuuucaaaacaaaacauagcauuuaauaguaaaaauaaacugucuucucacuaaugaauuuacugucugcauuuccauagauguggccauguguuuucccaggaaaacuggcuugaacucaaacuaagauagcuacuaagauccauuuagacaaagugggcuauaaacaugagaaaucuuccgcccccuauucuguguuugguuaauuuugcugcucucauacauucuagcaauguaccauucuguucucccuuuuacuccagggagccucauuuggcauauaguuagucauacgcauacaccuuugaaaacagucaauguaacucccaguuauuaagaaccugaugggugcuaggcauugccuuaugaacugagagguacaaauaugaaaacuauauaaaagcuccugccccagauaaacuaugauacagaagaacauuuguuagcuacuuuuuaggugcuguguaucaaucaguuuucuuaguuucaggugacagaaacuaacucuggguaacuuaaguagaauuucuaggagggccaaagaaucugacuuggagguacgguaaacaaaaacaaaguccuaaauuacaccacagagcuggacauagaccauagcuuacaucagugauagugcugauccugaacuguacuuccagaaccaaagccauggcuggcccuugcaacuagauaccacuccuucuaggccuucuagggccacccuucuuuccagaagagucuccuuugcagucuggagcuggugcaucuguguggcagagccuaggccauaugccuguacccuaguuacaaggaagucugggaaauaaauuaucugguacuuuauacacuuaacuaguaggaggucagcucuaucucacaagauaggagguucuguaaaccuagguaugcagucaggcacuaaguggccaaaaacuucuaucagcagcauuuugaauaaucagagaagauucaacacaggagaugagaaccaggaaacaacaaccaaaaaagaaauauggugaguuuggccuuaauaucacaaaaagaugaaaaaacaauguguuccuaaaccaguuuacaaacccacaguuagugaaaggcuaggugauagcuuauauucuccaaaguuauaaaguccuaaagaauguagccucuacuugagacccauuuggucugugcagguacaggcacuaucaucucucucuguaaagggucaguaugauguuuaggaaagcagcccacauuuggagucaaagccuuuuguucuuacccugcgcagcccuuaaccagaugugugaccuguaagcaaggaguucaguuaguauccucaucuauaaaaugagaagguugagguaggugaucuuuaaaguucccccuuggcucuaaaguucuauacuuuguacaugauaggccagugacaacuaauguuuuuacucaagccgauuguauguuuuagaaggcaaauaaauuaugagcuuauuuuuugaugacaguacauuuucauaaacccaaaauaauuaaaucuccaccucccacuuaguuuaguuguuuuggguuuuuuaaaacaauuuuauuuucccacacaguacaguuuaagcauucaaguugcagcaggggaaauacucauugaauuugucaucauuauuuuuggcuucuaucuuuaugagagccauuuuaguuuucuaguuucagugaucuauuuuuuagauuuuaagcuacaauauauuuuaacauuugaguauuaaauugcauuugucauaaugaauuagaaccuuacguuucuuucaaaaauagcuuuaucucaauaugaaaugcaagauuauucacauuuauuauaaagaggagaauuuuugagacauucuauauccacuggucaguuacuguuuugauuuggugauggaaaaucauagcaaauuguacauuuaaaguaaaccaaauaaauaacuuuaugcagagauagagauugaaguagccauuuggagaugagaauuuuaucuccaugccuucaagaaagaccauauguaaaccaggucagaaaaauaaaaauuacaccauauuuauuuuaauaggaccaucuuagaauacaagacauaacacaagagaauuuauuucuggaaugacgugaaggaauuuauuauacaaacugcuccaucuaaaacauguuccuaaaauguagguucguagaauuuuuuuuuuuuuuccccuggggacauaguuucacucugucacccaggcuggagugcagugguguggucuuggcucacugcaaccuucgccucccagguucagucucuccugaguagcugggauuacaggugcacaccaccaugccuggcuaauuuuuguauuaguagagacgggaguuucaccguguuggccaggcuggucucaaacuccugaccucaagugauccacucgccucagccucccaaaguguugggauuacaggcgugagccaccgcaccuggcugguuccaagaaauucuaauauuuguucuguuuuuaaggagaaaaauuauugaacaacuuaccucuaaacuauaguccuuuaaugauaaacacuacuguuaaaaaauucuuauaauuaacauaaucugauauuguuacuuaagucuuugaagaaauagagaaaaacuggcuaacaucccuuaugacugcauguuuuuauauauuaaauagcaguaucgaauugccuuccacuaucuuuuucagacgaaauaauauauauuuaaaccuugcaagccuuauccuuuuuuauacuucuuuuuucuagaacagcuuuauugaguuauaauucacauaccauacauuucacccauuuaaaaucuauaacucagugguuuuuaguacaauuuuagaacauaucaccccaaaagaacccauccccauuagcagugacuccucauucaccccuuuccccacuccaguaaugcugagcaucuuuuuauguguuacuggccauuuguauaucuucuuuggagaacugucuauucaaaacauuugcccauuuuuuauuggauaauuuaucuuuuuauugaauuauaaaaauuauaucuucuagguacaagucacuuaugagauauaugacuugcaaauauuuuuacucauucugugaguuugucuuuucacuuucuugagcaagccuuaucuugagcaagccuuauucuuaacucugguuaaauuuugguuuucugaacauuuugcuaaauuuucuaaaggucuccaguuguggaguagccugaaaugaauacuuuauuuuuugaaaguggaacuaaacucuaauuuaagucuauaauagaaaagaguaauugcuauaggaaccaacauuuuuuuugguuguuuacccugugccaagcauugugcugagugcuuugcaacccuaaaauauaggguuguuauuccuguuacauagaugaagaaacaaaggcuugaagaaguuaaguaaguugcacaaaaucaaaaagugcuaauaaauggucaauuggaaugacaaugcaaguuauuuuuuuugaccaacuuucacauuuuaugugggguguuuguauuccacuauuguacuuuuuaagacaauauuauuuuacagccucauuuuccauccacuacaaucccuagauuuuuucaggcauauuggaaccgaaucauucacuucugucucuuuaaaacuggaauuucuugguuucugaaccaagaaauuugauuugauuucuauagccuuuugauuuuuugacugucccuuccaaauuggcccuuuuuaaacaaauuauaacaauuuucaaagcuaaaaaaauucuaaagguaaacuugccauuaaaaugauuaaauguaaauugcagaccauuuuaaaugucuuuuugauuagcuacuauuaagaauuuagcugaucuacuucauuaaaauguuauauuagcucaaugaauaauuauauauuucuguguaacaaauuacccccaaaacuuuaauggcuuaaagcagcauuuguuauuucacaguuucuuugguuuaggaauccaaguagaguuuagcaaugugguucugcucuaggucucucaugagguuuaagucaggcugcuggcuggugcugcagucucauuuuuggggaggaucuaugugcaagcucacucguaugguuguugggaggauucaguuccuuuugagcuuuuggacugagaccugcaauuccucacuggcuguuggccagaguucucccucaguuccuugccauaugcgccucucuaugagacagcacaugacauggccucuggcucugucacaauagcaacacaagagaguguccaagauggaagccauaguaucuuuguaaccuaaucucagaguugauauaucaucacuuuucccauauucuacucauuagaagcaaacuauuauguucagcccacucucuauagaagggaaauaccaaggguaugaacaccaaaauauggagcuuacugagggccaucuuagaggcugccugucacacucagugaaucuauuguuuaaucauggagaauccaaaagucaugguguuuuuauauagaacauugauauguacaguuccauccugcaaacaagugauaauuuuaucugaaaauauauaaggaagucucuccauccuaaaauaugcauauguguauauguauuauuuuuaaagcaucuuuagucugcauauacauuugcuacuuauuaaucuguuuuaucaagagacaacauuaaaguuguaagacacaauuagaauagaaaauuuuauguguaacuuuauguucuccccuugacuuauaaagauugcuauugaauuuuaguauuggaaaacuuuggccaauguaaagaugauuuuaauuugaacauguacaacaugcaaaagaauauuuuuucuccuuaaaucauacuuuagaagucaacccuaauuuaacaaaauaggugauccugaauggacuuuaauucauuuauucagcaaggcuuauugaauuacucuucuaacucaucaugaguuacacucauaauaaaagucugcacuccuaauuuuggccucccauagcucagucaaucucugucuauguuuccaguuucauuuccuauugccaucucccuuaaccuuccacuccagcacaguuuuucuugcuccuccccauguugaugcucaugcaugccucagggcuuuuccaucuuccugaaaaccucuuacccagaucguuacauggcucgcuucacuucauuuacuucucugcuccagcaucacuaccauaaagaagcaucccaccagcacucuucacaauacagcagggaccaucaaaaagcaagagacacaauaaaaaugauaguugaaaagauuaaucucaugacaguguacaagauaacuuguacguaaacaggcuggauuagacauggaugagugggggccacaauuaggaacuuucacauucauucaggugugaauugauaaugauccaguuaugaccaccuugggcaugaguaaagcuacacaaacauucucccaaaaccaggucuucccucggauuugugaugccgguaaauuguugccaccuuccuccauccuccucuaacagagccauuucagaaccaaaacuuuuuaaagaaaaguuugaaaaaaauaagaagcaccaaagaauuagcaggaaaugguuagguuuuaggacuagaaaccacaaugcaguaggggcucugcaagaggaaggagugagugcuucaaagugacauagcagcugugugcuguugugccugagacuccuuccaauccuagauguuuccuaguggugcuggcaaagcuucuguuggcuguaccacauucuuucccaauccaacucccucuauguaaagucucauaauucuaaggauccuggguucaaauguaaguuucuuccguaguaguuaccauuuggguguuucugcuucuucuaaacucccuucuaauuguuuuuccucuuguuuuuaagcuagugauuuuuuccccuguauuuuacauaugcuuauggaaagaacagauauguuuucauggcacuuagcauguuauaaaugcauuguuuuccauggaguaagaucauucuaccacugagagcauuaaauccauguuccuaagguaacccauguuuuccuagaaacaggggaagagucaugaccaacuuucacauugucugcuuuguucuugggguaucauccauugugauaaccauucccaagaaguuuccuccccaaaacagaauuacuucucugccuacccuugauucaagugaccuuucauuacagauaaucugguuuuauagggaaaucuaguagguucugcacucaguuguaaagaaagacagaugcaaauggguuucaguaauugguacaacauugucacaaagcucuuuagauuagcaaguacuuauaaacuagguggaauauuuuuuauuccauguuguuaauaagaaugcccuaauccucuuuacacacuugaaaauauccagggaaugcagagagagacagacagagagauagacucguauguaaucauggacuuuugagauagguagguauagauguuccuguaaacuaagcguuuguagccucccaaaauuuauauguugaaaucccuaccauacugugauauggagccuuugguaugaggucagaggcuucaugcaugggauuagugcucucauaaaauaggcccuggagagcuuccucaccccuucugccauuugaagacacagugagaagaugaauaucugugaaccaggaagcaaacccucaccagacauuaaaucugccagugcuuugaucuaguucuucucagccuccagacugugaggaauaaauuucugguuuuuauaagccauccugucuauacaguuugucacagcagccugaacagacagagacaaguguaaucccaucuuuuccuuagcuguauuauuagguuagugcaaauguaauugcuguuuucgccauuuuaauggcaaaaaucacagcuacuuuugcaccaacauaauauuugcucacuuuucucuguuguaauuuucucauaugagacuguaggaaagaaugauuuaauauauucuauaaagugccuaguaauauaauagguccagcauaugaaagcauucauaauagguucucaguaaagaguggcaaugcucgagcauuucuaaagaaacggaauugauuauauuccauuccuuuuucagacaguuauaaauguuagaaauuucuuucuguuacugcuccagaaucugugcuuuucaauuauugguucuaauucaguauuuuuaggccucagagaaaaagccuuaaugccgucuucacgugguaggcuaccaggucuuugaagauggccauuuuguaucccacaucuucuccacaucugcucauagaaauacaguuucuucauuugcucccuuaugguuuagguucgaagcaacucagaauggaacacaacgcuacugguguguuaauuagcaggugagaauggaacuaucaccuuuuuuguuguguucuuaacacaaccuuaguuggcaugaauuugaggagcaguuauauuucaccuuugacuugucaaacuuacacuugacuaaaaccuacagauguuuuucuuuuuaauuuuuuuuaauuuuuaauuuuuguggguacauaguagguguauauauuuaugggguaugugacauguuuugauacaggugugcaacaugaaauaauuacaucaugaagaaugcaguauccaucccuucaaggauuuauccauugaguugcaaacaauccaauuauuacacucuuuaaguuauuuuaaaauguuacagauguuuuucaaacaugucucuguucuacccuaucucucucaucauauauuuguaugggauuuuacauuuugacauauuaaauuucaucuuguuggaguuugcucguuuucuucuuaccuaugaagcuguuuugggacccuaacuaugacaguaagucacuuggcuaugcacuuaaucagcauguguuuaauauccacacucacauuuuuauaaauauuuaacaggaagggaaauuuauaccuccaaacccacucuaaucccugaacuccaaaugcauguaaccaacugccuguuaaauaucuucacuuagaugauuccugucaguucacacuuaaccaaacugauuuccacccucaaccuucuccuguagucuucucauccuagucacagugaagcauauccguccuucacauugcacagccaaaaaccuuccuugcagucauccuugacccauuuuguuuccucccacaucccauaucuaaucccucagcaaacucuacuucacaaugcauccugagucauaccuuucuuacuucuuaccuucuugcacuaccacuuuggaccaaaucaucagaaauagauuccuaacauuuucuguauuuacccuuacauucuuuagucuuuuuaaaauauugacgcuagaaugaaccuguuaagacuuaaauuaugucacuccuacuaaaaauacaaaaauuggccagguguggugaggcaugccuguagucagucccugcuacucgggaggcugaguugggagaaucacgugaacccaggcagcggagguugcaguaagcagagauugugccacugcacuccagccugggcgacagagugagacucccucucaguuaaaaaaaaaaaaaaaaaaaaaaaucaccuuaaugccuuuuaucucugguuacuucaacaccauaauuaccauaaauaauucaucucuguuggaauauuugugucccauuaaaauucguauguugaaaucucuucacuaauguaaugauaugaaaaucagccuuuaugggggugauuaggucaugaaggcagagcccucaugaauggaauuacugcucuuauaaaaagacaaaggacuuugcagggacguggaugaagcuggaaaccaucauucucagcaaacuaacccaggaacagaaaaccgaacacugcauguucucacucauaagugggaguugaacaaugagaacacacggacacagggaggggaacaucacacaucggggccuuucggggggugggggacaaggugagggauagcauuaggagaaauaccuaauguagaugacagguugaugggugcagcaaaccaccauggcacauguauaccuauguaacaaaccugcacguucugcacauguaucccagaacugaaaagauaauaaaaaaaaaaaucacgccacuccucuguucagaacuuaccaguagcuuuccaucucacucagagucaaagcuaaagcccugacaauugccugcacaacucuacaugguucugccuccccuucccacacauguacacaaacacauuugcuuuucugaccucauuuucuagccuucuacccuugcuuccuccucugcaugcacagaguccucuuugcuguccccugaacaugccaggcauacucccaccuuagggccuuugcaucuacuguucgccugucuggagugcacuuucuucaucccaugcacuaugaaucuuccuucugcucucauuuuuguuuaagguauuauaugagacugugcuacuaauagaaauuauagggcucuuuuggcuagugucaaguauagauuugcguuuuggacucacauaacugaauauguuagaauuacaucuaaagaaauaauugccuauaaauggaguauugugugugaagaguuagaguccugccccaucuccuuuccuauuaaaugauagugauuuucacaguaucugagauagcccuuugaauaucagagaaacauaagaguguaaagauuucaaggaaauggucauauuuuucagaugagaaaaguucaccaaagauuuuacccauuggugccagaaauguaaggcaggcaagaaguuaguagaagaaagucaucacacuguaacaauuauuuuuuuuaaguuguaggcacugauuuccaaaugaguuccauaaaccacugcuauuuccauuuguaguauagcaauagguugugauacuaaccuuaaaggucucaaguucaacagcuuauuaugaggaaagcugccauuccuuuaagaaggugaguuucuauuaucuuuuuaaagagagaauuacuccuuuauaaaaauguaacuucuucauacuguauuucagaucucuugcuuuuuaguaaaacuuuucauugcaguggguuugauaauaauagugcucacuuuuaaaaaauucccuaaauuuuaguuuccccuccagucaccagcucacuuuucugugauccucuuuagcagaacuccuuaaaagacucaucuauacuugcuguuuccuccuucucuccugcuguucucucuauaacccacuccaaauaggcuuucaucucgucgcuccacugaaacuacuuaucaaaguuuccaucaccgucaugcuaccauauuaucuucuccauccucaucuuauucccagcaacauuugacaucaccuuggaacacuuuauuuacgugauuucacugagaccuccugucugguuuuguuuuucaucuuauuucauuagaugcuaguucucagucucauuugacucuuucucuucucccaaacccuauacauugaaauaucccaaggccuagacccucuagucuuuggccuaggugaucuuuuuuuauauauguauuuuaaguucuaggguacaugugcacaacgugcagguuuguuacauauguauacaugugccauguugguuugcugcacccauuaacucgucauuuauauuaggugaucuuauucaaucacaugguauauaaauuacaauauaggcuacuaugacagaggccccagaaugaaggugccuaaacaagaugaaaguugauuucuuuuuccuauaaaagugugggagcuuguccaagacugauaggauagcuuguuaguacuggagacccacgcucuuucuuuccugcacucugcuguucucaacaugcugucuccaucuucuggucccagauggcugcuucagccccugcauccugucaguauucuaaccagcaggaagaagaagauaggaagugagaacguaucccuucccuuuaggacucagaaguuaaacauguuucaucugcucucauuucauuggccagaacugagucacaugaugauaacuugcugaagagaauuuaggaaauauagucuuuagguagguagcuauggcuuccagcuaaaauggagcaguucuuuuacuagaggaaaaagagcgugauggauuuuggaggacagggagcaguuucugcugcacauggcuuuaaauacuaucuaugagcuaaugucucccagauuuguagcuauuuccugaguucaggacucuuuccucagcugccucccuaacauucucgaacaccugccuguucaaaauugaacucuucacuuuucuccccaaacuccuacccaucuuaggucucccaggugcucaugccagaaacuuagaacagucuugauuccuugccuucucuuucauccacuuuugauccaucugccaauccuauuaacuuuaccuucaaaauggacuccaaauccaaccacuucucaucagaucuaucuuccacauuaccaccaaugacuuauuuuaauaaaauacauauccccauccuguuucuuacuuccuuaaaaccuuccucugucuccuuauugccuuugggauaaauucuaaacccugugugaaccaacucuuucuaucucucuggccucauuuucccauuuuccacuuauauuuuguauuucaguacuaccuagcacaacacaccucaugacuugauguauuuacuaaugcuuaucccucuguagaauuucccccaccucagaccuggcugaagaaucccuuagucucaagugucaccuccuucagaucuuuuuuuuuuuuuuuuugagacagagucuugcucuguugcccaggcugaagugcaguggcacaaucuuggcucacugcaaccuccgccucccggguucaagcgauucuucugccucagccuccugaguagcugggacuacaggcaugugccaccacacccagcuaauuuuuuuuguuuuuuuuuaguagagacaggguuucaccauguuggccaggauggccucgaucucuugaccuugugauccgcccaccucggccucccaaagugcugggauuacaggcgugagccaccgugccuggccagaaaauguucuuugucaucucuccaccuccccaggcuagguaggcaccuuccucuuuauucuuguuguaccauaugcauacccguaucacaccuauccuggaugauaccaguuuacauagcugccucuuuuccuagaugcaagugccuuggucaggggcaagggcuuacucaucucucagugcccaacacauaauagcugcuaaguaaauauuuauguaauugaaucauauugaucaugggaacaaacucccauugggagagcaucaccucugccuuacauaucugagaaaagcccuuguuuauuguacccuaucaacugaaucugcugggcuauauauuaaaguggguauuuuaggcccugcuuaaaaaauaaagguuaaauugagcauauucauugcucuguuaggauuacauaaugccugauagugcaaaaacaugguuguugacugaacuuuacaguugucugggguuugugaggcccagcuauagucuagguagcuuuguguguuugaagguauucugacuagaugagucaguaguuuaaaaguaacaagucacuguuggucugugggagaaguuguguggacuuagacuugccuucacugcuuuaaaaucuugcuuuuuaaaaaaucccaagaaagguagguucucuuuaaaaaguuuauggccuguauuugcugucauaaaccaacccaguuuucagccuuuagccgggcuccgcucccuuagagaugaaugguaacccauauaaacuacauggcgauucuaguuguuuuuagucaggaaaagccccaagguuuuuauuaagaagcccagaaagaagagaugucaaggauuccggugagaaguacuauguuauaagaagcagauuaggauaacuugucuuaaaaaugaaaaagggaugagaaacuugacaaguuuuuagugcuuucuuagcacuaaaugaugacuuaaagaaaguuuaguccuugccaaauuuuccccuuuggaacuguuuccacugugugauagagaucugccgcuacgagcuugucaucauucucauccacugucuucuuugucuucuucgaagucacguccuacuccucuuccucuuaucuucuuuuuuucggcgggguggggggguuuuguuuguuuguuuuuugcacuaagucauagaacugaaaagacucuggguaauguuuucaaaauaaagccacauuguuuccaauacaacagcuuucucuggguucuuucacugccuccuuaauguaagucuuaaucacacuuguauuaacaguagaaacacucugcaguaucucguuucauacagugguguuagaagcauuaacuccucagcccucauaccaucacaggaaaacagcaaucauuguuaacccccauccauuggggagaugaagaaaaugagcaaacuaugaagaaugcaguuuauuucgucuccauaagacugugaggcaguggaagguaagggcuagaccccaggauggcugauuccuagggcucuuuuccugugcuccagaaugcagugacaccuuucaguuguugcuguauucagagguguguguugcaugugauagguacaguacuugacauuauuaacucuugcaaccacccuauggguuagguauuaauauccccauguuauagaugaagucugugauuccaaagccugaugucucuccacugugccacacacacugacuccacacaauaacaauuacucccauuucauaucacuugacauccugaaaguccuccacaaacaucaucauauuuaauccuuaagaacuuuggaaauaucagugauuaucacacacuuugaaauaagcaagucacuaaucaaugugaucuuauuaaaauuuaagucaguucaugaugcuacuacuccgaccuuccaaucaugucacaucugucuagaaucaaggcccaaaucugugugaccugugauaugguuuggcuauguccucacccacagccucaucuuuuuuuguuuguuuguuuguuuguuuugagacagagccucacucugucacccaggcuggagugcaguggcgcaaucuugguucacugcaaccuccgccuccaggguucaagugauuauccugccucagccucccaaguagcugggauuacaggcaugcgccgugacacccggcuaauuuuuguauuuuuaguagagacgugguuucaccauguuggccaugcuggucaugauuuccugaccucgugauccgcccaccucggccucccaaaaugugggaauuacaggcaugagcuaccacacccagccccaaaaccucaucuugaauuauaauucccacaugucaagauugagaccagguggagguaauucgaucaugggggcuguuucccccaugcgguucucaugauagugagucucacgagaucugaugguuuuauaagcaucuggcauuuccccugcuuguacuaacucaguccugcccccuugugaaaagggugccugcuuccacuuugccuucugccaugauuguaaguuuccugaggccuccccagcaauguggaacugugagucaauuaaaccucuuuccuuuauaaauuacccagucucagguauuucuucauagcagugugagaacggacuaauacaaccuguaaggagagugguccgcugguuuccucuccagccucaucgccuccuacucuucccuugauucucucugcuucagucacacuggucaccuuacuauuccucagauacucagggcacgcuccugccucagggccucuauaccugcucuucccucuauauguaaugcccucuccccagacaccugcuugacuagcucccccaguucugccaggucucgaacaaaaaaucaccuuuucacacgcacacaaaaagccaucuugcuggucaggacuugccagaccacucuuugcaaaauuccagucuagccccuaacaugucauauccaccuuccaugcuuuaguuuuauccuuagucuuuaucauuuucaaacauacuguguauuuacuuacuucucucgcuuaccaucugcucacuagaaugugaaugcugugaggguagggcuuucaucuguuuuguuguucacuucuccacuccagcaccuguaacauacugggcacauagcaggcacucaauaaauauuugaugaaugaaaacagauuagaaaauagaaagucaaagaagcuaagugaguuuccccaaaaugauaugguauagcagcaucaaagcuaaaaccaagacuggucuucugauccacaugcaguuuggugcucaguuaggccagaauccgaaaaaguuguaaguuaaguucugaaauaaaacucagccaaauaaaguaguuugguguaauuugcacuuuuaaaauaauuuuucaucaguuacuauaucauagaggaugaagagcaguccuucccuuggacugucuccaagcagcaggaauaaugagaauaaguuacagaacuuaaaauaaacccagguguuucugggccugagauucuuaauguccacaaugaagggaccaugucaguucagagcucuucacagcucuaaucuugaauccaucucauggaugaaugaaaugccugguuuucuuuguaauuuguucaguucuaugcauacaagguaugcaguuuguucuguagauaaacuacacauggguauuucuguaacucuccuuuuaucaucauuaccgucuguuugauucuuuccccuacauuugugcaaaauguaggcuugucaucucacuguguuguauugcaggaucagcaagcaugucaaggaucucaugugucuucuaaucucaugcagccucugcugcaaggaagcucucaccacugccuccucagaguuauccaaugggcaaagaaaccagaaggcaggacgacuuaaggccagggaacuaaauaugcaauaauggugucugggggucaggaaagcaaguguuuguacaacauggccuggcauucuuugucacucugaauuaaaucugcacaugguaaucagaccuaaaagaagugcaccaauaagucaggccauugguuauccagcucuauacaaguuuuggcaaagaagguuaaaugcaguguuuggcauuguaucucauccugguucauuucuucauuaaaaauucccucuguagagaguaaaauacaguuauuuugaggugguguccauauccuuaggaacaggaggcaccguccuaagcuccuuuacacauaccagcucuuaaauacacaacuugaguaagguuuauaauucucauuucuauuauaugcugcacauggcuuaugauaaagugaaccugcaaaugauagcaagauagaacaagucugcaaaaguaagaauggcacguuaauuacagaaguuggauccuaucaguaauuuaaaccaaagcauuuauuugaaaacaaaaugaaacaaaacaccaaugcccucagucaccuucuuauuccauucccauuugcuccaguaggaauuaaucucuuuauuucuccuuacccuugagcacuuuuauauaucugcacuuggguuaaaggcaguucuauuaauuucuuuguuuggacagaaguuuccuuaauuuaccauaaucaucacuguugucacuaugccaguccaguauguuuggacuucacagauaagucuugcaguuuccaaaacaccaucccauccuuacugcguuuauucuugaaugacuuuucacugggagauaguauacuuaucuuuuucaacaaaacuacaaaugggauccuaauaacaaguuuacuguuuguuaauuuguguuagauauaggcauacugucauauuuuccuguaauuuuucauaucuggucuugugaacuguuacuaguauuuuucuuccauauguauuuuaccuaccaacuugauuguaaacugcuuaaagauagaagcuauguuauauaagcauuucacgcaugcuggcucaaugaaucacaaauaauugggaauuugguuagacaucucaucugaacagucccugcccugauaccacccugggacauucagcccuuggccaccugcuuugaugagcacauuucuaugucuccugcuuaaguacuuacguaagaugcuacugaguaccugacuucagaccuacagagucuguuuuuguuuuguuuuguuuucuuuuguuuugagacagggugucagucugucacccaggcuguagugcgguggcuagaucucagcuuucugcagccucaaccucccaagcucagguguuagccuccugaguagcugggacuacagacacaaaccaucaugcccagcuaauuuuuguauuuuucauagagacaggaguacuccauguugccccagcugcucucgaacuccugggcucaagcagucugccugcuuuggccucccgaagugcugggauugcaggcgucagccacuacaccuggccccugcagagucuuuaucaaacagaagugaauauuaggaggagccuggggaagaauucucuuugauuuaccuugguguuaacacuccagcgauacaacuauggauccuccagaaagacuauguuuuugcuguaucagugccaccuauuaggaauuguuccauaaaagagcaugagaaacucucuggaguucaaaaagucaaaaugacauccuugcuaaaaaaucucuuuaugguuugaguuccauaguuacaaccaggaaucucugggaauuuggucuccaagcucuucucagagcauguguugcauacauucugcaaagcccuugggggauggagcaggccuaguuuuugguuuucagcaguguuuguuaucuucacaguuaaauggaacacuggaaugugauauuuacucaauuuugcccauuuuucauucaguauuuauaauuuuuaauguggcaggucuucuaaaaaaccaacaaaaaauugcugauuuugugauuuuaguuucuaaaacaaaugaaagcaaaaaacuucucgccccugaacuccaucccuggcuguuacccuucauucucuguucuuacucuuuccuaagcaaguaagauaugacauuuauucaucagagcauuuuaugguuaauucacuguucaauuuucuaaaauaccauuuggcuucuuaccuacagagcuauagcaccagaauucacucgguauauguguaagaaugacugcuuccauuuuccgagagaaauagaaauagaacuaagagcagugauuuccuuguguuaaagaaaaauuauucaugacccuuguugaaaacaauagagaagacuuuauucaagggaggcuaugggaacgauacaaggauuacggcaguggagucuugcagugugggagagagauugggcuggagucugacucugacaaggacaaguagggauuuguagccaaggagcaaggugugggggucaguagauggaaaauuacuaaguggaaacaccaauguaagggagauucuugcuagauggacucaacagaauucuugcugaaggcaggccagggugauuagaugucgaggguaaucagauaacaaggguggaggauuuuuguuaaacuuuagccggauucuugcucaaacuggauucuguaaggacagagagggaagcccagggucaggcccauuugagcagggggcuuauggagaucugauuagaguuaguuuaaugagagucuuugucaccugcugaaaagaauucguuuuuauggcucagaauaauaguguaaucauagcaagagaugacuugucuauguccauuuuauaauaauucaaaaaucucaauaauuucugaaaaaaagaagcauuuguuaucagagucauaaauguugcuauuuauaugcuuaaguaguaguauaucagaauucacagaaaggaacaauuauuuagugugcaagauaguauauuccaaauuauuucauauuauagaaauaaaaaauauuccauaguccuuaagccacgccuuuuuuuuuuuuuuuuuuuuuuuuuuuuuuugagauggaguguugcucuucuugccgaggcuggagugcaauggcaugaucucagcucacuacaaccucugccucccaaguucaagugauucuccugucucagccucccgaguagcugggauuauaggugugcgccaccacaucuggcuaauuuuguauuuuuaguagagacagggcuucgccacauuggucaggcuggucucgaacuccugaccucaagugauccacccccccgucagccucccaaaguaccuuaagccauuccuuuugagacucugaagaaaggguacguuccuaauguuuuugguuuggauuaucaguucauggcagagcagugccuuaauuguacuugguagugaccacuacuaguuguucaaucaugaauccuccaguacuuuuuaucugaauaauauggagauccuuucuuaguacuuuguuagacagcuuuucuagaucgguuuccaauaguagcgaaagagaaaauccuuuaucccaucuuuuccagaauuaauauuuucugaucacuucauuugcaagaguaaaguaaauauugaaaauaccaaagugagcuucagucauuuauaagaauuguuuaaagaaggcagucaucaguuacuuuuuucacaugauuguauugcugagaguaguaucugcauuagucucuuaagcaagacuuuaaaaaaauccuacuguuguccccaccuuuauuuuugaaagauaaacuuaaaauuuacauuuuuaaaaauuuuuaaaaaguaaaauuuuaaaugacucaacaggugauuagauuccaucuaaggaugagauugaauucacgaucucagauucucaacauauauuuggccuuaccuauuguuaaugaaacuugccugcaaggagggcugcauguugcagaacuuaaacggagcaauaaaacuauuuauaaauccagacaccuuuaugaggauguuuccuugguuucacuuauguaagccgacaaaacgaucaguuguaaggaacugaaggaaguaaacacuugaauguacucaaaugucuaggcuuugcugaacauuauaugauuaaaaagcagccaaguucagcguggacugagaacugcugacaauggagaacaugagacccagaauggcaaauaauguuucagacauugacuucucagacuggucuccacccuguacuuaaccccauucucacccuuuuuuggaggggaaaggaauuaucuaguuaaaaacugaaucuauaggacaaccugucucuccugaggcagcugacuuaugcuaauucuugcuuagcucaguuucuugaguuuagcagaggagaucacugucacccacacccucuuuaaaucagccuccuguggggccaugucuacacaaccaaggccucauucauucguuuauuccaaaauauauuuauugagugccuucugugugccaaggacuggggauucaguggugaauaaacagauaaaaacaccuguccauagggaacugauauucuagugugauuacugcuaggagugugucugaguugaauugaggcucagaaguagaugugucugagaggccucaggaguuuggaaauggggguguccaaccuguuucuuuguccuccaacaggcuuuauuaccugugcagguaugguaguaagucuguuuugcauuucuuuaaggaauaccugaggcuggguaauauauaaagaaaagagguuuauuuagcucacgguucugcaggcuguacaagaagcauagugccagcaucugcuucuggugagggccucaggcugccucuacucacagcagaaggugaaggggagccugugugugcagaaaucacaugaugagagaagcagcaagagaaagagggaagaugccagacucuuuuuaacaaccagcucccaugggaacuaauaaaucaagaacucgcucaccccugagggagaacauuaaucucuucaugagagaucugccccaugacccaaauaccucccauuaagccccaccuccaacauuagagaucagauuccaacaugagauuuggaggggacaaauauccaaaucauagcaggaagagacacucccuccuaugaaaacacaaauuugaagaacaguugucuucaguguuauacaaacugcuuucugacugcauauaagagaauuccguuuaugggguuuuggucuaaaauuauagugucaugucagaucucaaucauuuuaacuuaaggcaguuauucuagccuuugaauacauuuuuccccugaauauucgugguguugugugacaacuauccaaaauauuuuaagauuccauuuuaucaguaaaacauaugccaggcuuuuuaauaggcagagaguaauuugguaguaucauuccucuuauccuuuaaaguuccuucaugcucuagaauuuaauucagugauuccuuguagaagcuagccugcccaacaccaugggcagagauauugcagagaaugccauuuugauacucugagaagaacauguaauucccaugccuugauuuuaaaugcaauuaaagagccauaguuuuucagaagaaagaguacucuuuggcaaacaguagucauugcagagguuugguccuuaaucuguuuucaggguaguuauuucaugguuacuggauguuauagggacgugcuucugaacauugguuuaguuuuuaugggucuugaauuucagauugugacauaaaacaguuuucuaguacauggugccaguguuuuaaucauuagaagccagaaaguaauaggccauuccucauguuggcugaugaccccaggcuaaaccuccaagcuguguuuaggacagugaaucagguuccagggcuaguucacucagccuucaaaaugauuuuuuaccccaacccagucuucucaugggccccuuuguacacacaccugaaguucacuuguuuucuguuuuugaggcacuaauuguaacuacauaaucagaugucaguuugguagucuagaaacucuauuugaagaaaauacguaauaauuuuguuagucauuuucuuuuuaaugguguuucaagaaguguuugagaucgaugaaaugauauucuuuucuaugaucuaaugaagaaaccucccacaguugugggcagcauuuuuggaaaagaguagccagguccagugaaaagcaaaucuaauaccauuagucuuugaacuuuaauggaauuagccagauuuccugaaauaguccuagaagacuaucaaaagcccuaggggagcuaaacuugauugaaaauauuauaggaacuugaccauauauagcuuagaccucuguggcauaggcugcuaaauuucccaagggagaaaugucauugggucaccuuucaaagagucauuguugaugguuaugaauucaacagauaagcuugagguugaagagaagugacuuugauuguguuuuagggacaaggucuuaacaaaguauugucuaaauuuguauuugaggauauuagaaauccagaaaccaccauuucuggaacuauucugcgauggcacuuucucaaguuggagccaagaaugguugaauuuucagaaagcaaaggauuucuugaugacuugaccagcaaguauuagaggacagccuucucauugcugaagguuguguucuauauuuucaucaucugcugggugccaggcacugugcuagcuuugggcauguaguggugaacaaaacagauguucucucugaauuuauggaguggauagucuaguaggggugacacacauuauuaaauaagcaaauaagccaaaguuuaauuacacuuuguaacagauacuaugaaggaaaagaacagauaugauuugggagugcuauuagaguuuuggucauaggagaagaccugaggaaaugcauuuguuugaugauuuaccaguauuuuaaauguaauuucugguuucacagaacuugaguaagcugcacaagggaaaaaaacucaucuucuguaauuccucccaguuucuuaagccacucaguaaaugcugacuacgguuuuguggauccauuuuguggugucuguuuuccuuuaggcaauccucccucugucuaauuuggauacagaaucuaaaucuuuaugagucuguaauaguaccuggccauuacuggucuauaaucagugcucauauaauuguugaaugaauuagugaagguuacaaauugagugugguuuaucaguuaaaagugcucucccaauuaucugauggaaccacaaaccuucucuuuucccauuaugccccuccuucuuaacacagguguucccagcauucucuccccaagaguaauacccuauggccccagggcuccaucuaucucuuuucuacauauaagucccaagccuacagguucuagcccuguuuucuccugcagaguaucaguccccaccccaguuucuuacugcuugccaguccucuccacuaaaauguccuccuggaaacucagacgugugugcaacucuucccccuuugccuccuuaagucuuuagaggucaccuucucagagaguccuccucugggcccugcacuuaaaacugcaagcuacucucccaucccaccucaccccacacucaaucccuaaucaacuuccaugcuuuuuccccccauagcacuuauucaucauucucuauaacuuauuuucuuuauuuucuguauccacccucucacucucuuuuuuuauaagaauuaagcuccaugaggacaggauuuuuuuuuccguuuuguuuacuacugugucccccugugccugucaugugguaggaauucacuaaauguuuguugaauaaaugaauauuuaauguucaggcauuauauauauauaauauaucauaaugcuucuauugcauuaggagacagugaacaagucagacgcuugcacugaucuguacugucacugugaauguaacaaauacagacugauccaaguguuccugguggugacucagauaucaggagugucuuugaccauagaugaugugauuuucugaaaugauagacaauucuugauugaauucagacaaaaacaaugcucccagcaaaguggaaugguggugagaaaggauucugaagccauacugcuuagguuugaaucucuccugccauuugccagcugaguggcuagucacgugaugucuccauguuucauuuccucaucuacaacauaggaauaauaauaauucuuccucauuuaggagcuuguuacaagaauuagaugagcaguguuuagcacacagaaacacuaaguguuucuuaaguaaauuauuauucaguagcuucguuccuggaaauuuaggguauauuaaacucauguaaaaguacuuuauauuuaaauuuaaaacagugagcuucuagacuaauuuaguaauaaucaaguuucuuuuuaaccuacgugaauuauaugagauauaagacaguugucauaugggacuguccugugugucacagaacggccagcaucccugaccccugcucacuaaauuuuaguaauacccuucaaucaucaugaccacuuagagugccuggaagguuggugguuuuuacauacacuguucuagcgaggccuauacauuuguuuugugacaucauuauagaucaucuaacuagacaagcucucccuaucugaauccucauugcccaguguccacaauacccuuaucacagugaacaaauucugcuaugucacagcugaaugugugcugucucuuuuuuucccucccugccuuuggacacuucccauccugaaucucuccugucagaggaacuguuuuuaauuuauuucagcaaaaggaauacguggugguggccagaagcucuuugccccaugcauguguucucccuuaagccuccagaaagauucuugaguuuggaagcacuuaccccaucugcaguuuuacuguuacucacucagcguucuucccacuuauaacugaggggcucuaguuuuaccacgcucccugaccagcuucaauuucaccccaccucaauuuuugccaggcacuucuuaagggagccaaacuucauuucuaaaaguauuuuaacauuauucaauuaaauggaacauuuauaaauugguuauaagggaaaagaucaauauuggaguucccauggaagguuuauaagaagaagugggccucaaagaauuaauagaauuggacuaaguagaaaauuagacugggcagaaaagagcaggaaaggaggggguuuguuuguuugccaagcagagggaaaaaauacuaacagaaaugcagugcaugguguguagggauggucaaaaccaggacucagauugaaaauuauaaguaagaauggcacaguagaguuaacuuagggaaguucuuggaaaccacaguaaaaacaugacauucuaccacuuccuuguucauuguguucccgccucccuuguuuuucuguuuguuuuuguugaagaggucucucgugguccaugagugaguggauauuuauuuaccuuccaugccuccacacuuguguaccccacaccccaggggauucaggcacauauacagcagcacuaccugucaccagccuaguuuacacagagaaagcuaccucuuuuuaggguuaguguuugauucugaauagaaaucucauuauuuaugcuucuuugcaaaguacuggugaagucuuaucacuuuuuaauauuaaacuucauguaaauguuuuggauauuuaauuguuuaugaucaaggugucuggcuaguguguuagucaucucccagcuaacagucucuuggcaggccaugcuuaauucaguuauugcauguuaacaggcuguucaaaauuccacauugccuagaguuuuuccaccuccaauguccagacacuuuuucuggcuucuccaacccucugggcauucagaaucauaguuuagugcucauauuugaagccauuuagcucuuuccuuuuuauuugccugauuaauuuugaauuugaauuaaucauacuuuauacccuuuuccugacucaguucaguguucaucucauucuguuuacucagaaagcccagaacauaagauuugaaccauuugugcagugcccaaaugugugcugauggaagagugaaccuuuaauguuuugacucccguacuauuugguucuauuuuuccuaaauaagucauggucuuuuuucauuaaguauacauuuacaaaaaugguucagucuuugcacauaacucagcucucacaauucccuaaucuaauguugaccauguucuauuuugucauaaaacccaugauuuuacugcuuucucuuuacuagagcccugcauauuagcagugaagaccugguccuuaaugaaagugugggguccauccucagugucucauaucccugccuguguuuuccuucaggagaccuuccuuuccuuccuaucuaagccagagucuucucuguuuccccaguuaaaacucgaucugauaguuuuuauucagacugacaggcaaguuguaggcaacgauugaagguggcuuucuucccagggguggccagaacucaaagucuuaaaguaaaggguagcaggagcuucaucugccaugauuaagaggaguucugggggcucucugcugcuccugggugcauacuauauaaacagaugcccagccacccaggggagggaccuacaaagaucaugaguuaccacgagcuguuuccaguuuguccuccuuuaauuaaaauaauuagagccucgucaguaaugacgagauugccucacuaacuguccaaggguguuaguacuaagccacccaaagaaccuuuuuauaaugucucauacaguagaccagagaauguugcugugacuccuuuaucauuuauagagauguggcuauguugggacuccuaauggcauguuaccccaaaugcugaacuauccagcuugucacucagaaggagcuuccugacuucagcuucaggcauucacaugcuaucugguagagucgucuucuagcaaugcugauaguuuccuugguccagaauuuguuaccuucagaagaagagugugaggaagagaucccguucuaaagccaccuagaccaaaccuagccugagucuccuucugguugggcuuaagaugacaaugccauuccaaccauggcuaggaacuccugagucuuggaaucagaucauagcuuuacauuucccucaaagcaucugagcuuacauucccagguuuuccaucucuucuugauauuuaaagcuuuaaaaaaccgcaguuaucaguuuaaaccauaacaggcacgugggcucuaaugacuucugcaggugguuugggcuguauuagagaaccuagucuugaucuuaaacugucaucuggauucugaguuaauccaggaaaccaguaagaauuaguaauguguauugcaugucucugauacauguguuuuccauuauuuggucuuccacagugcaugcgcauacacacacacacacgcacacacagcccuucaguuuuucuaaaauggggagagagggacuaugguuccaaaaggaaaugacugguguggugccuugaaaucugaacuuagucacguguuguaaaugaaaugacuccaggcacauuaacaagauuucuuucuuucaucuccuacuuuuuggaaaacccuuugaugagaaacauuggcuaacuuauagacuuucagauuuauuucuguaaagauaaguaauagccauugcaaagcagccguacuugugaaauuggaguuaagcuuccauaacagcggucuuaaagaauagguaggguuaguuaauacacagcagcaaccagcuguucuuccucccugcugagacugggaaagaaggaaauuaacuucaacuauaauggaagagauuuucaaaacugguaaugggaaauuuaucaucaaugaagacuauuuuaaacauuggaacaaaugagugaccaacagaaguggaggaauuauguauucuauuggauuuaaaauagaauauaucaucugcucaagacacuuagaauugauagauuagaucugucuaauaauuuuuaacucuugggggucacagaccccauucagaaucugauggccccucucuccaaaaacaugcacacacaaaacuuugcguaugauuucagggaacuuacagacucccugaagucuauaaauuagaccugaauuuaggacacccuggacuagaugaucuccaaaagucuguuuuagcucucuaagugacaagcuccacagcauaguugucccauacauaacaauggaaucugaagaccaaaugucagacuuugcauuuucuuccuccagauuuguaaugcuuggcaugcucagugucaaaguuaaaaaaaaaaaaaguagaauagaaagaauucuacguuuaaauucaauucuuugucuuggaaaagccaaacauuuaauuuuaaaaaucacugguuggcucugugucaucuuuguagaaaggcaguacagaacuagguuguugccggcaguucuuccccagccccacaccccgcucuggauucauggaugaaaaugcaaacucagaugccauauuaaguacucagaauucucccauguucacacaucuuuuuacuguauugcugugauuguucaguugggcuugaaaaauauuauuuauuuucucaucaguuuuaugucuaaguuucauugacuacaaguuggaagaugaccacccagaauuacaaaucagggaguaauuugguccucucccuaaaauaaagagcuuuuauccucuuaagaaguaggaauggaguauagucugugucuguguauuuuaaacucaugauaaugaguugccccauauguagaaagcaugacucuauaugguuuucccauucccuucuguaaauauucucuagcuuaccugcaaguucuguagacucccuuuaauuccauguuggaauuguacuugacacuuugugccuggaaucaggaacucuggaaauaaagaucgccucaauauggaagggaagugaucucuggaaaagagcauaauugucagaugucuauaacuugucaguuuucacuguaccucacacuccuaauggcaaaccuuuaaauucauaguuggaagugucuuaaugaagucagaaauauuacugaugaauaggagcuaagcguacuuggccagggucuccuuaccauucacauggaaugcugguccuuuugacaguuguuucuucccauuguugaaggcagggaggaggacuuagggauucuucucuguauuccccacuaaaaagcccuucuguuccaguugcuccaaucagaguaauacacugcacagaaagcauacaagauauacgaugucuguggacagaugcucuguggcauuauuaacccuggcaguugcuuuagccguuguuuagucaauggagguuguuugggagcuagaauugggagagaacaggugauccuggcacccagcccacuuguagcucugcuuacugacugagagucccucugcaccccuugaaaguuuacugacaguucacacccuuaaagcacauuucuguauuucuggggcugaagcuuauggcagagaugcacauucuguugaauauuuauucuuuguguauauuccugucugcagagaaugugaucaaugggcaggacuacgaagugaugaugcagauugacugucaggugauggacaccaggauccuccauaucaaaaguucgucaguuccuccuuaccuccgagaucagcagaggaaucaaaccaacaccuucuuuggcuccccucccgcagccacagaggcaacccacguugucagcaccaucccugagucauuacaauagcacccugcagcuaugcuggaaaacugagcgugggacccugccagacugaagagcaggugagcaaaaugcugcuuucugccuugguggcaggcagagaacugucucguacuagaauucaaggaggaaagaagaagaaauaaaagaagcugcuccauuuuucaucaucuacccaucuauuuggaaagcacuggaauucagaugcaagagaacaauguuucuucaguggcaaauguagcccugcauccuccaguguuaccugguguagauuuuuuuuucuguaccuuucuaaaccucucuucccucugugaugguuuuguguuuaaacagucaucuucuuuuaaauaauauccaccucuccuuuuugccauuucacuuauugauucauaaagugaauuuuauuuaaagcuaugccacacaugcauguucaaaugguuuccacugauucgauuuuucauucauuuaaugcaaacccauucuggauauugugcuuauuugagaaaacacauuucaaaaccagaaaagccaaaaacacuccaaaaacaagcaaaacaauuuggagcuuuagauaaaaggaaaaacucccaguugguaaaguuuaucuuuacuuaggauuuguggcucacaccuaaacaaagggggucagggaguggguacaaauuugagaaaauagaaggguaagggaagggccaguggugggguuuggagagaggagauagcuccauuaauacacauguuuaaaagauggaaaguucacgccuguaaucccagcacuuugggaggccgaggcggguggaucacgaggucaggagaucaagaccaucccggcuaaaacggugaaaccccgucucuacuaaaaauacaaaaaauuagccgggcguagugacgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaagauggaaaguucgaugugacugcaguaugagauuaaagccacaacuauuguuuauuuuggggacucuaggccaccaaguauuagcacacauacuuauguuuucucuacuaaucugguccagguccucauggaccacaggacaaagcuuucauuuucauucauucuucuauugaaauuauaccaaauucagcugaggaauauggaaguaacuuuagacuuaaacaagacaaaaguuuuuucacugaagaauugacaaguauuugcuccuuaaaacaacgcagauuagugaacguggauuccugcugagggagugcaucccauaauauggcaauaauuuucaguuucuccaacgaaaagauagugaaggaauuaaaucuuuuguccucccaugguuaaaaaaaaaaaaaaagcuguguucauuuuuacuguacuaugccucuuuuuucaccauaguagacaauuauguuucauuugaugaauucauagaacuggaucucauacagcgauguccucucuaauguucuaccuuucaguuucuaaagugagucuuccucccucuccuacaaaacuuuucaauuuuuugauguaacucaucuacaaauacuguuucuuaccccaguugacuugccuuugucagauuucuucuuguuccacacuauagcaaucaauuucucuucuuccuuacaagaaagggaacgagaaauuguagcaaccucucaaggauuauaugcagcuaguuaguuuucugccugugaaauuaggucuggcuccuaaauaauuuuaaagaaccaucagcacuucuaacucucuggacaggugccucuuuguccaagcuaguuaaaugcuuuccaaggaaaucaguucaacuuuugugagcggggaaaagcagggcuuuauuguuguguuaccugggagucuggaguuugaaaagugcuaauuaaccuuccucuuuuuccacauuacaaaccuuuuuaagcagcgcagcacuccccuuagauuuggcuauccugggugauuuucagacaagaaccauuuucucuggggaccauucuucugcugggugccaaggaauauaaggcaaaugcccagaagaccuucaggugacugggcagucuuaucaugggauauuucuucuggcccugccccuucccauucuguaaugugaauuagccacaccagaggcugugaccauggcuaguagacaguggcaacauagucauccccaagaugcuaaucuucugcuggaacugucauacguuaucauggucaauguaaaccugguuuguguggggugauuauaaauagaguuucccuccucucugugacagaaucacaggagaaggacccaucucguggccuucuuguucuuagcgcuucacuuuuacuucaucccucgauucccagcuuuuucuaucaucauuuugccaacuccucagaugcaagacuuugguuaugucauacucaccaacguuagucccucucuuccaggugaaaagguggguagcgguugggagggagucuccacugaagagcaggaaggugguagcagggccggcagcucugccacagagcuaggggugccuguaaggugccgccuagagcagccugggagcuuugccuucuuuugucucucacuagcccuucuacucuuugucauugccuguucuugaguggaucuuugaaaugaggggacaggauucuccuaaggguagaguuucaggaaaugagugaaaggcaauugacaaaugcaaagaaguagucacuuuuuaaauugcuggcaaagcuauaauuaaucccuaggcacaauuguaguuuuuauuuuaauguuuguaugcacaaggcccuuuaggaaaugagaaguugccaugccagauuaauuuuuuuuuuuuuuuuuggugggauugccuuuuggggguugcagccagaaauuguggguaauguguguauuuuuuuauuuauuaaauuuuaaacaggauugugcaagcuuaugagacaauuagauaaacucauggaggaggcagguccuccuguuauuagaugauuuugugcucuuggggcugacaauaauacacucuugggaagugaugguagagacugaugggaauagucuuucugccugguugcaagucccaaauuuuuaaggguuaauggaaguaaguggauguuuccucauguuaacuacugaaucagauguuaggagcuugucccuuugggguugacuuaugcccagcaguacagggacacagcuucauuagaguguuaguguaaacuaacuccaaaguuaggaguuaaugugaaaggaucauccuugaaacaaaucugcuguuugccaugcuuguaguacagaaacuucacauggaguuuugggugggauuuguguuuucacaaguaaaaaaucccucacgauuauaaaacucagagcaucaucuaauuuuuuuuuuuaaugacuacaaguuccagcacaaaacuggcauuucuuugccauuucuugccaguaagaaguugacacggagguauuugaaagcaauguuaugugagucauucuuaaguguuccaaguaaguuuagaaacagaaaaggaacuugggauucaaauugauuuuucaaaucauuuuuaaagagacaucauccugacuaaaucuuagccugaaccuuccuccccuguguguauuccccgguagucaccgcagcgagaugcuggugagacugccgugguggcauuuagcaucguuaaaacuggaaaacucucaagcucuuugccacuuuccuacuauuuuuugauucuugccauuuuaccaagcuuagguugugaaacuugacagaaauguauuacaggaaaaacuuauaauuguauuugacuuucuaacacauugcaaaguuucaaagugacuuucacuuucaacaacauauuagaaguaaccacuuuugcuuucacagccugaagaguuagagccugaucugaugcccccuuucacucugaagucaugggaaauuuuccagccaugaaagcccucuuuccacugcauacugaugggcugacucagcuuccuucagccgacugagaucuuuucauacuauuggcuauuucauaccaauuaaccucuuaaauaagauugugaauugccaaaauugauagacacuuauuaccaccuguggacuccauauuccuuaccacaaauguuauuuucaucaguccugagucauuuuaacuuacagaaauuaggauuguugcugcuaauaugaauaccaauuauaacuuuuagaaacaagaauaaagccuaaaagagaaugaaauauaagaaauguucguucccaccccuaauaacauuuggaagugaauauucccauuuucuuccacccacagggauugggauugauuuuuaauuuccuaggaaacaauacuagacuacccaaaaagauguugccagaauccaaaaggaacuaugcucguaaaagaaaugcaguuuucuccuaccuaaaaaaaagaaaguaaaguguguucuguucuuaucuuuuuaaugacuaagcuuuaaacaguuuauuuuggguaagacuagaacuuucggccauuuguucuaauauguguguuauuagaugcaauagaauuuaugaaaagaagaaugacaaagguaucugauuagaaaauuugaucuuacgcaugaauccaugucauggccagccacugucacauagugggugccauucucaacauauugguuugcuaacuuuaagcauuagggauuuagcacacuaaaauacuuuuaauuauauuagguuugguaacuaaggaguaaauaaaucauaauuuaucauuugccaaggccaacaaacaacacuauugugcuguuugcucucaaugaaguugaauaaaccaggaggcuuggcauauccccuuuauguuaaucccagcuagagauuaguagguugacuuucacagcaauuguauauugauccauuuuaacucauccuugccauaauuuccaggccagucaccaggacagaggagaugauggggaaacagagcuuuagaugaaaacuacuaugcacuacuagccuuagaggcacugguuuccuguuaccacuuuggcaaguauggauggucuaaguccaguagggcuucauccauggagccauuagaacugaggggggaguguuagagaugccauuucaccaggaucuuuuugcucagguuguacccaugccaauugaagaacguguuaaagaugaggaggagagauguaccauucucucccuuaauaaugauguugguuugcaaaaccuaaagaaauaauaacaacagacuauuucauacuuucaagcaagucuuuauacuaccuguuauuucucuaaaauucaaauaaagaauuuuuaaacuuaccuuguuuauucuguauguagaaagagagaaaaaagcccccaaaugaaucuucaguguugggggguuaguaaugggaaaggaagccugaaaaggcuuuguggcuuguguuacuguucagaugaaacuguugaacuauuuuccacucuucucccaagccuaauuaaguaaaaauuuccuuuauuuaaguguccagauauuuaaacuacaaucuuaucaaggaaaaaaaaaucuaaaaaccca

SEQ ID NO: 12950 - RNA, 536 nt, Homo sapiens
ggguggaaaggccgcgcugaauggggccgaagcuccgccccucagcgauaaguccagauuccugcggccgacgugguccuccgagggagcagcagagccgccgaggcuggcgagucccaggggaaggauguucuagccggagucuacucgaugguagggcaggaagccgccuugucucugggcgcggccauguuggaggcuccgggcccgagugauggcugcgagcucagcaaccccagcgccagcagagucagcugugccgggcagaugcuggaagugcagccaggauuguauuucgguggggccgcggccgucgcggagccagaucaccugagggaagcgggcaucacggccgugcuaacaguggacucggaggagcccagcuucaaggcggggccuggggucgaggaucuauggcgccucuucgugccagcgcuggacaaacccgagacggaccuacucagccaucuggaccggugcguggccuucaucggucaggcccgcgcugagggccgugcgguguuggugcacuggug

SEQ ID NO: 12951 - RNA, 4999 nt, Homo sapiens
cauguggccacugacagcccuucugcuccugggugaguccacagugaggcagcagaagagcuuugggugguggagaauaggguggaccaagguauggggagaggaggguggguauccaauccucaguuuccaagugguucauuaucuuuuuuuggaggggugaagaagaaggggcuuucucagagcuugggaaaccaggggcagaagaagaaaaacagguuuugggaccauucagccuuucuugucgucaagagucucucuccucucaucgccaauauucuccuucuccuuccucuuccuucuuuccuguucugcaguuccaagcagugggcaagcuggugagucuuauaaauuucucaucccaauuuucuacagcuuccacuccaacccccuaagugaccuuuucaaguagacuccucacuucuuggcugcgcugggauagugucucuucccacucucgucaaccccugggacuaaauuugcuugaaggcauuuagaaaugggugcuggcugauggacugguagucuguaacccaaugaaugugaucuccucuccugcagggauggguuaguacaugggcuggggccugcgagcugggguuuccuaagauuucccaaacucaggucguuucuuugggcaccucaccuugauucucuuugcaugcugcccccucucaccccacuccccaccccagcuacucuggagaagcccauauugucucuacauccaccuuggaccaccaucuucaaaggggagcggguaacuuugaagugugauggauaccacccacugcuccuggagcuccagcccaucagcacucucugguauuugggccaccuacuucugcccucucacaagaagagcauugaggugcagacaccagggguguaucgaugccagacacggggagcacccgucagugaccccauccaccucucuguauccaauggugaguggacugagcacgaggggagggggagcacgugucuccucuggcaauacuaguccucuggugggagggaacacugggccaaucccaaggugcaggaaacaagggccacacuggggccuaucuuaagucucuggagcagguagggaccugcacggcacuaugcgagagaugcaguaaggcaugccuagcccccaagguccccuuacccuccugccauagugugaggcacagugugaacauuucuguuuguuucugagaccagcucagaagagcaaaggcuccaaggaccuggagugcuggacagagaacuuuaggggguuggggagggagcaguaaaggaaauucaccaaacaggaaaggugaguuucccuggcagucugagcauagaucaaggaucuacucucaguugaacagugugaugcuucucugugccucaguguccacaucuguaaagaagggacaauaauaguauguaucucuucggcugcucugaggauuaaaagugaauuaugauuugcuaaagaaaaaaagcagcaauugaacugagcacuuacucaaaguuuuauugcagacguguauauguguacacaggagucagcugagaaacugauucucgagaugcuugaaggguuuuaaaacaggauaagaaaaauaacaauaauuuguucaauaaaguacaggauugcugggcacgguggcucaagccugugaucccagcacuuugggaggccaaggcgggcagaucaccugaggucaggaguucaagaccagccuggccaacauggugaaacacucucuacuaaaaaaaaaaaaaaaaaaaaaaauagcugggcaugauagcgggugccuguagucccagcuacucaggaggcugaggcaugagaauuguuugaaccugggaggcggaaguugcagugagcugagaucgugcacuccuagccacaauuuguauucagaauuuaaagcacaucacucaauguucagauuagcacuuacacacacuucauauucauacucugugguuucuuguucggaaaucauuggugauagcaauaauuauacugaguacuauaggaguaauuacugcuuacagauugggagugcauguggauuguggcuauuacuugcaggauucuuucucaauguacaacaccuaaaauggcaucugcucugugcuagggcuauguaagcgugcuauaaugaucacaggguaauuaugaggugcuguaggagauaccuaaggcucuccuggggugucagggauguuuucuggaggagauaaggucuaagccuagacaugcaggacaagcaggugaacuuaaacaggugaaagagagucuucuuggcugaggaaauagcagguacaaaagccucgggcucagagcagggccaguucucucaacaguucaguauggcuggaacuuauccuguuaggaguggaagaugaggaaaguagagaggaaauggggcaggaaugaauacugccauggugagggagagguaagcaggacccagucaggaggacucugacaccauccuaaggagguuauaguugauucucauggucaaaacccuuugaggguggagccaagucucuggcaucuuugcucccuggcuaagugaaagaccagccaucccccuuccuucccacucaccuacaaauauaucuugcacuaugaggcugcugggugccaaccaccagggaaggccuguccgcucaagaaagcagugggaggccaggcccgguggcucacgccuguaaucccaccacuuugggaggccgaggugggcguaucaccugaggucaggaguucaagaccagccuggccaagauggugaaacccugucucuacuaaaaaaugcaaaaauuagcugggugugauggcgcccaccgguaaucccagcuacucgggaggcugaggcagaagaaucgcuugaacccaagagguggagguugcagugaaccgaguuugugccacugcacugcagcuugggcgacaagagcaagaccaugucucaaaaaaagaaaaagaacaagaaaaaaagaaagaaaaagaaaagaaaagaaagcggugggagauggcggggaagggagggagaggaguuaagaggagaaagcuggaaggcugugagagugggagaucuccagggcuggacuuucuguggagucaagcgugucuguggugucugucgcagauuggcugauucugcaagugcccuaugcgccaguguucgagggugagccgcuaguccugcgcugccgcggcugguacgacaagguggucuacaagcuucacuacuaccacgacggccaggccgugcgcuacuuccacuccagcgccaacuacacuguguuacaggcgcgugccagcgacagcgggcgcuaccagugcucgggcaccaugcgcaucccgguggagagcgcgcccauguucuccgcuaagguggcugugacagugcaaggugggagagaccaggggccccgggagggaggcaaaugagcauugagaaauucugggacaggagcucggcgagaaaagaaggggcggaaguucaaauagcugccacuuggaggguuucucuuagacuauggacgcugucuccucuccuuugccgugaagcagcgcuugauccgccgccugcuuggaggcuggucccuuuccccgacgcacauccuggcuucucacucuggcuggggacucccacagagagggcagcucuggcaggggcaggggccacugugggacugggacgaaggagcgacucccuagcguccugcaaggcaggcgcagcgucuccuauucuaggcugcagaacccgagcugagugucagucgggaugugacaugaagcgucuggccuggucccucuuccuuucaagcuuuccccgucccucguggacucggucccccugccccacauuucagaaggcuccccuucccccuccacguggacacacggccuccuccccuccccccuuggucugugggucugcaaggagcccucgcgggaagcaggaaggagcggggucgcggagcgguggacaagccggcgccguugcuccccgcccucuccguagagcuguuccgggcgccggugcugagggugauggguccgcgggaggcccgcggcgcggcgcugggugggguggugcugcgcugcgacacgcgccugcacccgcagaagcgcgacacgccgcugcaguucgcguuuuacaaguacagccgcgcggugcgccgcuucgacuggggcgccgaguacacagucccggagcccgaggucgaggagcucgaaucguacuggugcgaggcggcuaccgccacccgcaguguccggaaacgcaguccguggcugcagcucccggggccgggugagugccugcacacccucccggacgccgacccuggcggucagcccugcuuccgccucucggcacccacgaaucacccccgcccccugguucccgucccgccccccgccuuucccaucuccccuucgccgcccuccuccucaccccucuuccggccuuccccauccccgcccaccgcccuacgccccucccccagcccagcgccgagaagaaccaugcaagccgcgcgugacugggcguaaugcauucacagguucuccccuggacccggccuccaccaccgccccagcuccaugggccgcagccuuggcuccugguaauaggccgcuuuccuucagaaagcccccgguguccagaucggucccguuggucaccuccguccggaacaccaccuccaccgggcugcaguucccggcgagcggcgccccgacugcggggccacccgccugcgcuccgccgacgcccuuggaacaaucggcuggagcccugaaacccgacguggaccuucugcuccgagaaaugcagcugcucaaaggccuucugagccgggugguccuggaauuaaaggagccacaggcccuccgggagcucaggggaacgcccgagacccccaccucucacuuugcugugagcccgggaaccccagagaccacuccuguggagagcugagggggcgg

SEQ ID NO: 12952 - RNA, 6738 nt, Homo sapiens
gaagggacaaagucccauuccagagcccaacaccuaggguuucauuaggcugggguuucucaaacucaguacaacugacauuuugggccagauuauuuuucguugugggguacugcccugugcauuauaggauguuuagcggcaccccuggcuucuauuuacuggaugccaguagcacacacaucccaccaucccccaaccccccaaguauaaugaccaaaaugucuccaaacauugcccaauguccucuggggggcaaaauugcccccaguugagacugcuguauucaauccacuuccauuaguucucuuuaaaucacaacauucuggucgauauaacagauagaaauuccugaucuagacagcagaauucuguuguguuaagagagaauacacaauuauagcuaaacucuaauucucacuuuauauaaauuuauuuacacucaccuaacuacauuauucuaacaaaacacugggacaacuuguaaaaguacuuaugcauaugugcaggacaggaagagaaaauaaagaaucagauuuauuggggugguuaagugagaucauggaugaacuguuuacuucuauucagcaguagccuuuguggucccaggcuuccgguggccagauaauucccucaacuccaugagcaggugaccgaggaggacucucacauccugcauguguuugagaagaaggcccaucuggugauacagaugaggaucuggcauccccagaggagaagaaaagccuggauccucagaagaugggguuggcggcggaggcagaggcccaggggccuccucaggagcaguuccuggagcagcugauuucugaggagcuggauucaaugugggaggugcagcagagcuggaagcaccugaauuauggggcaggaggcacauacaagagugaagucugacucuggcccuucccucccaucccuggccaaucuuucuuguucucugaaaguggcuguggggcccaauggcagcagggacuugaggacucuagugucccuccugguccaaauuuuaaucugaagcuuggccacuucuguuugaaauucuucagcagugaggcuucaccacuggacagcuauaacuauuagccaguucuuucucuaucaaggcugaaucuaauucccugaagcaugaaugugguaacugguucuaggucagccucuuuauuauauaagacauuaguccaauuccuugugcuaaugccagccuucagcuuuuugaggacaccucugcuggccucugagucaccuccucuucaggauagcaucuccagccccuuccauuauuuuucauaugacaugacuuuaagcccccuuaucacccuggacaccucuucugggaguguuucaggucaagugcagccucuuaacaguggcucccagaauugaacauagacuucagacuaucccaucuucauuccagauauuaaauuccuauaaaugcccagagagcauguugggggggaugcuaaggcuuguggggcagcagguguggagcuggcucagcucuuggucuggugaggugugcaccacagucugagggagaaguucucuauuugugcugucucucaucaucagggauucuggcccauuguuccugcccccucugugucccuucuuaaccugcucacacugaaccccagcucacaggucaauuuauccuaucccuccuuuucacucacacgcaugccaaacagacaaccugcacucugaugcgaacucacccugcacucugaucucuagcugggggcucuguuuccaaacuugguuguccucaguggcugccucacaccaguaugacccggagugaucuucugaagcuguggggaucuggaauucugaggagagcccccugcuuugcacuauccuuccauccuuguagaaggagaagaggaggcgggcagcugaccucugcaggggcaacuuugucugacaacucagggucauggggcuuccugcuugggguucagcugaggguacagcucugagaauuggcgcuggaaacaguucugggaaaaagauaggcaggaaagaagagcucagccaucuuauauacagguagacacaugcaggugaagagacuuggggagucauacuuccuuuccccuguuuccagcaggaaugggcucucuuagauuccauuugaaucugucaaguucuuucuguaaguagacaggacuaggaaagauccacagaugggcaaaucugauaguuguccagacacccaaucagugagcacuaggaagcauagaucugggugguaggaacuaugcuggacucugaguggggcuggaugacuucaaaaggcugaggucucgucccuuucgaagcccaacuugggcauuugccagcaaccugcuccauagucuguugaugaucuugcuaccuccaggcuaaagaaagacaauuugggcucccugucucuccuuacccuccccugccaugacaaugcugcuucuagcucucaccuuggacugugauagccacaacagaugcuguuucugggaucccaggaccagggcucuggaagaugccacugcagugguagugcccgcugucugccuuuuguaccacggugauggagaauucccuguuaggcccggggggacccagagcugagccaucucgguagaaggucaccugagucaguggccagucuugccaggccuggcagcgcagaaccagcagguccccuucaaaaacuggcuuggcuggaccuuggaggaucagccagucuaugguccagagaaagagcugagugucacccagggccucccuugggggccacccccaagcaugccuacuccccuaaacuuucucugaggguccagguaaacucucaccccugguugggaguaugggacaacuucccuagggccuaggacuuagagcacccugguugcugugggcugaagacugggaaggaaguaccucaucccauagccaauuuccuagggacacuuuccugggugggcucugaggcugaaagaagggguuuggggcacugcucaggccuucccaggaccucaccauaggacacaaucagguggaaggguucacugaaaguguaggccuugaccuggaagccagcuucccuugcaucagucaagucauccuccguguggcagcugcucuccucagugcagacaggucccucacacugcagcgucucaaaacuggcagcugaagagggcauggcccagggagaaccagaaaaugaugaugcaacuuggagaaagaggacaggguuccuccaucucccaggauaaucauccuuuuuagaaugagacuaguaagacaucaaaaccuuuuuuuuuuucggaaagaccccugagagugucucagggggauaguuuugaccuugauucacuggcguccaggugcucucagcaaaugcacugugguuuggagaagagggaggggagagaaugaaagaauggugaaacucaccggcaugacauccagcugcugguacgggaaaccaggagcaaagacaaugguaacucgaagcagggaggcauaggacaggaaugaaagggagacaucagauucuaauguucacugggugccagacccugcuagcacuugugugcaguaucuaacuucauccucacaaacuuuccagguaggugacuuuauccucauuuuauaaucuuaaagaaacacacuuagaaaaccaaauuaacauacccaaagcuuaaaaagagacuaagcaauggaucgggaaaggcaggugugucugaguccaaaaucaauguucuuuuuacuucacugugcaaauauggucuacuucaguccucagaccuuccucggggacuuucuuucauauucugauuuucccaaacuucacuuggcuccucagccuugaauauguuaucuaacaaagagcuuucaguacccagcagugucucuccuccuuucuuccucccccuugcaggucuucacuuuucagccaucuuuacuuuaauguccucugccacuugaauuuucccuggcaguggcacagagcuuucucugucuuuuuuccccuccucccaguccauauuaguaacuguggaacaauucuuugcuccagauugaaauuuagaauuauccauuucucaccacaucuccucaaccuaucucuuaccuucaugguagaccuaggcaagggaagugacauuucucccuucucugggacugcucuuuaucucccuaacuauucucccccuccuccagccucauggccauucacaugugcauacuucuucacuccaucugacugucauuucgugccccacuugccuuuauucucuuccacucccaauagcccagcguucuucuuugauuuugucaugucccuuaccaagaccccucccuacuuccuaauucucaucacaucaguaccagguguuuucuuuccauccuuucuccgcucccuucacuguaaugcuaccucuuuucaguuccuccacugucacucaucugugcucugccuccucuccauuuuuucuuuuuaaaaauaaaaucuuauccaggcgugguggcucaugcuuauaaucacagcacuuugggagguugaggugggaggaucccuugagcccaggaguuugagaccagccuggggaacauagagagacccugucucaacaaauaauuuuuuaaaaaauuggccaggccugguggcacuugccuguggucccagcuacuugggaggcugagauaggacgauugcuuaagcccaagaggucaagguugcagugagcagugauugcaccacugcacuccagccuggguggcagagcgagacccugucucaaaacauaaaauaaaauaaaauaaaaucuuguuggguuacugggaacucacucaauaaaccuuaggugguagguauuauuauuuucauucuacaaaugagaaaacugaaccagaaauagaaaaagugauuuucuaaagugacauagagcugguaaauagaagaggggcuugaaacaggaguaucugauuccaagucugcaguucuuaucacaagacaaaaacaaaaaaacauugucacuacccacaaauagcucucaauuuaguggaagacacagguagaugaaaauauuauuucagcauaaguaggaaaauauuauaauaagaaaaauguaucgcaagcagccauuggagcagaaagaagcauucaagaaaagcuaccuggaaaagauaccauuuaagcugagucuuuagggguaccuacacauuugcaaggagaaggagaguagggugccauggaaagaacucauuucagguagagauagugguauaagcaaagccuuagagacaggcaagagucuggugugugaguauguaaauaugaacugauugagauuuauuagagcauaaguuacaaggcugagaggguaaaaguagaggcugcuuggccuuuugugccaugauaaagaauuugggcugguaaacuugaguuuuagaaauuacucugucugcaggguacagaauucauuucaagaacacaagguuuggacgaggagauuaguuaggaauuuacuggaauagcccaagucauagaggaugagggcuuguccuaagacauuagugaugauccaggcaagggacugcuucuaugaacaauuuagaagguaaaauuggccaaaccuaaugauugaucagauuuagagaaugaaaaagaaggaagagucuggguuguuucugagguuuauggccuuguaaggguagaugcuggugucauuagcugagaucagaaaguggaaaaugaauuagaugaggcaggggccaaaaggacagauaaguucaacucuagucacauggugcagagacacuugugagauauguagguagauaugucugguaugaagcuugauauuugaaugugaagcucaaaagcaugguuaggguuggggauaugauuugggacucuuaaauacagaguuauaguggcaaaaauuaaacagacaaauaagcucaugaaggagauuguguaaagaaagaggaguacagaggcaaggcuauaacuauagagaacacuaguguuuaaggggaagagaagagaagcuauuaagggaucaagagaaguccauguaguacaaggagaaaauggugccauggaagccaggguaguagagaaugcaagaaggaguaagugaucaacagagcccagugcagcagagaaguccagcaggauaugaacugaaaagcaugccauaacccagucaauauagagaucguugugcccuagacaaaaccaauuccaguggaagccaggcugcaagcauugaggagcgugugagaagugaggaaguggagauagcaagugcaaacuauucuuuuaagaaaacuugucucacaagugaaagaaaagaguugagauuagagcuagagaggauaucaugaucagaggggacuuucaggauggaagauuuuuauauucagaaaguaauucaauccuguacaccaaacuuucuuauaccuacccuucuuauuccaccugaauacugcuucuuuggagggccagaauuaguccauguuucuuuccuucugguccuuucucccaagguaagcaaagcuccauucccacaccaauauucaaauauuuuacuuacccaguagcaucugggccacccagagcacaccaagggaaagguagagggcccaggccaugaggacacagcccagcuucauggugacuguguuuaggucuccugcaaccccaacacugauuuu

SEQ ID NO: 12953 - RNA, 9544 nt, Homo sapiens
uccgcucagcucugccuagcugguuugcugguuguuuucugguuuuuuagucuccuccuccgccuccugcagccgacuucuaccggaauuugccaggauuucggcagaaacgccgcuggcucaaaaucugcagucuacguuccaccugcguacauauucauuuuguaucgcacucccaaacagcaaacggcggacuuguuuagauucuuccuuaaggacuucgcagucuguugcguucccccugccucccaggucggccuaaaaacguggugguuggccgguugagaccccgaagagaaaagauacuuuggguucccucccuuucuaauacgaagcuuuaaccagacagauacauaaauugugaccuaaguuggggaguguguagaggggccucgagaagaccuugcggaccaccauucccgaaaacgaggagccucaucuaaccaccucgauuagaccccacaauuccuggguuugagcugccacauggaccaggcgcccacuagccgaggacaaugcucccuuguucguuguuucagcgcuaugugggugacacccacagcuagaagaacccggagugaggggaagaacacgcuuugauuuauauauguguauauauauauauacaguuuuagggaacccaagcacaggaaucaacugccgagcacucaagacugaagaaagaagaagagcaaaugauaaaggaagggaacagagcacaaaaguucuugacucuuguggggaguaggguggagaggaguaaaagggacaggcuagagcaacuccuauuucuacaaaaaaaauacucaauuauauuaauauucagaucuuauguauauuuagcaucccugcacuucaggauuuaaauagcacaaauucacuuauuucugcaucagaugaauaauacuacuuugcauuucuauaaugcuugacaaagcacauucguacacuuuaggauugaaagaggcucucuaauccaaucuacuaucuaugcagggaucuccucugcaacacccauaacagcugaucuucaagacucuacccccccauauucaaugauggguaccucaaacaacaaguuuuauuuaaugaacaacuuauucguuaguuauuauauuuaaauacaguuuugugcuaucgaaauuccagucauugacuuggcucucuggagcuucacguuaacaaacccaaggaaugccuuuuucacucagaucuuuuuugguuuuucuuuuucuuuuucuuuuucuuuuauuuugagacguagucucacucugucgcccagguuggagugcaguggcgcuaucucagcucacugcagccucugccucccagguucaagcgauucuccugccucagccuccccccaaguagcugggauuacaggccugcaccaccaugcccggcuaauuuucuguauuuuuaguagagauggaauuucaccauguuggcuaggcuggucuagaacuccugaccucaagugauccaccggccucggccucccaaaguccugggauuauaggugcgagcuaccacucccagcccacucagcucuuuaaauauuaauaauuucauuuagcauguaguuauggacuuuuugucaguccgugaaaaguucuguaggggauucaaagauacagauguuuguacuguccccaagaagguuauagccuuagcaggaucaauaaagacaugcaacaaagaaaguagcaacaacccauugaagaggguguugauaaaaggggugguuagauaaagaggaaaugauugcuuacaguugggagguggaguuagguggaaauuuuggaggggagaguuuuggggguuuuuuuuuuuuuguacuuugaauugcuguuuuauagaaauguugacuacaacauccuguaaacauuugucaaugaugaugguuuugccuauggacuucauaagcaaucccauauuuagaauuccacaacccaaaucuaauacuaaugaccauacccaccagggcuguggucuaaugagaugccaggaagguaccaggacacuguccuucaccugggugagccugcaguggucucauagcaggaauaacaaugaccaccccacuuacauuaacuucuagaggucaggcacggugacucacaccuguaaucccaguacuuagggaagccaaggcagaaggaucacuugaguauaggaguucaagaucaaccugagcaacacagugagauccucaucucuacaaaaaauugaaaaauuagcuggguauggugguggcugccuguggcucagcuaaucuggaggcugaagugggaggaucgcuugagccugggagguugaggcugcagugagcuaucauugcaccacugcacuacagccugggccacagagcaagaccuuaucucugaaaaaaaaaaaaaaaaaauuuuaaacuagcccagcaugcuggcaugcgccuguaguucccagcuacuuggaaagcugagguaggacaauugcuugagccucagaggucaaggcugcagugagccaugaucaugccacugcauuccagccugggcaacagagcgagacugccucaacaaacaaaaaaaccucagcucugguuauguagacauccccauggcuaacuccaccccaacaccuucagguucucaugauguaccaaauugaauucaccuucuuucaccugucauuuaaggccuuucacaaacugguuucgacuuuccuguccagucucauuucugacuaugccacuucaaguuuccccaaaucaagucaaaguggauggcacaagaucggcccugaauauauccaacacuucagaaaccuacaucucauauacauacacacacacacacacacacacacacacacacacacacacacacacacacacauucugucucuccgucucaccucuuuguccuugcuuuugcuguucuaucuucugguaacccucccuaucucccuuuccaaaaugacagucauccuucaaggcugauucauaucuaacauugccuccuagacacaacuauucuucccucugaacuauuuauuuguuugauuauuuauuuauuuauuuauuuuugagacagaguuucauucuguagcccaggguggaaagcaguggcacaaucauagcucgcugcagccuugauuucccagguucaagcgaucuuccugccucagccucccaaguagcugggacuacaagcaugugauaacaugcccagcugauuuuuuaaaaaauuuugguagaggcgaggucuugcuauguugcccagacaggucucaaacuccuaaacucaagcaauccuccugcauaagccuaccaaagugcugagauuacaggugucagccacuaugccuggcauaaacuucauuuauuaaaguuuauuuugucuuuaaucucucauauaacuuagucuuccugauauugcagcugugugugccccucuuuuguacucccagcauuuuguucauuacuaaaggaagugucauggcuuauuauacuugauuguugauggguuuguccucugaucuucccaucuccaccuccccaaaccaaauuuucaacuccuugcuggaaggacuuaauuuuuauuccucucucuauuaccugcauucucauacuuuacauauugcuggcacuuaauacaauuuuguagccuugaaauaaauugaaauggacuuaaacagcagcaugaagcacugaaggacuucuugacaaacggaaaggucaggggcuucuugccuggaaauaguccaguggagaaaaacuucugucugggaagaaucgcacaggaugaagggaggugcggggaaaaaaacucccauaggacuuggucaucucaagaagucuguaaugcagcccacauuagaggagauaacaggggauauccuauuuucagaguucucugggggaaaccucccucuaguuccuagggcugugaggcagccucucucaggcaaggaggcugaggagaaaucccuuuuuauggccuuuaaauugagguuccauaucuaucccucagagaagugugucugugucccuguuuuugucccucucccucaccaccccccacaacauuccagccuggggcagggggaggccaguggacacaaagcccucuguguauggggugguauguguccccccaccccuccacccagacuauacaaugccccuucugcucccugcacucugccccccuccccaccaccucucaacugcacaugccaggcugcaauugguuacuggcugaggacagcccccucaugcuggggcccuaggggauuuuaagcagguuccaggaaccccccguucaguuccuggucccccacuuucucaaccccacagaugcuccgggccccugccccugccccagcuauggcuccuggggcucccucauccagccccagcccuauccuggcugugcugcucuucucuucuuuggguaaguggagccacucuacucugggagucuugggacucaggugucucucagcaauccccacagccuuugcugcacuccccacugcaaccaaagaaagaacaagcaggagcaggaaggugacauuauauucagaaagaaaaaauaugcggcugggcaugguggcucaugccuguaaucccagcacuuugggaggccaaggugggauaauuauuugagccccaggaguuggagaccagccuggacaacauaaccagacuccaucuguaaaauucaaaaaaaaaaaaaauauauauauauauauaugaaaagaaaaaaauaugcauuuagagggaggaaguagagguuuuauuuuaaaagaaaggguaaaagagaguguagcaagcuucccugagugguggccauggcuggacccagguuggaaauaguagcaugcccccagagccaugcuaacagccuggugggaagcaguguuagauuacauaaagaaauaggcucaaacaccuggguuugguucccacucguccccuagcagugcaggaggugccuuaaccuuaguuucccagaaggaaaaagagagugcgaucuaaguaaggagcccagguuuguggucucagcuccucagauuuuuugucucucuauggcuccucaccuguugugugggugaauggagugagguucuaugagauucugggaucuuaucccucuaaagcugucuuccuucauaagcugaccagcccuuuccuugcccccuggcagauguugggugaguaagaggucaaagcaggauuauuggaauggccccuucccuucucugaacugcccugaauccuagugcaaugagugagccauaggcaagugggggugguggggaggacaucaagggaaagggggcuggccagaaugcccaggguucucugcugucagcugcuugagcccuagacucuucuggguuguacugggcuauuuggggguacccugagaaaauguuaaagauagagaguuggagaagggcauagugagggaaauagggggaaggaaucuugauguauaaggaagagggagaguugugucucaacacuuguuccacucauagaaccauugagcacagcugagaagggcaaugguugauauuguaacaggaggaauagaaguuagagccagugaauuaucucccuuguuaaacaagggggauucccaagaagguucuaagguggaaguuccagaagguaaguacaugguauugcaugcugaggugagagauucaggacaguuggggugggaguagggguggcaugagccccccagcguuggucagacaauggaacuuuguuugguugccaccucccccuccuguagaacaaaaaggucuacaguugccccucccuggggccagcccacacacauagucucucuggaaugaccuuccuuguguggguaagucuuggggauggcacugggccacaguggccaagaggaaggugaggacaguugaaccauagagggcucacauguagggucaucugagcuguaggcuugggguguugcucugcacccagcugagagggguaugaggcccuucccuuccugacucuccagucaagagcaagcuguauggcaaccagggauucagcaaugaggacaguugugccagggaagaagacuuauauuuucuaguuaucuucauuuuuuucugcaagaaaucugaguuugcuguauugugaaauccaaugcagcuguuaaaauaagauugauaucuaugaaucaacagggaaagcuccuccagauacguaaguucuuaagcaaaaagacacuagaauacaaugcaauauguauguggaaaaaaaaacuccacaaaacuauuuguuguaaguauguguauaucuugaguuuauugaguuuauacugaguuugauucauauuaaauggauaacuuguuacaucuuggaagggaauacaggaaaggaauuuguugggcuaagugucaaaggagacuuuuguuuuauuucuauugcuugaauaguuuauaagaagaguacaauauguauuaccuguauaauuuauaauaaauuuuaaaaauuuagaacacugcaucuaaaggauagcuuaaaaguuagauacugacccaaaggagaagugagacuuaaagacagaacccaaucucuggaaguccucaagagaauucuguuacugcugauuucaucuucucuacagacaugcuaaagagcuugacagacacagcauuuaugcucaucuguucaguuaguccccagagacuuggggcucagaauuuguuguuucuuuuccaaauuggccucugaccugugacucagcacuugauuuccuacugaucucacuuccucuguaucccuuacugggcccauaggugcaucugauuccccacuuugugcuugcagugcuguccccggcccaggccaucgugguuuacaccgacagggagguccauggugcugugggcucccgggugacccugcacugcuccuucugguccagugagugggucucagaugacaucuccuucaccuggcgcuaccagcccgaagggggcagagaugccauuucggugagugccugggggaauccugggguuggauaacagaaagugcuucaaagaacaacaaaaaagauaacuugggcuaaggagggggaaauccuuuuugagccauaaccccaacuuuggcaagguaaaugacagucuuugucacccugacuacauuguccucccuucuccagcacuacccuuuccagcccaagaucccuuacccugaggcuggagcgaagcuuuuuuuuuuuuuuuuuuuuuuuugcuuuuuucuuucuguaacaaauuauggagcuaagcuuugacagcuguguucucauuaggguccucucacaugcuuccccucauuccucauagaucuuccacuaugccaagggacaacccuacauugacgagguggggaccuucaaagagcgcauccaguggguaggggacccucgcuggaaggauggcuccauugucauacacaaccuagacuacagugacaauggcacguucacuugugacgucaaaaacccuccagacauagugggcaagaccucucaggucacgcuguaugucuuugaaaaaggugugagaagggauggggacaaggguaugggaagcaguuugggaggggaucagggaggacugauagguugggggaagaggcaaaaagcccggccuaaggaccuuuauucaggcucugggagcgugggcagaaggcaguuuuagcugggaguccuacauccucaaugcagggcauacacucggacuaggaaccacagauacagggcccugcucauucucccacuucuuuucccaccccuccuagugccaacuagguacggggucguucugggagcugugaucggggguguccucgggguggugcuguugcugcugcugcuuuucuacgugguucgguacugcuggcuacgcaggcaggcggcccugcagaggaggcucagguaaggggcggagccuagcuccccucccccucuccccacuaucccccaucugggcggagacuacuccagugggugggagggccaaggggaagaggaagcuguguccgcggugcaagggguuccggcgaggccaaacguacagcagucucucuucuugcagugcuauggagaaggggaaauugcacaagccaggaaaggacgcgucgaagcgcgggcggcagguuagcgggacuuggggccuagacaagaugggaaggagaacccugggagccgccgggcagcagugaggggugggaugggaacagucaagccccagucgcucggugacugaugugugcgccccucccccagacgccagugcuguaugcaaugcuggaccacagcagaagcaccaaagcugucagugagaagaaggccaaggggcugggggagucucgcaaggauaagaaauagcgguuagcgggccgggcgggggaucggggguuagggguggaguccgccaaaggcccaaaggugauggucaucgagauggagcuacgaaaggaugagcagagcccggagcuccggccugcugucaagucccccagcagaaccagccucaaaaacgcccucaagaacaugaugggccugaacucggacaagugaucgccacccccccaccccaggcccugccagagcagggggaccuaggcuccucuuacccccgucuaggugcuuucccucuuugcucccccgcccugcccugcccucaccucccuuugagauguaaguuucauuccagaauucauuccccaggcaauuguauucucccccaccuucaccccuggcuuucugggagcccaggagcuaauccuaccccucaccugccccgggggcuguguguuuggugccuguccaccugagcacugagaagaaagggacuuugauacccucugccucaaguccaggccaccuggcauucccaucuccugcaucccccagccugucccccuggcuguuuccucucccgucccucccuccccucuaccagguggcccagcuccauacucuguccccccagcuaauacccagagcacccagaucagacucuccuucaggguuuauuuagguuauuauuuuuuauuuuuuaauccauucuuuguuuguuuaccugugcucauccucugcccuuacacccaugacugaggaccaaugacgucauguggcuuuugcaauucacgccccccuuaaguccuuaaugaagagccagcccaaguagaggggccccugauccucacacuucaguauagcauugguucccccugaccacuuuggagcacuguucugggacuccaggucuugaggagagagacagagagagagaauggauccucauaggucagggagugggggagggggcaaaugagccuuaagaaaugguuuuuaaacaaccaaacaaaaagcaggaaaaacaaaugggaaaugggggggcgggggggaggaagaggcugcacugcagccacaggggauucuuaggauuuuucuacauucuguauauuucuucucaaaccuccaaauguccuuaaauguuuaauaaacacugacauuuccagaag

SEQ ID NO: 12954 - RNA, 4039 nt, Homo sapiens
augaaugaaugaauagaguccaguccauggcaguuuuauuggggguucucccuucccauauuuuagcuggaguugggaauggggaagagaagaagggugggacaagagagugagacuagaauauaaauauccguaaacagcaucugagcauuagucuuuaacagggaggaggaaccacugguguauauuaauuuaggacacaggaucauuauagggguagggccagcugguguuaauggcaugcaggcauaugugaugccaaccaugagggcuggaagaaccagaagccaaagaagaauaugaccgcaucuauucuaaagcuacuguggugguuucucaugcuucagagucucguaagucuccugguuccuggugcucaggcccuggagaugggagucaaagggcgaucaggagcuggaguccaucagaggccccucccaccuccacaggaccccccuccccccaccggccuuccaaagaucgcucaaaaucccacccucuucugcugacuuccugggugggggagguaggcacacuuaccguguaaacaccaucugauuucugcagagacaaaagaagcaaaacauuaaagacccacacuuucuccagggccccucagcaucugccccacccagggaggcauggggggugggcagccagccaccuugggcuagagggcacucacauggacacucugggacauggauaccuguuugcccacauggcuacaagcacacauauacacccgacauacuacauccaagucucucacauauucuuuaucacucuaugcuugauucuucccugucaccugcugaauauuuuacuuguggcuuggcuagguaaggugggagggaggccucugagguguaugcagaucagcaccugagaggcaggcccucccagaggcccggaaacccaggcuagagccccaggagggcugagggucugaaaaguuguccacaccagguguaggaggguccauaccucauagcugguuauagcugccuuucgcacuuggaucuggaaugggggaaagguuaucaguaaaggguaaguuaauggcccaucccccuucccuccaaacuuuguggaggauccccuuuuauuccuucucuucgaauccuugcugcugcccuccucccacuuccccuuccagcccuuaccccacccugcccagcgcuaccuucagucgacaguagaggagggugaggacaauuccauacagaaacaggauggcauccaggauauagcagagcugaggcucucccagggccgcugaggggauagaggaugcccauggggucggggguaucagggaggaucugguacucagaggagagaagggaaggggcucugggagguaggacagggccuggaggggagccgucuaagggaagaaauucuguuucucucuggccuuccacugcccuuaccuuucccuccucccacaccauagggucaggcuaggauaggaagcuugaggguucuauugaaaugggacucacacggacuaauaauugaggccuucccccucagcccccaaccuuuucuuuuuagcacuguggguucuucaggcaccauugagcacuuuauccaccucaagggacccaucugaguccacuggacugaaaccaaaaccucagccaagauggguagugggagggagagguaguggcaaauuucagugaagaaaccacagaagugucucuacuaaguccugugaccuguggcugagggcuggacaggaaggaugugagcuggggaagggagagaaggcaauuacucuaucauuggucaucuccuagccucagccuuguugcuuucugucccaccacaagacacuuaaauauguaaaaaaaaaaaaaaaaaaaaaaagugugucuguuuuucccagaccuuacagauaccuuuggcccugaacacaaggcugggggaaugaccacagcuauauggauuccagcuccuguuacucugcccuauuacucacucucugggucucugagaggggaaguuuugugcaauuuaaaaaaucaaaucaagucugggcuccagagacugcucucaccccguaucagaggaccaguagggaacaugugacuaacgucagucaauugcugacaucggucaaguacuuuuuauucugcaacacucuuucacacacacgauauugcacaaaucuuaaaacuacccugugagggaaacaucaucaucgccauuuuaugggugacgaaaccaaggcucggaaaagcuaaguaacucacucagagccacagaguuaagugacagagcuggaacucaaaugcagguuuucugccucuaaagcccaugcuuuccuuugugccucagcgggccuccucccuccucaucccacggcagcagaccaguggcuaacuuaauacuugcucccaccuucucagcuaggcugcuggaauuccuccccagucauucucuuucaauuuccacaguuucccugaaguuuacugaccuccuccuccccaacacccagcugccaccaacacacacacaccaauccagcacagacaacacagagugaacgaggagugagaauucuuagauaguggcuggagcuguagagcuucagagaccuucccauuucugccucuauuucucagcugacgcucaggucucuggaacuggggaucucaugcugcccacccucauuaucaacugcugacagaauggagcauuaacaaugacccauagaaacagcaaucccgucuguuugucuuggcuauauccuugccuuacucccaagcacaagaacagaguccuaccuuccuaaaggguuaucucucucucucucucucucucuauauauauauauauauguguguguguguguguguguguguguguguguguauguguguguguguguauauagauagauagauagagauauauauguaaaaucuuuuuuuuuuuuuugagacggagucucacucugucccccaggcuagagugcaguggugcgaucuuggcucacugcaaccuccaccuccuggguucaagugauucuccugccucagccuucugaguagcuggaauuauaggcaccaagggugcuuuguauauuaaaccagcuagagaucagcucccagcagacaagaccaaaggcaccccaugggaaaugcucaucaugagaaaugaggcuuuucaccagaccagcucuucaugccauacaaccagacccuuccccugccacuuucuaucaacccugaaaagagaaaagucagccaggcacaguagcacuuugggaggccgaggugggagaauugcuugaggccaggaguucaagaccgauguggccaacauaguaagacccugucuuuuuuuaauaauaauaauagcugggugcaguggcucacaccaguaaucccagcacuuugggaggucgagguggguggaucacuugagucaggaguucaagacuacccuggucaacaugacgaaacccgguuucuaccaaaaauacuuaacuuagccgggcgugguggcgggcaccuguagucccagcuacucgggagccugaggcaggagaaucgcuugaacccaggaggcagagguugcagugaguagagauugcgccacugcacuccagccugggugacagagcaagacuccaucuccaaaauaauaauaauaauacggagaaaagucuggaaugaaguaagaaggcaacaagaaaggagggaacuaugagucuagugcccugggucggggcuggagaggacuagccucagggucucccuaugcccaccuacccacugucagccuuccuucaccuguguuugacuuggcccucagacccaagcucuggacuuccacccuggagccagcucacgcuaucccucaccaaacccucuuaccugcuuguucaaccaaaaggaguaagagcaagaccacugcuggaaucaucuugggcuggagaucggccguucugacagcacugugcagcugugcucagcgagcaguucccugaccacagagucccccucuuccugccacgccuucc

SEQ ID NO: 12955 - RNA, 16202 nt, Homo sapiens
uuuaggccuaggggccgcaagacggcuaauuuauuauaauuucuccuuuuuuaguacaugcacagaaagccugacagccaaguguacaugaacauacacacacacacacacacacacacacacacagaggccaauuuccagugaggaacaggcuccacagaagaagcugauaggcaggggggaucaaacgcugcuccccugcucaccgaucuacuucuccaaauacaauaucuuggguaccuaggugagaggauggaggaaaaaagugauguuacuuaucuuccuguugugaggcaaaacaaacaaaaaaagugguguuacccaagauccagaacccauuacugugcucaaaagauugaggacccgaguccaugccauggccuauggugaacaggaaguguucuccuucuguccccagugggcgucccgaacuccuuugucuaggauaccucuacuacacaauaggccucguaccuaugauggcaacgacaucugccaacaugugucccuuagacaucuuguccaaaccagccuagggagauugagauggcaacaauguuaguuaagacuugcaaggugggaggagaaagaagaguucauaaaaaccucaaccaaggucagguuuaauucauuggaguuauaguuacugggauugauucuuaccagaugggcaaaaccaggagccuugaucuugcaucgauaagggcggcugcugccaucagacaccagguacaccccaaacucucccuguucaaggaagaagguugggugucuguauuaacaugaagaguauuuuucucugccaacaaaaccucuauucauucuguuuucucucucauugaugaaugagcuauuuguuaaacaucuaucuuuagcuaccuacucuacauauggucuuuuccuuccccuccucuccuuaccuugggagccucaauggcaguauauguggcuccuggaggaacuugguagcccucaguauacaacuuaaagugaugaaucagugacuccauggaagucugaagagaggaaacagggagcaucaauaaaccauauccaaacucugucuccuaggccucccccagcacagaaaauaaucucuacccucagggagacuaaagccacaugucagucaguaagcagagaggauacagaauaaaacaggagagcuaugggagauuaagaaucucuuauauggccgggugcggugacucacgcuuguaauuccagcacuuugggaggcugaggugggcagaucaagaggucagguguucaagaccagccuggccaacagagugaaaccccgucucuacuaaaaauacaaaaauuagcugggcgugguggugggugccuguaaucccagcuacucgggagacuaaggcaggagaaucgcuugaacccaggagacagugguugcagagagccaagaucaugccacuguacuccagccuggugaaagagcgugacaccgucucaaaaaaaauaaaaaaauaaaaaaaacccgaaucucuuacuacacaguaaauucucuauuaaaagaaaacuggguugggugugguggcucacgcuuuguaaucccagcacuuugggaggccaaggaucaccugaggucaggaguucgagaccacccugaccaauauggugaaacccugucucuacugaauacaaaaaauuagcugggcguaguggcacacgccuguaaucucagcuacuugggaggcugaggcagaagaauugcuugaaccugggaggcggagguugcaguuagccgagauugcacuccagucugggcaauaagaguaaaacucugucucaaaaaaaaaagaaaaccaaaagauaggauuuaauccaaggauacuccuccccagccacuggccccuuuccaacaccccacacuuucccccucccugcagccaaccuucaucucugcucgcuuagguggagacacuuuggcaucaucaaccuugaucuccccaggaggcaucuuguuuagacacugugcgauaauucucagggacuggcgcaucuccuccacccggcacagguaccucaagaagaugagacagagcaagagaagaacagucagaggagcagguauggggcuaggaaggaugcccuuuggccaaccucaaaaggguuaggucaacucuccccacucuuuucuccaaguacagcaucucugcuuggcuuggccacccauauaaacccuguagucuuuuuuuuuuuuucugaaacaggguuucacagcucacugcagccucgaacucuggggcucaagugauccucccaucucggucuccaaaguagcuuggauuacaggcgugcaccaccacauccgaauauuuuuuguagagacgagguuucacuuugcugcccaggcugaucuccaacuccugagcucaagcgacugccugcuuuggucucccaaagugcuaggauuauaggcaugagccaccaaccccagcccccuguaaucguuugcuucuacucuugggugcuuccccaaacccucuccuuauuuucucagaacauggccuguaguauuuauuucuuuaauuaccuccuuaagcacuuuuuggaccacaggaugggugagagucaaauggacaaacaaaaauaacagcaguagcuaccagguucaaaaaauaaaacaaacaaaaauaaaaaaaacaauacacaguaacaaaucugacucagggugagaaaacaggaggagaauuuguuuuugguuuucguuuuuuguuuuuuugagacagagucucgcucugucgcccaggcuggaaugcaguggcuccaucucagcucacugcauccuucaccuccuagauucaagcaacucuccuuccucagccucccaaguagcuggacuuacaggcauguaccaccacacccagcuaauuuuuuguauuuuuaguagagaugggguuucaccauguuggccaggcuggucuugaauuccugaccucaagugauccacccaccuuggacucccaaaaugcugggauuacacacaugagccacugugccuggcccaggaggagaaucugaagcuuaggaucuacuagaaagaacacuggaucaggaggauucuagucucgaccacuccugaagaauaaucccagcuaaucccuaacuuuuaugccucagcuuucucagcuauaaaaugcagccaaagcuagcuccaucuaagacaaggauaauguaaagauaaaaagaaugccauaggccgggugugguggcucacgccuauaaucccaacaauuuuggaggccgaggcggguagaucaccugaggucaggagcuugagaccagccugaccaacauggagaaaucccgucucuacuaaaaauacauaaauuagcugagcgugguggcucaugccuguaaucccagcuacucaggaggcugaggcaggagaaucacuugaacccaggaggcggagguugcagugagccgagauugcaccauugcauuccaaccugggcaacaagagcaaaacuccgucucaaaaaagaaaaaaauaaguaagauuccauauaugugaaaguguuuugagagcaaccucgucuaacacacacaagagcucccacagacacugagaaguaggguaaagaaggaaguggcaaagagaagagugaggcaggggaaacuagcuggaauaucagccaagaaaggauuggggccuuaccuaucauagcaguccccucgagaaccaacaggaacaucaaacucaaccuggucguaaacaucauagggcugggucuuccgcaggucccacuggaugccugagccccgaagcaucacuccacuguggagagcauaaugggaauaagggccacucuccacaaacuaaguaaggaggcuccuucuuccuuagccucccuuguugauccuucacauucaggguaugacuaggaggaugccaacaagucuucaaagacaagauauuaggcuggaacucccccacucccacccccacuccuacggagagaaguuguauuccccucaccuaaaaccauaguuaagugcuucuucugcuguuacaaccccaaugucaauuguccgauuucgccagauccuauuguuggucagcaacuauugaucaagaaaacugguguguuaauacucuuccucacacucuucaaauaucucuguauuucucuagcccuucuugugggggagagauuuuucccauugacuccuagcuuaccuccuccaacucaucaagccgaagagagaaguucuuagaaaacugauaaaugucauccauaagcccaagggguagguccuagaagccaaacggaagugcuacugaauguggcauagccuucacuaaggagagcccucucagcacccccucccccagcgauacagguuuggaguuuccaucauccagcacugcccuccaguggccacagggaaaauaggccugggcuggacauuuggggaagccggggaccugcucaccuggugcacuccuccuggccggauauaagcagcaugcauucgggcuccagacacucgcucguagaacucaaacaucuucauagaacgugcugggaauuagugucaaagucccaggcccccagguccuaugauggccuacucccccacuuucugccuucuugugcccaaccaaccccucaugauauaguuucuacaaauauaacccaaguuaaacauaccuucccccucuaaauguucucccauguucucucucuucuuuuaaucuccugucuccuuuauaccuucucuacuuccugcacuuccuucccuauuccuauccuuuccucccacucuuaccuucucccuuucuucaaacagccagaagaaaggggucauggccccaagguccagggcauguguggucacagccaugaugugguucaacaaacgugugauuucuccaaacagcacugugaagacaaggagaagacaggauauaggagccaagcacugaggcggacagagaggucugggcagagccuggggucugaacacuaagcuuggguucaacggggaagugguggaaaaggcacuaugcuaugcucacagugggccacagaaaaaguuggggggacauaccucggauccacugugcccgaggaggaggccggauguuuagcaacuucuccacagcuagagaauaggccuguucguuacacaucauggacacauagucuagccggucaaaguauggaagggccugggaagagggaggaaugugggucacaucuaacaggcucaggagcccacagucuggcugccugaagccuugcucucagucggcaccagaaguuggugcuguauaagccuuucuagucucaggagccccaacaaggcagguaaaaauaucccaaaaaccaguaguauucuaguaaauguuuaaaaacuggcucuccaaagugagggaggacucugauuugucauguuugccaauuuccaugguaaaaauacucccacaauggccaauuuuaaguuaccaauaucauguaacugaaugcagcauugggaagaauaccacaccauuauacaguauuuccaccauacagacacauucaaagcaaauaccucaaaggcagagcauaguaaaaugugguaaaauaaugaagugaugagcuuugaauauuuaaucuuaccuuugcuuuuaauauaauguauuaaaucauaagcuuauauaaauuaauuucugacaauggcuauguucaacaacuggcucacaaaacuccugaaaauuuaacaacugcacucuugcaagcccguaugagcuagcuccaggauaccacugucaagaguccuuggccgggcacguggcucacgccuguaaucccaacacuuugggaggccgaggcggguagaucaccugaggucaggaguuugagaccagccugaccaacauggagaaaccccuucucuacuaaaaauacaaaauuagcagggcgugguggugcaugccuguaaucccagcuacuugggaggcugaggcaggaaaaucacuugaacccaggaagcagagguugcagugagacaagacuaugccacugcauucuagccuaggcaacaagagcaaaacuccaucucaaaaaauaauaaaaauuuaaaaaacugacauacuggucaggcgcgguggcucacaccuguaaucccagcacuuugggaggccaagucaggguggcucaugaggucaggaguuugagaccagccuggccaacauggugaaaccccaucucuacuaaaaauauagaaauuagcugggcgugguggugaguaccuguaaucccagcuauuugggaggcugaggaacgagacucgcuugaaccugggagguggaguuugcagugagccaagaucacacuauugcacuccagccugggcaacaagagugaaacuccgucucaaaaaaaaaaaaaaaaaaaaaaaaauuagccaggcaugguggugcgugccuauaauccuggcuacucugggggcugaaacagaauugcuuaaacucgggaggcagagguugcagugagccaagaucacgccacugcacuccagccugggcgacagagcgagacuccguagggaaaaaaacaaaacaaacaaaaaacuucagauacugaaggagaaaggcaaucagucuuaagaguaucugggaggguuuuuuuuuuuaaucuuuuuuuuuuuugagacacagucuugcucuguugcccaggcgcuggagugcaguagcaccaucuuggcucacugcaaccucugccucccagguucaagugauucuccuacaggcgcacaccaccacgucuggcuaauuuuuguauuuuuaguagagaugggguuucaccuuguuggccaggcuggucucaaacuccugaccucaaguaauccaccugcuucgaccucccaaagugcugggauuacaggcgugagcccggccagagugagguauuuaaggaagacagagcaucagguagaaaugguccuuccuccagaaugccaaaaagccaaguccuagcugucugcugaaccagcuucagcuuccaggaagaggguggagcuaagacgcuacuagcugggacagccuguucuuauucugaugucacugugacgggggcuaaugcuacagggguuaacccauagacuccaggaccagaaacugucaucgccgaggcucucuuggggaaucacauucuagucacuguucaccccgacacugggcuggaucuaaauccuaauccuaccauccuguuaucaggaccuuucuucaugacaguaagaaaaaaacuucagauuccuauuagagauccaacuccuucaaaucugaccuucaucauuuggguuauacaguucuccuaaaaauggcaaacugucauaaacccucucugaguugcugugacucauugaauguuuugaaaacaaacguagacagcuggaagauacaagaaucagcuguuaaacuuagcgagcuaaugucuuuucucuuucccugccccuagggacacuggcuuugacgcacuagucuaacguaagagcagggaaacugaggcacucaaguaauggcaaaggggccugccaaaaagucagccagagaaaagcugaguauagcuccagcuucaaagcacugcugcuaaauaaaccaaauccuaaugacucaagcauccccugccacuucccuccauccacccaaccaagaguaaucucaacggguuacuccucucaacaccuuccuccccucacguuuuaagggcagcaaacuggcaaagccccaggcuaaagcaaccccagaucccgccaaaaggcuccuguucaccccccacaccugaagauaggucuuguauucaaugagcuucucagugccucggugcaggagcccgaugugaggaucacacuuccgcaccaucuccccacucaauuccaucacuagucgcaggacaccaugcgcugcuggguguuggggcccaaaguucaggguaauguucuucacaauuguguccuuuggaggguccacaucugagaaguaagaaauaguucagagccacaugguuauucccuugggaucccccaaaagauagcaaggaguuagccucucccuauagauuuucuaacucaccauuccauacuuuguuaauuuccuaaucuccacuauaaccaggaagaggacucuuagauggggaaaaggaagaucuaaacuuucugaugacagacaucaugaaucucacucuaugucuccuagaauaccuuuuuuuuuuucaugguucauagucagugugcauagaauaucuuuuuaauaauacauaacacuuauauagcuuuauuaugugccaggcacuaccuuaggcacuuuaauugauuuaauucuuacaacaacuguuaugaguaauagguacuaucguuauccccauuucauuggauaaacugaggccauggagcuuaaaugacuuuuccaggaucauaaaacuaguaaguggcagaaccaggauuuuaacccagccuguuuagcuccaggauccaaacaucuuaacuacuaugauauacuguccuccaaauguauccaaugaauggccaaccagucaggaaaugguauaccuaaugcuuacucgcacuaaaugaacuuuuacccucaagaagauuaccuuuuuuuuuuuuuuuugagacagagucucacucugcacccaggcuggagugcagcagcaccaucucggcucacugcaaugucugccugccagguucaagcaauucuccugugucagccuccagaguagcugggacuacaggcgcacaccaccaugcccaccuaaucugaagcuuacauuuuaauuugcgaaagaaguacaugugaaaaacuaggaacagaggccaaauuuguaaguaaccaagaaagugccuuagccauuaaguuuuuaaaagaaggaaagaacacugcaaagacuucauguagguaggaucugagcucaaauauaggaaaugauuuagauagcuagaagggagaagaagcauuccaggcuaugaaaucaacaugggccaaaucuuagaaacaaggaaguaaacauccauggaacucuuauugggacuuccuaagagagggaugauuaguacugggacaaaguaggggguagugguucaauuaucuguacauaucauuaauaacaaugaacacuuauaggggacuuacaugugccaggcacauguuaucucauuuaauccuuaaaauaaugcuauaaauagacacuuuauucacugguaaauugagaguggagauuugaaaccagagcccaucuuuuccaccaaaauucuucaugaugggcuuuggagucugacagacccgaguacaaaucugccuguguguccuuaaccuuuuuuuuuuuuuugagacagucuugcucugucacccaggcuggagugcaauggcgugaucucgguucacugcaaccuccaccucccagguucaagcgauucuccugccucagccuccugaguagcuagaauuacaggugcgugccaccacgccuggcuaauuucuguauuuuuaguagaggcgggguuucaccauguuggccaggcuggucuugaacuccugaccuaaggugauccgcccaccucggccucccaaagugugagccaccgcauccgggcuuuaaucaaguuuuaaucuccuuagaccauaauuuccucacaacugggguaauacucucauagagcuguuguaaagauuaaacaaaauaaugcauacgaaaauguuuggcaaaugguaagcacucagcuauuguuacuguaaguuuguggaaaguaacuggaagugucuuugaagguuuuggagcaagaguaugaauaacaugguaaaauaauguuuggggaagaugaaggugaugacacuguauaggauagauggaaaggggacaacaucagcggcaaaaacucagugaauagacuccuaaaauaaucagggucuaauacaagauaaaucugaauaagaaugauggcaauaaaaauuaaaagggagagaugaccagauaugagacauuacgaaaguaucuacaugguuugguaacuuacuggacauagacauggagggcaagauaaaacagccaaagaugacuaaaaaguuucaauccugagggauuaggagaaugagggugccacugaucaaaaucaaaagucaaaaggaagagcuaguuuugauaggaaaaaaaaugguuuguauucauguagguuucauuugguuaccaacgggaaaaccaccaccuugucuggagagggagauaauguagugaaccugaaauauauugaacaugggaaaagcuggcauuaauauuuaaauugguagggacuuuuggguauuuacugggacccauucuuuauuuucuucugcaacauccuuccuuuccuucucuacuucacaaauaccuguuguuaucacuauuaugucuguugaauuucguggugaaagaagcaaacaggauaggggcuaaaauuugccuaagacagagagcucaagagcacuuagaaaucagcuggaggccaggcaugguggcucaagccuguaucucagcacuuucggaggcugaguugggaggauuaccugaggccaggaguuugaaaccagccuggucaacauagcaagacucugucucuacaaaaggaaaauuuucaaaauuagccaguugugguggcacaggccuguuguugcggcuuucuggggaggcugagacagaagguugccuugagcccagaaguucaaggcuacagugagccacuuucgcaccacugcacuccagccagggagacagagggaaacccugucucaaaaaaagaaaaggaaaucagcugggggcagggauggguguggguugggacagcaacucuggucacucaccauuccaagguggaggcuuccagugggcuguuucuuugcuuggguacauaacagcucccccaaacugcugugcccauuccacaucuggcugccacugccgaacaccucuggggagucaaagacagauccuagacaaagggccugaacaguguuugguuccuguguucccauucacucucaaggggacccaggaaggaugaccuguuuuuuuguuuuguuuuguuuuuuguuuuuuuugagacuggguuucacucuuguugcccauacuggagggcaauggugugauuucgacucacugaaaccuccgccucccggguucaagugauucuccugcuucagccucccaaguagcugagauuacaggcaugcgccaccaaacccggcuaauuuuguauuuuuuuaaagacggggguuucuccauuuuggucaggauggucucgaacucccgaccucagaugaucugcccgccuaggccucccaaagugcugggauuacaggugugagccaccgcgcccagccaauguccuggauuuuuuaaugccaagucacugaucugaaguuaauguagcuucggcaaaacaagcuggaacucuagagguuccauuccuacuaacaaauuauuccuggaauaacuccacccaucaccccugggcaugcaagguugggauccuagcuucuucauauuuucaucauauugauauuaucaaccaggugaauaugaacgugagaaaaguguuuguucaaggucaacgacagagagacagcgagcauucuggcucuuuggcugagcucuacucagguaugacaggagaggugcauucaaauuacugaagcuaaaaagcagagucucccacuccgcugauuucaccucggcacgaacgaacucuagacccucuccccucccucgccagagugggcgccacugcaucccguagcccaagaaaucagggauggacaauggggucacaggcuuggguuauuauuuucugggggaguaaagcguccccaaccugagaaacccuagccuuggagaaagugugucgagagcugcccucgaucucaccugcugggcugaaucggcaaucggacuccagccccaggccgcagcaccugggccgcgacgccccggaagccgcacaaagcccucagcgccgccaucuuacuccggcugcagacugcgggaaggagaaccgggcggaaguaacuccagcgcgccuccuucuuggcuucucaccuauucgcacagugaagccgcccucuuggaagcuggcagggucguuuaccgucgaacugacaacauccggguccugugacucggcuucacuugcguuuagauaacagugaccgcggucaucuuuacugagggcguuuccucccacagcuccuggcuggcuuuucuaggagcgagcaagggaaaauugccguuccugcguggggcagauacuucgugcucucucgccgagcccgccugcguaucuuggaaacgcgcggcgcuuccuucccuacucccuuccgccuuggccgcccucaugcuuuaguccugcucucggauuguaucugagcccugcccuuauaggguagccccaggcuuugccaauuacuuucccaucacugaauccaaaagacaggaguugggaaagccagcuaauuuccagaugucauaaauugagauuggagaaaggagccuaaguggggcugggcgggucugagagcucccgccaaaccaaaacaaaaaagaauaggaugccaaggccgccggcauugguggugcggaggggagugucgggguguguaggagccaccucaucccagaugggggaguggagguccucugugggugacccugacauccuccaggcuucccgaaccuacagaaucacagacccaggaagcgcccuuagagaugccucacaccccacuuccgucuugcgucagccucuuuucccuaacgucuuucugacccugcuauagcccuccuggguaauggccaacagcacggaaauguaguagcaccaggagucugaucacaauucuguauggacaaagauucuuccagccuuagaggcuaguuccuguuuucucccucugccucuaagcccaacuccagcugggccacccacccguagaguuuguacaacucuccaacucugagccuggaaagaggccuuccccagauauccccuagacaggaucccagggacacagcccaccagcagcgcagcagggugaggcagacagaccaggaagcagagaugguggaauucuucacugcagagaaagaggggaaagccagacuucuggccugggaauugaccuaaugggaacuguaccaaaggguggggccagauccuuagcugugggaacugaccaggaccugggcuagacaaggcagcugccacagagccagggcagagguuuggucccucuguuguccucauuccuugcucuuucccugggccuucuuucuauuguugaaacacagcaaauguggccaugguggugggggaugggaaggacugcauuuauuugccuugauccagccugggagaagucaggauagacuuugggcugcuuggcccuggaggcagcuugagcugggacugggguggggggcuccugaggggcugccuaggacacugcagcuuuugugccuucucccugcugccaacacccccacacacacugcugcagccacucuaaagcccuuugucuuucauugcuuagucacccccuuuguccucaucucaaauaggggaguggaaaggggcaguagaguucucuggugauagcuccucuugccccugccccuucuggucucccacccuuuguccgacuccucuagucccagccccguuggcuuagaaccagggucaggcaaguggugggucaagaggugggucuggcagucacaagggggugggugauccaggaagugauaggcaccagggcagguauuaccgaccugagcaggaagggagggggaaaggaaguauucugacggauaugauaugcgggggacaggaggugacaaagcagagugaauaggggaauagaggcaagaggaggugguccacuucugggaaaggaaagagacugcugacugcacucuccuuccuggggauuuccuggggaaacaagcagccagaggauggggugagcagaaauugccccuacuucugaacccuuccuugccuugagaguucauacccaagaccucuuuuccgaguucccuccuauccaaagccaaaggaauaauuugcuuccuuucccuaacaccaccucuuccuccccagccacuuuccccaccccaggcaauggauuucucccaguacccuaauuucccuauaugcacaaugcugucuccacccucucccugccccagggagaauuaaaaagaaaagaugacuagauauuccaggaaccacuggguucucagagcaaggugggguggauggugggagccagguggggauucucccagauugauacugggugaaucuggguuccugagagcaagucuugccuaugcugggggcuggcugacuugaggcugggggaggguuuagggcaguugggaguggguaggagcagggccaaaagccugggggaagcuacugggagcugggccagggaaauggggagucaggaaguggggagggggaacccuggggggaaauggaggcggaauggcuguucugggcuuuggaggggguggguagugguaacucaggaagggggauccugagggagagaagggacguuagaaaagaggaggugccacccuggauccgccuucuauaaaaggaaaagucguuaaccccuccugccuugucaucugccgccucuguuauguucauuccaagcaggaucauccuaccuuugggcagucaacucccugaucacugucuccuugccucccccaauguucugccuuuuuuacucuucccagcugcucaguucuauccugagccaugucaagcuaccucuuuuauuuguucuucccucuugaugccuccuuaccuguucccuacccucuuuucucaggcagcucacucaguccccucagcccuggaaaccagccacuagggccaaagggcagcaugagggagccuugagaaaagagaagccaugguagguuagacuauaagagcaggaauucucccaggaccgugauccuaucugugcaugccggccaggcccuuucccucacucucugccucuccuggggcucugucccaccaaaaagggaaagagacagcugagggcugauugugggguuugggaaaaggcuaugucaucagcuggcccagugccuauuauccauucggcugcuagagauuccccuccccugggcaagucccauuuuuuugggaagcgaugauacacccaucugagucccaccgacagagcucagcugaguggcuuagagaucagccaaucaaucgcagaggcucaccaugcuuaaaagagcuggcgcggagagaggcuggggagaacccacagggagacccacagacacauaugcacgagagagacagaggaggaaagagacagagacaaaggcacagcggaagaaggcagagacagggcaggcacagaagcggcccagacagaguccuacagagggagaggccagagaagcugcagaagacacaggcagggagagacaaagauccaggaaaggagggcucaggaggagaguuuggagaagccagaccccugggcaccucucccaagcccaaggacuaaguuuucuccauuuccuuuaacgguccucagcccuucugaaaacuuugccucugaccuuggcaggaguccaagcccccaggcuacagagaggagcuuuccaaagcuaggguguggaggacuuggugcccuagacggccucagucccucccagcugcaguaccagugccaugucccagacaggcucgcaucccgggaggggcuuggcagggcgcuggcuguggggagcccaacccugccuccugcuccccauugugccgcucuccuggcugguguggcugcuucugcuacugcuggccucucuccugcccucagcccggcuggccagcccccucccccgggaggaggagaucguguuuccagagaagcucaacggcagcguccugccuggcucgggcgccccugccaggcuguugugccgcuugcaggccuuuggggagacgcugcuacuagagcuggagcaggacuccggugugcaggucgaggggcugacagugcaguaccugggccaggcgccugagcugcuggguggagcagagccuggcaccuaccugacuggcaccaucaauggagauccggagucgguggcaucucugcacuggga

SEQ ID NO: 12956 - RNA, 12567 nt, Homo sapiens
cuggggagaacccacagggagacccacagacacauaugcacgagagagacagaggaggaaagagacagagacaaaggcacagcggaagaaggcagagacagggcaggcacagaagcggcccagacagaguccuacagagggagaggccagagaagcugcagaagacacaggcagggagagacaaagauccaggaaaggagggcucaggaggagaguuuggagaagccagaccccugggcaccucucccaagcccaaggacuaaguuuucuccauuuccuuuaacgguccucagcccuucugaaaacuuugccucugaccuuggcaggaguccaagcccccaggcuacagagaggagcuuuccaaagcuaggguguggaggacuuggugcccuagacggccucagucccucccagcugcaguaccagugccaugucccagacaggcucgcaucccgggaggggcuuggcagggcgcuggcuguggggagcccaacccugccuccugcuccccauugugccgcucuccuggcugguguggcugcuucugcuacugcuggccucucuccugcccucagcccggcuggccagcccccucccccgggaggaggagaucguguuuccagagaagcucaacggcagcguccugccuggcucgggcgccccugccaggcuguugugccgcuugcaggccuuuggggagacgcugcuacuagagcuggagcaggacuccggugugcaggucgaggggcugacagugcaguaccugggccaggcgccugagcugcuggguggagcagagccuggcaccuaccugacuggcaccaucaauggagauccggagucgguggcaucucugcacugggaugggggagcccuguuaggcguguuacaauaucggggggcugaacuccaccuccagccccuggagggaggcaccccuaacucugcugggggaccuggggcucacauccuacgccggaagaguccugccagcggucaaggucccaugugcaacgucaaggcuccucuuggaagccccagccccagaccccgaagagccaagguaggcaucucuggagucuguguccugcgguguccucccgccaugucuguccuacugaccccuauucacccucucuccacccacuuacacuucuggccguucugcuucccucccuucugccugccuuuccuuucuccaugagccuccuuucuugguaaggcucaggccucuccccuucacccuucuccuagccagacccaccgaggguucucagaggugggucacagacucugggcugggaauaacugcucccucuccccaccccaccccuuccuggccauggcaucuccuacugacacaguccccagcaguaaaggucuccuaacagccccuuggccuuggcucuuuucucugcuccaaauuugauuuucaucccccacucccagcuauaggagucagguuugaggcccuagggcuuggugucuggcuucugaugcugccuuuaaaaucacuguggcaaacugcaaacuagggcaggaguggcaagagagggaggguaucccauaccuccuucuggucaauccccuucacacacuguggccggacugcgaggcugccugaggcuccauccuuuccucccucccacuccuggucucccccuucuucccuucccuccucccuccucccucucuagcuuuaauccagaccagacgcucccuccacaaccgccacgcugagcucuggcccuggcccuagcugcugacugaaucguuccuccaaccacacagggcagacacguugcagcccagcccucuagcccuggucccauaggccccagccacacucaggccuggagaaccccaaagucccuccugacggcaguccaggcugcuuucaccucuggggcucccgcagcccugggauguggcguccccuucuccuccccuucuuagaaccagcugcugacuccucagaguuaccacaaaagcccugagauuuggcguugggggaagggcccaaccaagacccgccaggagucaggaaucccgugggguguguggggcccagcugacuaugcugaguuccagacccaggaagugagggauuggagaaucgaccgacccaugggucugagaggcuauuucaggaucuuccucucccuuuuucucuacagcgcuuugcuucacugaguagauuuguggagacacuggugguggcagaugacaagauggccgcauuccacggugcggggcuaaagcgcuaccugcuaacagugauggcagcagcagccaaggccuucaagcacccaagcauccgcaauccugucagcuugguggugacucggcuagugauccuggggucaggcgaggaggggccccaaguggggcccagugcugcccagacccugcgcagcuucugugccuggcagcggggccucaacaccccugaggacucggacccugaccacuuugacacagccauucuguuuacccgucaggugaggccccagucagcaccgcaggccaugcacugcacaauucuaagaagcgccacuacauagacuaugaugcaaaugauguuccuggaguugugugacauggugccuugccccagccacacugccauguguggcuaccuaggcccugacagugcuggguccucagugcccagguccccgggaaucuggaucucaacccaauggacccaggugucuuggcugucuaugcaccuucuaugaucccucuccacaggaccuguguggagucuccacuugcgacacgcuggguauggcugaugugggcaccgucugugacccggcucggagcugugccauuguggaggaugaugggcuccagucagccuucacugcugcucaugaacuggguaaaguagggguggaugagaaagguauuagggaggagaaggugggggaggggguagcaaguucaccacaguguuaaugggggucccaagguauucuucccccaggccuagguauagggcuauuacuccucucugcuccagguguagacauacauuuacauuuuucuauuaaauaaauuaguuggucgaaacuacugugaacuccucugugugugugugugugugugugugugugucuguguguguguauuuggagggggagucagagacaauggguggggucacaguugggaauguuggcuauaaggaaaaguggguagggagggacccugaguauauuuuggggaagaggagacagagaaagagacggggcuacauacugggagcccugagaguaccauaaaggaaaggacugggggcagggugagguggguaauggaucugaucauccacagcugcagccagauuuauuauggagucccucagggcauggggaagggacccucagauccuaucagggccuuugcucccacaggucaugucuucaacaugcuccaugacaacuccaagccaugcaucaguuugaaugggccuuugagcaccucucgccaugucauggccccugugauggcucauguggauccugaggagcccuggucccccugcagugcccgcuucaucacugacuuccuggacaauggcuaugguaagcagauggcacuuaccuuucccuggguagcacucaauuccuguccuccagggcacucucacuuccgcugcauucugcauggaccaaauugccucccccaagugugcuuccucugcagugugggaaggggugagaaaugcugcugucuuuguguaguucucacuuccucccagaauaaauagcauagcuagaggaggcgaauuuuggcucaguagaauuagaacugacuuucugagggccagaacuguccaccacuggaaugggcuggcuaugaaggaggugauuaccuugucacgcagugagguaugcaagaauagcaggaugacugccacuaggcagagauguugaugagaagcaaacucaaauauucuauaguugguuagaauaggcagaauugaguuccuauccuuacucuguuuuguuuuguuuuguuuuguuuuaaauacagauguggucucacuguguugccuaggcuggucucgaacuccuaggcucaagcaauccucccaccucagccuuccaaagugcugggauuacagacauuaagccaccaugccuggccucuuauucuguucuuuaagcagguguagaugugugacuguaaguuacuucaccucucuguguuuguaguugauaugucagauaaguauaauagcgguaccuaucucauagguauuugccaugauuaaauagugcuggucaagcauuuagccaaugcucaucucauaauaagcauccaauaaacuauagcugcccauuaaagccucuuacagggcuaggcacaguggcuuacaccuguaaucccaaugcuuugggaggcuaaggugggaggauugcuugagaccaggaguuugagauuagccuggacaacauagcaagaccuuaucacuacaaaaaauuccaaaaaauuagcuggacauggcacaugccuguaaucccagcuacucaggagcccaaggcaggaaguuugcuugagcccagaaguuugaggcuguagugagccaugaucaugccacuguacugcagccugagcgacagagcaagacucugucucaggaaaaaaaaaaaaaaguaaguaauuaaaauaaaaauuauaaauaacaaaaauuuaaauccucuuauaguccuaggauuguuuuucuaggcuccaucaggccccagggagccuaagcuuucugcuggcaauccugaaugcuccccucagcccguugcugacuuugugccccaacccccuucccagggcacugucucuuagacaaaccagaggcuccauugcaucugccugugacuuucccuggcaaggacuaugaugcugaccgccagugccagcugaccuucgggcccgacucacgccauuguccacagcugccgccgcccugugcugcccucuggugcucuggccaccucaauggccaugccaugugccagaccaaacacucgcccugggccgauggcacacccugcgggcccgcacaggccugcauggguggucgcugccuccacauggaccagcuccaggacuucaaugugagauccuagggcaggggugggguaaagggcccggggguguggggacuggccuuaagcccaggagagaguucacuuaugccccacuuccguucugugccuuugcagauuccacaggcugguggcugggguccuuggggaccauggggugacugcucucggaccugugggggugguguccaguucuccucccgagacugcacgaggccugucccccggaaugguggcaaguacugugagggccgccguacccgcuuccgcuccugcaacacugaggacugcccaacuggcucaggugaggaguaggggggaugggagcccuugggaggggacaguagagcaggaaggacugucccuugagugcaagaccaaggggguguugauuccccugcugcuguggggagugccuuuaaccucugggaauuguccuuggccgucugcagggaagagcagagcugugcugucuagaguucucagggguuggguggagggauguggggugaugugaggaaggaaggaggggcucugacuguuuuaccccuccagcccugaccuuccgcgaggagcagugugcugccuacaaccaccgcaccgaccucuucaagagcuucccagggcccauggacuggguuccucgcuacacaggcguggccccccaggaccagugcaaacucaccugccaggcccaggcacugggcuacuacuaugugcuggagccacgggugagggucaggacacccccaggcccugucuauggucacacacacccgcagugcucccucugcuuucugauaacaaagaucacccaaaguaacccuguuccuacagccacgccagcccaguccaggauuccacucagacuuaucuguacauggguaucaggaaaacgagccccagacuccagauauguggccaauaggucccucuagccuauccuauuucccgugguuucuuuuccucugacuccccaucuucuaaugcugcauuuggugagaaucgaauguguggccuuugggacaaguccuucaccccucuuccaugggcuccucugucaaauuauaguggugguuucauucagcuccuggacagccagucccucaauggacaggccuccuggagaugacugaagucccuacacucccucucugugauagggugguggguugaaggcugcacaaagaaaaacaagccccagcagcauuuugcucccuucgccccaaccugagaauuucuacaggcuggcugcccucuagcguccauuuagggacagugccaucaagguuuagggcuuggugcugggaccagacagacugcacuucccaucuuggcuccucugcuugccauuuguguggcuuuuggacagguucuuuagcuuuucuaaaccucaacguuccaucccuaaaaaccucaaauagugguggugagauuuacauuuguguuuauaaaacacuuagcaugcugccugauucauacucagugcucugaaaaugcuggcuagauguuauaugugauaauaauuauuauuguuaugauuaucacccacaugguggccggcacucacccaucuacauccccuacuucauccaacuuuuccgacaacauugcuucccugaugggacaugggucucguuugauuuaccaaccccuuuugacuuaggaggaaccuucagcauuguucuuucucuuuuccucaggugguagaugggacccccuguuccccggacagcuccucggucuguguccagggccgaugcauccaugcuggcugugaucgcaucauuggcuccaagaagaaguuugacaagugcauggugugcggaggggacgguucugguugcagcaagcagucaggcuccuucaggaaauucagguucuuucaccaucauuccucccucuaccuuccuggacauucuggguccuagugaugcagaggggaacucagcacuguuuccacucucaaagagcucacagucuagcgggagauagacgaguaggcagcuacagugcgguuucccauguauucauccgaaguuggaacaggguguugugagugcccuugugggcaucagggaaggcuuccuuggaggugaccucugagcugagucucagaaggaggguaggaauuagacagguaccaaggaaguggggcuuggaagggcaacucaauaagggggcaguggguguaaagguccagagauaagaggcaguagggcacaugugcauguagcucugauccagaccgaacagcucacauaggauugggugacagccaucuacacacauguacacacauacagucacauaagcacagcucagaaggcugaggggauucaggugauccugagcuccccaucuacuccuuccacacagguacggauacaacaauguggucacuauccccgcgggggccacccacauucuuguccggcagcagggaaacccuggccaccggagcaucuacuuggcccugaagcugccagauggcuccuaugcccucaauggugaauacacgcugaugcccucccccacagaugugguacugccuggggcagucagcuugcgcuacagcggggccacugcagccucagagacacugucaggccaugggccacuggcccagccuuugacacugcaaguccuaguggcuggcaacccccaggacacacgccuccgauacagcuucuucgugccccggccgaccccuucaacgccacgccccacuccccaggacuggcugcaccgaagagcacagauucuggagauccuucggcggcgccccugggcgggcaggaaauaaccucacuaucccggcugcccuuucugggcaccggggccucggacuuagcugggagaaagagagagcuucuguugcugccucaugcuaagacucaguggggaggggcugugggcgugagaccugccccuccucucugcccuaaugcgcaggcuggcccugcccugguuuccugcccugggaggcagugauggguuaguggauggaaggggcugacagacagcccuccaucuaaacugcccccucugcccugcgggucacaggagggagggggaaggcagggagggccugggccccaguuguauuuauuuaguauuuauucacuuuuauuuagcaccagggaaggggacaaggacuaggguccuggggaaccugaccccugaccccucauagcccucacccuggggcuaggaaauccagggugguggugauagguauaagugguguguguaugcgugugugugugugugaaaaugugugugugcuuauguaugagguacaaccuguucugcuuuccucuuccugaauuuuauuuuuugggaaaagaaaagucaaggguagggugggccuucagggagugagggauuaucuuuuuuuuuuuuucuuucuuucuuucuuuuuuuuuuuugagacagaaucucgcucugucgcccaggcuggagugcaauggcacaaucucggcucacugcauccuccgccucccggguucaagugauucucaugccucagccuccugaguagcugggauuacaggcuccugccaccacgcccggcuaauuuuuguuuuguuuuguuuggagacagagucucgcuauugucaccagggcuggaaugauuucagcucacugcaaccuucgccaccuggguuccagcaauucuccugccucagccucccgaguagcugagauuauaggcaccuaccaccacgcccggcuaauuuuuguauuuuuaguagagacgggguuucaccauguuggccaggcuggucucgaacuccugaccuuaggugauccacucgccuucaucucccaaagugcugggauuacaggcgugagccaccgugccuggccacgcccaacuaauuuuuguauuuuuaguagagacaggguuucaccauguuggccaggcugcucuugaacuccugaccucagguaaucgaccugccucggccucccaaagugcugggauuacaggugugagccaccacgcccgguacauauuuuuuaaauugaauucuacuauuuaugugauccuuuuggagucagacagaugugguugcauccuaacuccaugucucugagcauuagauuucucauuugccaauaauaauaccucccuuagaaguuuguugugaggauuaaauaauguaaauaaagaacuagcauaacacucagcaucuaguaagugcucaacaaauagcagcugcuguuacuuacuguuaucaaauuucuguccacauccacucuccauaugcacuugaagguggcaaagauccacaaccauggugccugccuuuauccucaggguccguuccuuugguuggcagaccccuauccuggguucugagggaccaacagagaaaggaaaauuccaucccucaccucuggaaguucccaaucacaggaaggaaacauaguaagcacguggcuacaaauacaauugacaagaacaugaaggugcaggauaacaagaacaaauaacaagaacaacugcaucaacacaaaugagugcuuaguaauaagggugauaguugaggggucuggguuucacaacaguagaaagagcacuggagugggagccagcgggucuggauucaauuuggggcucggcgucuuauuagcugggugguguuggguaagucacugaugcugagccuuagauugcucauaugggacuaacaguaucuacucccacagaguuguucugggaacaaaugcuagaauauuuucaaaauaguaaagguuauagucauggccaugugagagguuaccccuaugacuaccugaagauggaacggagucuccagaaucugccaguguaaacccagcagaaugccuagaagaugugagauuagaauaaaauuucauaaaacaaaaacaaucgggcacgguggcucaugccuguaaucccagcacuuugggaggccgaaaugggcggaucacgaggucaggagauugagaccgaccauccuggcuaccacagugaaaccccgugucuacuaaaaauacaaaauauauauauauauauauauauauauuagccgggcauggugacaggugccuauagucccagcuacuugggagacugaggcaggagaaugacuugcacccgggaggcagagcuuacagugagucgagauugcgccacugcacuccagccugggagacagagugagacucgucucgauacaaaaacaaaaacaaaaacaggauaugguuuggcaggaaauaggcaagaaggcaaaaagaauaaccuggaaaaggaucugagguaagggagccaggugccucaaaauggcagaauaccugaugccugaggagagggagggaauaaaacaucugcauuuuccccucugggcaaggcgccuuugcuugagaaagaauuuugggcuggaugagaugguucacaccuguaaucccaguacuuuggcaggaggauugcuugaggccaggagguugggaccaaccugggcaacauagaaagauuccaucucuaccaaaaaaaaaaaagauugaaaaauuagccgggcgugguggcaccuguagucccagcuacuugggaggcuaaaauaggaggacugcuugagcccacgauuucgaggcuauggugagcuacaaucaugccacuauacuccagccugggugagagaccaaaacaccaacucaaaaaaaaaaaaaaaaaaaaaaaaagggccaggcaugguggcucacaccuguaaucucagcacuuugggaggcugagguucaaaaccagccaggccaacauggugaaaccccaucucuacuaaaaaaaaaauacaaaaaauuagccaggugugguggcaagcgccuauagucccagcuacucaugaggcugaggcaggaggaucgcuugaaccugggagguggagguugcagugagccgaaauugcgccauugcacuccagucugggcgauagagugagacuccaucucaaaaaaaaaaaaaaaaaaaaaaagaacuugggcaguccucuaugugucauggauggaacagggaugggcaagggugguagguagacccugcaagaauuuggaguuuugagaggcagacgcaggacugcuagggauuggggaagguacuggaugugggguugugggagaaacuauagguaaagaagacccugagguugagguggaagagugaagaaugggggaaccaaaggcacuucacucugccauagcagccccuagcugggaugccaaauacugcuuggaaugugaagcugggacuaugggguugaggcaggccauggagguuguagugguuauaugugcuaugcuuacuggaucugggcuuugcuaaucaaguucuguaccaggcagugccuuauacagcacccuguacucuacaccagccagcacagcgccugcuuccucugcagcaaugagaaaagacugcccacacucucuucucuccaguaaacacgguucucccugcuaggcuuggcccccuggcccuuccugugguccuccuacuaaccaggcugaagaagauggagacaagacaauagugaucuuuacucguuucaucuaguuugcaaaaugagaccacagauaguauguuuauggaccuugauacuaugaguugaugguacaaugagcagaguucugugauaaguagauguaagguacaaauacaaacaauauauacgacuguccuaaagggguucacacugcauucugggcaggggagguuguauacugcucccacuccaccuuccccgcaaacagaagcaaugggacaguaaaagggacuagaagauaagagccuaaugagcccugaacugaauggacuaugaggguuauggagggcuaccuugggcugggcccuggagaacaggucaucaugauagcccuucucacuuuccuuuaauguucauggagauacacuuuuuuuuuugagauagggucucccuuuguugaccaggcaggaguacaguggugugaucuuggcucacugcagccuugaacucucaggcucaagcaacccucccaccucaaccuccugaguaccuaggacuacaggcacgagcuaccacacccagcuaauuuacuuuuuuuuuugguugagacgaggucuuaucauauugcccaggcuggucuugaacuccuggccucaagggaucuucccaccucgaucucccaaaguguugggaugaccagugugaaccaccaugccuggccuuuucuuuugagacagucucgcucuguggcucagguuggagugcaguggcaccaucauaacuuacuacagccuugaacuccugggcucgaguaauccucccaccucagccuccuaaguagcuuggacuacagguguagauucacuuuuaaaucacuuuucugccuguuauuuuaagagaaagcccuucgcucaccaaguaggguucucacuggcauaaguaaguuu

SEQ ID NO: 12957 - RNA, 6208 nt, Homo sapiens
agaccccgcccccgcagcgcccgcuuccaagauggcggcagcgaugccugcccggcuguugggguggcggugacgacaggcagcaaaagaccagguaugugcgcugggaaugcgucgacacggaggccugggauaaagguuugggcauucgagagagugagaaguuuuggguaacgccuggagacgagccugagcagggacgggguccuagguggaaguauggacgggggccgggcgggcucacguugcuaguagguagggcaaaagcaagagacugggauaggaugggcgugcuccgaaagagcuggguuuuaacccccuccacagcgcggaccacgccccucuaggugagcccuuccagccaccccugacugucucugccccugcucucccucucccuuucucuucagcaguaacccuccuccccacccccgcuagaagaggggaaagguagaaaagguagaggacgccacccccacccuacucuccgccgagcuccggggcuguucgcuuacagcccccagguggucacggucccugcaccugaggaguuggcacccaggcacaugaagaauagaaggagccuguuuccuacuucgcccuggguacuccuuaggccacuccacgguccugucaugacucugucgccacuucaacugguucuuggucugggggaaaacaauguuuccauuagcuguccuguccccacuccccaaucuguccuguugggguggggguacgggggugguuaaguaugaaccugacacuuaucauuccaggguagcacgggagauaggcgagggaccuaccaucuccugcuccuccucuuccuuuccaaccacuuuccuucacuucgccugcugggaaaccagcuucacccugauccugaucucuggcggugcagguagcuaguuauccuuuaccacuucuguuccagcuggucccagauucgcugcuggagugcuggauggagccuuucucugcccucugugacauuuccaauuuuagauaaugccucacaucucuguccccccgggacccccuggagcccccaugaucccuaagaagacagcuugaaccuaggugagucuaucucuucccuucuaaaauuggaagaggggguucucuagagacuuucugaaaugaacaugagauuugaaugauguaaacauuuuugggggugaggacugacaguagauggugggagugguuuggggggagguagaggagagcgaaacuugggcugaagugacaggugguaggguuacuggugguuacauucuguuuccuugcgugacugugcaccugugugcucccuucugugacuuuguuuucugcuuuuuccucuuuaccccuggcaucaccuucaacccuaccuacugaccucucugcuggcuugcucucuuccugccuacccccagaauuccccucucccucccuagaucucacccccaggauguugcggaggcugcuggagcggccuugcacgcuggcccugcuugugggcucccagcuggcugucaugauguaccugucacuggggggcuuccgaagucucagugcccuauuuggccgagaucagggaccgacauuugacuauucucacccucgugaugucuacaguaaccucagucaccugccuggggccccaggggguccuccagcuccucaaggucugcccuacuguccagaacgaucuccucucuuagguaagugcaggaggaaggagguggugaaaggaaggacaaggugcggagacagggaggcuuggggauagggaggcauggaguggcagaaguggaacuuagaagaggauagguaggcugaggcugcagguaggcugagguugagauagagggcugagguugagauagaguagacucugaauugggaguuuagauuagacuauuggguuuccacuuucuacugcuugucccuuuaugggcucuuccugccccaggcuaggaauuguuuuccuuguagaugagcccugguuuaauuaguugcaagucucuccagccuucaacuauagcuuccaacccuguaagacaggagaaaguuaggcaacccuaaaauaagaagagaaggcuagguaaggauccugcaccuuccagccuuuguagagcugucccagugauagguaauccaaggcaugcgagauuucugagugagcccugagaacuaagccccagaaccagacugccagugucagagguauucccaaacccuaguuugauucuuuucucuuugccccucugaucccucuacuugccauuccuucccaacaguggguccugugucgguguccuuuagcccagugccaucacuggcagagauuguggagcggaauccccggguagaaccagggggccgguaccgcccugcagguugugagccccgcucccgaacagccaucauugugccucaucgugcccgggagcaccaccugcgccugcugcucuaccaccugcaccccuucuugcagcgccagcagcuugcuuauggcaucuaugucauccaccagguacccccaaucuccaccucauuuugacugacuuucuucuaaggaagccucaagcacaugccacuucacuuucaucuaaaugggucccuagaauaauuuuaagaaggccagacuguuagaguguggagaagcacccggcacugcucuuccaacuuuguuagucccauacuuuuccuuaaucugcuuagguuauucccacuguccuacacucuccugugauuuuuucuuuauugaauggcuugugcagaguuggaauuggacacaauagggcuaaaauucuaguuccgucacuuguuacauguaugacucugagcaagauacuuaaacaucuaacaugaggaaagagcauaagauaacuaauauaccaucuguuccacaccacaccauuguugguugccaauugucaggauuaaauguuagacagcagcaucuuaaguaucagguccauaccaauacacaagcaagauuugucaaaugacuaaguggaaaaaugaaaaagauagucuuucuuuuucauucuccuugcccuccaccccacuuugauuucccucuuuucacuuuuauucuuuuuuuucuuuuuuuuuuuuuuugagaucucacucugucccccaggcuggagugcaguggcacgaucucggcugacugcaagcuccaccucccggguuuuacgccauucuccugccucagccuccugaguagcugggacuacaggcguguaccaccaugcccagcuaauuuuuuguauuuuuaguagagaugggguuuuaccguguuagccaggguggucucaaucuccugaccuugugaucugccugccuuggccucccaaaguacugggauuacaggcguaagccaccgcgcccggccuucacuuuuauucuuuagcccccuuuucuccgugccaccuacagacauagucugguuccccuccauuaucuuccaggcuggaaauggaacauuuaacagggcaaaacuguugaacguuggggugcgagaggcccugcgugaugaagagugggacugccuguucuugcacgauguggaccucuugccagaaaaugaccacaaucuguaugugugugacccccggggaccccgccauguugccguugcuaugaacaaguuuggauacagguagagggcauggaaggguacugggaaacagggaagccuacuauccuguggaaggaggagagccaagcggauugugguuggggauguguccccagaagacucgggguaugcaaggaucuuucucucccuagccucccguacccccaguacuucggaggagucucagcacuuacuccugaccaguaccugaagaugaauggcuuccccaaugaauacuggggcugggguggugaggaugacgacauugcuaccaggucagacuuccugccacuuccucccuccugaccccagucuggaucccuguccucuaagaccaccuuugaccauagcccuucaacacuaaccuuuagcucccugguccugcacugagcccauuccuuucccuuagucuuuuuaggauacccaggucaggcuugcaugcuacugcccauugugucauccuucagucuccugguuaguuuguucuugggagaggacauaagaucaauaggaaauaguaucgucggauuccagaacuggaaaggggcccagagacagcuuagucuugccuucugcugggguuccagccaggccacuuccuaugggguuaggagagaggggcucugcuccauguucccagaaucgcuuuguaaaaggccugugccauuggcacagggccaacucauuuuuagcaugugaaacauucugaccuucagccucagcugacccaauuucaugucugugguaugaauauuugggcuugguaugcaggaccaauugccuccauucccccuguguccucugugaugacaucucugugaauucucauccucuguaugugugugaaauacccagugaauuguaaauauacauaaguauucuucuaguuccuucccaggccaucugcacuccaugcuucugugugucagaaguggaguuuguuucuuuuaagguccugauuaccugguucuacccuuuucuuuucuuucuuucguuuuuuuuuuuuuucuuuuucucuagagacaaggucccauuauuuucccaggcuggucuugaacuccuggccucaagugauccuucugccuuggcauccaaaagugcuaggauugcaggugugagccacugcaccuggccuaccuuuuucuuaacaugggggaugugggagagaagcugggguagcucagucacuauucuaagauucucagcaacucccagucuucucuuauucuuuugacagaauggccucucucugcguccuuccuagacugcaagggcagcuccuaggagcccuuuaggaagccaagggaauagguugccaacuguuuaaaggcccuagggugacuggcacugggcccugaggauuuggauacauccagcuuuuauauucucuucagccauuuccuucuuucuguuugacuucuguccugggcuuuuuuuuucuuuugccuacuaaguaauaguuguuuuuuuguguguacagaaacauuuaaucccuuccuugcuuuucucuacucuggaucccccaugauacccucacuuuucccauagggugcgccuggcugggaugaagaucucucggccccccacaucuguaggacacuauaagauggugaagcaccgaggagauaagggcaaugaggaaaauccccacagguaggaagaaggaaggacugccugggaauuguuacuggauccucaggguucuguaccccuagccaggaaaauccuaaaggucccuagauuucuggcuguuccuuucugggucuuagucuccaaccucuaacccucagauuugaccuccugguccguacccagaauuccuggacgcaagaugggaugaacucacugacauaccaguugcuggcucgagagcuggggccucuuuauaccaacaucacagcagacauugggacugacccucgggguccucgggcuccuucugggccacguuacccaccugguuccucccaagccuuccgucaagagaugcugcaacgccggcccccagccaggccugggccucuaucuacugccaaccacacagcccuccgagguucacacugacuccuccuuccugucuaccuuaaucaugaaaccgaauucaugggguuguauucuccccacccucagcuccucacuguucucagagggaugugagggaacugaacucuggugccgugcuaggggguaggggccucucccucacugcuggacuggagcugggcuccuguagaccugaggggucccucucucuagggucuccuguagggcuuaugacugugaauccuugaugucaugauuuuaugugacgauuccuaggagucccugccccuagaguaggagcagggcuggaccccaagccccucccucuuccauggagagaagagugaucuggcuucuccucggaccucugugaauauuuauucuauuuaugguucccgggaaguuguuuggugaaggaagccccucccugggcauuuucugccuaugcuggaauagcucccucuucugguccuggcucagggggcugggauuuugauauauuuucuaauaaaggacuuugucucgcau

SEQ ID NO: 12958 - RNA, 5840 nt, Homo sapiens
agguaggaagaaggaaggacugccugggaauuguuacuggauccucaggguucuguaccccuagccaggaaaauccuaaaggucccuagauuucuggcuguuccuuucugggucuuagucuccaaccucuaacccucagauuugaccuccugguccguacccagaauuccuggacgcaagaugggaugaacucacugacauaccaguugcuggcucgagagcuggggccucuuuauaccaacaucacagcagacauugggacugacccucgggguccucgggcuccuucugggccacguuacccaccugguuccucccaagccuuccgucaagagaugcugcaacgccggcccccagccaggccugggccucuaucuacugccaaccacacagcccuccgagguucacacugacuccuccuuccugucuaccuuaaucaugaaaccgaauucaugggguuguauucuccccacccucagcuccucacuguucucagagggaugugagggaacugaacucuggugccgugcuaggggguaggggccucucccucacugcuggacuggagcugggcuccuguagaccugaggggucccucucucuagggucuccuguagggcuuaugacugugaauccuugaugucaugauuuuaugugacgauuccuaggagucccugccccuagaguaggagcagggcuggaccccaagccccucccucuuccauggagagaagagugaucuggcuucuccucggaccucugugaauauuuauucuauuuaugguucccgggaaguuguuuggugaaggaagccccucccugggcauuuucugccuaugcuggaauagcucccucuucugguccuggcucagggggcugggauuuugauauauuuucuaauaaaggacuuugucucgcaucugcuccugcuuucugcaucccaggcacacuuugccucuuugcugccccgcauucuuaugccuauaggugauagaacagccagaccaagccaagcuccagcaauuuuuauuuucaugaaugagaguuggggaucagcuguuagguucugugcccaggacacugacugcugccuggcgcccacucucuauacagucauuaacagcaacucccucauaggaggcuccagccagagucaggggcaaccugugagcagucaggaauugccuagcugacucuggaaggaaaggaugaaaggaauguuuuagcugggggucugauguccuuggcccuccucagcccagcuguuuucccaacuuaccuaguuuuugccagugaccuaguguauacuggggaaugcaguucugagaagagaggagaggaugcagggaaaaguuuauuauugauguccuaggccuuggcugacauacagugacaaauguuccagucucugucuucaaggccuucaguggagagcugagggaaguuuaucccaacuuaccuuguguagauggaccaagcaguggcucggcaucuccuucaguccuaauuguguagcagcugcuuccugggcccgcuguugaaacagcuccugagauaagacacagccacuagccuccagugucuguaaccaggaaccucccagcaucaccuaaggagggaauauagcacugaucagucuggccuugccuacaauggagcacagaggagcccucuggaaaugccacuaggcaaaguuuccuccuccucacagucacucugaggccaggggggcucccguccugcucagggaaagcaacugagucauacacgauucccaggacuccuggaucuucugaagauggcaccaaauguccaaaucccuggagagaaggacauucaugcgucagaaggaaagggcucuagcugaggcugucucuccuucccauuuuuuugggggggugggggggacagagucucacucugucacccaggcuggaguguaauggcgagaucucagcucacugcaaccuccaccuccuggguucaagcgauucuccugccuuagccucccgaguagcugagauuacaggugcaagccaccacaccuggcuaauuuuuguauuuuucguagagaugggguuucaccauguuggccaggcuggucucgaacuccugaccuuguuaucugcccaccucggccucccaaaaugcugggauuacaggugugagccaccaugcccagccucuccgucccuuuaucauaccuggacaggcagaugggcuccuugguacugcagauucaccacagcuacagacacugcagugauggcacucagggcacgagccagaggggcagccucagcagggagcagcucacugagcacuagagaucaggcagaggccugacucagaaggcauucccauuacaguugucaguccucuuugggauuagacucccauagagaugaccaguucaggggcauggugugguccugcugacccaggaagguauagcuuuugcuucucacugguagggguuggggaaggggaagguggcuauuccauuaccugaagcuggaauggcacuaauaacguggucagccuccagacugcugucccuuagagauaccugagagcaugaaaacauuugagagacccagaaaaugagaauuugaugagugaaaagagacuucuggugccucacucucaguuucccaggcacccauguggccggggagacuguguacugacccaggaugaagagauugggugacuauguagacuucacaaaaaaucauuccucuguguacuccaggaaguggaccagacaggccaguguggcuguucugaaauguucagugaagcuggguucuuuccccuaucucuaagccacuuauaaguacuacuucuauccacagacuugcauaggcucuuugaggaagguucacaaauagggccuaggauucugggguagcccaugucuaaguagcuucuaaggcacaaaaacaaugaggaacuccaguccuaucggcccuggccuaguuaagccacuuggauaaagauggaaacacugacagguucauuacacuccagggguuccccuaccuuccagcgcccuucugccuggaggcugagcccacagaccggcuggccucugagaacacugaccccccuacuagucagguggguuucaagggccugaggcaacaucucuagaccuccacgaagugaccacuggcuccagcgcucagccaaggccuggcgaaugagugcugagucuggcugugggguccgcccugcagaggaagcaaagaagaaucauugaggcuggaugcaguggcucacaccuguaaucccagcacuuuaggaggccgaggcggguggaucacuugaggucaggaguuugagaccagccuggccaacauagugaaacugcaucucuacaaaaaaauacaaagauuagcugggagugguggcacauguuuguaaucccagcuacuuaagaggcugaggcaggagaauugcuugaaucugggaggcggagguugcagcgagccgaucugagauugcaccacugcacuccagccuaggcagcagagcaagacuccgucucaaaaaagaaaaaaagaaucauugaauagcaccccuuguccccacucccucacuuuggcaguacuuaauauuuucacccucugaaucaauccccccucaccugcccccagcagcaggcccaguaauauggaacgauggguuugcucagcuuggaagagacugggaaagcaggaccugaugcugagcucacggcuguugccugcaaacacuccacggcagagacuguccauggcuagagacgccaccuuaagggugagacuaggacuaaggagcgaaaaaauaaucuacacugacugauuuccacagccccuauuugguagggaaugagggugggauaggguuuggguugggggacauucccacugugacggauggaaaugaaggccuucacucccaauaaugaguuuugggaauuaugagggggugggguaugaagagaagagggcauccccaaaugauacagaagagccccuaggugguagauuugaacagggagcucugcagcugguuuaggagggaagagguuuggggccucugggcaagugucaccucagguccaaggcggcgcugggcaaaacugugcacagucucaucaggcucuuugccccggggcuuggucagcucccucagcccagcccaaaacagagguuuggagaaggggggugaagggcggaguagcccccugcauggagaaaggcauagugagggggaagcuccugacauaccuccccagcuccaggcgcuggggucauuuccacucauuuggcuuccuuuugcugggaaggcugacagggagaugaagaaauggaaggcaggucgggcgugguggcucacgccuguaaucccagcacuuuggcaggccgaggcgggcggaucacaaggucaggaguucaagaccagccuggccaauauggugaaaccccaucucuacuaaaaauacaaaaacuagccagacguggugguaggcaccuguagucccagcuacucgggaggcugaggcaggagaaucgcuugaacccgaaaggcggaaguugcagugagccaagaucgcgccauugcacuccauccugggcgagagcgauacuccgucucaaaaaaaaaaaaaaaaaaaaaaaaaaagaaaagaagaaagaaauggaaggcauaugaggaugagggcacaguaaaaggagcggaggugcugguguuaccugaggccaguggguagggcaugcagggcaccgcccacguagaggaaccuguucugggcagcuggguggucuccccggacaggcagcacuucugaauccaagccaagcucagaaaccugcucuccacaugcccucagaagaggagaaacuaagggaagaucugacccaccaaacauacuuccuccccuaaacucuauuccccaauggaagcccccuccacaaccucuccuagacaucccacaagccucucaccaggagcaagguccgggccccuagggcucccgcuggccuaauuccccgagguccaagcucaaagauagcaccauuagggccucgaacggagcgaauccagccucccagacgcucacugcucuccacuaggaccaccuggcgacaagagggagagacacugcagcaccgccuguagccgccggcgagaggucaggaggggaggggaagaggcauauucagagggccaggauccaucuagcuuuugauggaaaugggaagagcauuaaaugaagcucccucuggcacaaguggagcacucaccuuaggggggcagggggcccggcucaggugguaacuggcggccaagccgcugaugccuccgcccagcacgaccacgguccggcccaugcggaaaccugggggaaagggggcgauauggacaggcagaccggggacaaccugcgcuccagaagccccgccgguuuugaguucuaucccggccacucacugcuuuaggggaaacuaagugugcacggaugggcugguggaacagcgagguccccguccaggggccaggacucacccacaauagguagggaugagagaaaaugagggagaaggagaucgagguccuaagaccguaccccgccggcgcucugcugggugcagauaagggccacacccucgcuaucggcccucgcagggcucgggcggcgggcaguacgccugaguucugaggugcucugcuugccacaccucuguaggccaacaagugcuucaaauccgcuacucccacccccagccuuuucggucucuccuacgcuccguccacucuguucucgcggcacgcgccuaacccuaccucuc

SEQ ID NO: 12959 - RNA, 5840 nt, Homo sapiens
gagagguaggguuaggcgcgugccgcgagaacagaguggacggagcguaggagagaccgaaaaggcugggggugggaguagcggauuugaagcacuuguuggccuacagagguguggcaagcagagcaccucagaacucaggcguacugcccgccgcccgagcccugcgagggccgauagcgaggguguggcccuuaucugcacccagcagagcgccggcgggguacggucuuaggaccucgaucuccuucucccucauuuucucucaucccuaccuauugugggugaguccuggccccuggacggggaccucgcuguuccaccagcccauccgugcacacuuaguuuccccuaaagcagugaguggccgggauagaacucaaaaccggcggggcuucuggagcgcagguuguccccggucugccuguccauaucgcccccuuucccccagguuuccgcaugggccggaccguggucgugcugggcggaggcaucagcggcuuggccgccaguuaccaccugagccgggcccccugccccccuaaggugagugcuccacuugugccagagggagcuucauuuaaugcucuucccauuuccaucaaaagcuagauggauccuggcccucugaauaugccucuuccccuccccuccugaccucucgccggcggcuacaggcggugcugcagugucucucccucuugucgccaggugguccuaguggagagcagugagcgucugggaggcuggauucgcuccguucgaggcccuaauggugcuaucuuugagcuuggaccucggggaauuaggccagcgggagcccuaggggcccggaccuugcuccuggugagaggcuugugggaugucuaggagagguuguggagggggcuuccauuggggaauagaguuuaggggaggaaguauguuuggugggucagaucuucccuuaguuucuccucuucugagggcauguggagagcagguuucugagcuuggcuuggauucagaagugcugccuguccggggagaccacccagcugcccagaacagguuccucuacgugggcggugcccugcaugcccuacccacuggccucagguaacaccagcaccuccgcuccuuuuacugugcccucauccucauaugccuuccauuucuuucuucuuuucuuuuuuuuuuuuuuuuuuuuuuuuuuugagacggaguaucgcucucgcccaggauggagugcaauggcgcgaucuuggcucacugcaacuuccgccuuucggguucaagcgauucuccugccucagccucccgaguagcugggacuacaggugccuaccaccacgucuggcuaguuuuuguauuuuuaguagagaugggguuucaccauauuggccaggcuggucuugaacuccugaccuugugauccgcccgccucggccugccaaagugcugggauuacaggcgugagccaccacgcccgaccugccuuccauuucuucaucucccugucagccuucccagcaaaaggaagccaaaugaguggaaaugaccccagcgccuggagcuggggagguaugucaggagcuucccccucacuaugccuuucuccaugcagggggcuacuccgcccuucaccccccuucuccaaaccucuguuuugggcugggcugagggagcugaccaagccccggggcaaagagccugaugagacugugcacaguuuugcccagcgccgccuuggaccugaggugacacuugcccagaggccccaaaccucuucccuccuaaaccagcugcagagcucccuguucaaaucuaccaccuaggggcucuucuguaucauuuggggaugcccucuucucuucauaccccacccccucauaauucccaaaacucauuauugggagugaaggccuucauuuccauccgucacagugggaaugucccccaacccaaacccuaucccacccucauucccuaccaaauaggggcuguggaaaucagucaguguagauuauuuuuucgcuccuuaguccuagucucacccuuaagguggcgucucuagccauggacagucucugccguggaguguuugcaggcaacagccgugagcucagcaucagguccugcuuucccagucucuuccaagcugagcaaacccaucguuccauauuacugggccugcugcugggggcaggugaggggggauugauucagagggugaaaauauuaaguacugccaaagugagggaguggggacaaggggugcuauucaaugauucuuuuuuucuuuuuugagacggagucuugcucugcugccuaggcuggagugcaguggugcaaucucagaucggcucgcugcaaccuccgccucccagauucaagcaauucuccugccucagccucuuaaguagcugggauuacaaacaugugccaccacucccagcuaaucuuuguauuuuuuuguagagaugcaguuucacuauguuggccaggcuggucucaaacuccugaccucaagugauccacccgccucggccuccuaaagugcugggauuacaggugugagccacugcauccagccucaaugauucuucuuugcuuccucugcagggcggaccccacagccagacucagcacucauucgccaggccuuggcugagcgcuggagccaguggucacuucguggaggucuagagauguugccucaggcccuugaaacccaccugacuaguaggggggucaguguucucagaggccagccggucugugggcucagccuccaggcagaagggcgcuggaagguaggggaaccccuggaguguaaugaaccugucaguguuuccaucuuuauccaaguggcuuaacuaggccagggccgauaggacuggaguuccucauuguuuuugugccuuagaagcuacuuagacaugggcuaccccagaauccuaggcccuauuugugaaccuuccucaaagagccuaugcaagucuguggauagaaguaguacuuauaaguggcuuagagauaggggaaagaacccagcuucacugaacauuucagaacagccacacuggccugucugguccacuuccuggaguacacagaggaaugauuuuuugugaagucuacauagucacccaaucucuucauccugggucaguacacagucuccccggccacaugggugccugggaaacugagagugaggcaccagaagucucuuuucacucaucaaauucucauuuucugggucucucaaauguuuucaugcucucagguaucucuaagggacagcagucuggaggcugaccacguuauuagugccauuccagcuucagguaauggaauagccaccuuccccuuccccaaccccuaccagugagaagcaaaagcuauaccuuccugggucagcaggaccacaccaugccccugaacuggucaucucuaugggagucuaaucccaaagaggacugacaacuguaaugggaaugccuucugagucaggccucugccugaucucuagugcucagugagcugcucccugcugaggcugccccucuggcucgugcccugagugccaucacugcagugucuguagcuguggugaaucugcaguaccaaggagcccaucugccuguccagguaugauaaagggacggagaggcugggcaugguggcucacaccuguaaucccagcauuuugggaggccgaggugggcagauaacaaggucaggaguucgagaccagccuggccaacauggugaaaccccaucucuacgaaaaauacaaaaauuagccaggugugguggcuugcaccuguaaucucagcuacucgggaggcuaaggcaggagaaucgcuugaacccaggagguggagguugcagugagcugagaucucgccauuacacuccagccugggugacagagugagacucugucccccccacccccccaaaaaaaugggaaggagagacagccucagcuagagcccuuuccuucugacgcaugaauguccuucucuccagggauuuggacauuuggugccaucuucagaagauccaggaguccugggaaucguguaugacucaguugcuuucccugagcaggacgggagccccccuggccucagagugacugugaggaggaggaaacuuugccuaguggcauuuccagagggcuccucugugcuccauuguaggcaaggccagacugaucagugcuauauucccuccuuaggugaugcugggagguuccugguuacagacacuggaggcuaguggcugugucuuaucucaggagcuguuucaacagcgggcccaggaagcagcugcuacacaauuaggacugaaggagaugccgagccacugcuugguccaucuacacaagguaaguugggauaaacuucccucagcucuccacugaaggccuugaagacagagacuggaacauuugucacuguaugucagccaaggccuaggacaucaauaauaaacuuuucccugcauccucuccucucuucucagaacugcauuccccaguauacacuaggucacuggcaaaaacuagguaaguugggaaaacagcugggcugaggagggccaaggacaucagacccccagcuaaaacauuccuuucauccuuuccuuccagagucagcuaggcaauuccugacugcucacagguugccccugacucuggcuggagccuccuaugagggaguugcuguuaaugacuguauagagagugggcgccaggcagcagucaguguccugggcacagaaccuaacagcugauccccaacucucauucaugaaaauaaaaauugcuggagcuuggcuuggucuggcuguucuaucaccuauaggcauaagaaugcggggcagcaaagaggcaaagugugccugggaugcagaaagcaggagcagaugcgagacaaaguccuuuauuagaaaauauaucaaaaucccagcccccugagccaggaccagaagagggagcuauuccagcauaggcagaaaaugcccagggaggggcuuccuucaccaaacaacuucccgggaaccauaaauagaauaaauauucacagagguccgaggagaagccagaucacucuucucuccauggaagagggaggggcuugggguccagcccugcuccuacucuaggggcagggacuccuaggaaucgucacauaaaaucaugacaucaaggauucacagucauaagcccuacaggagacccuagagagagggaccccucaggucuacaggagcccagcuccaguccagcagugagggagaggccccuacccccuagcacggcaccagaguucaguucccucacaucccucugagaacagugaggagcugaggguggggagaauacaaccccaugaauucgguuucaugauuaagguagacaggaaggaggagucagugugaaccucggagggcugugugguuggcaguagauagaggcccaggccuggcugggggccggcguugcagcaucucuugacggaaggcuugggaggaaccagguggguaacguggcccagaaggagcccgaggaccccgagggucagucccaaugucugcugugauguugguauaaagaggccccagcucucgagccagcaacugguaugucagugaguucaucccaucuugcguccaggaauucuggguacggaccaggaggucaaaucugaggguuagagguuggagacuaagacccagaaaggaacagccagaaaucuagggaccuuuaggauuuuccuggcuagggguacagaacccugaggauccaguaacaauucccaggcaguccuuccuucuuccuaccu

SEQ ID NO: 12960 - RNA, 6864 nt, Homo sapiens
acggcagcuguaagagcuggagguuaaccguguuagcgccgagcugggagugagcggccguacccgucacugcccuccucaggaccgaggcggcgagcgcuuaaugcuggaguuagcguuccccagcacaagcuuaccagguccagcuagggugacaacccuagagggaaggccgcaggagcuuuggucguagggagaauagauagggacacuuaaggccaguccacggggaggcggcuccauaaacagcuccuugauguuagcaacagaccgggccuacgggagcuagggccgcccggcaacguacccaguguuugucaacaguggcacucccccaucgccgaccaaaccagucgccccagagccugcacgcagccucacucaaguaugccuuuccucuuuuccucccaguacauaaccuucacugcugggggacacagguccggguccagcaccauccccgaaaccuucccccucggcucugagagcgcccccaccuguuagagagggaacuugggucccaagaagacuccaauuuggcucaguucucuaucacccccuaagcaaaaauacaaauaagcacaucauuuuuucuuaauaaauuuauucacaaaaagugauauugcagagggucugggggcuguacaugggcaggggcuuggugagcuuuguacauggggcugggagacaagggagccuccagguggaaggguauuuuuuaauaaaaaaaauaauggagcuacaaccacccccuccccccuccccgauuaaaaagacacaaaaauagacgucucugagguaaacggggagccuggggcuuaaggguguuuaaagggcuucacaggugccagagcuuagaggugucacaggcaccgggguggcuccugcaucaguugguagaacagcacguagcccucgcuggaugccaccugguuuucacugacaggggagacacuaggaaaaaaggagaucgggaaaggguuguggucauuccuguuuacucccuucucccuacaagaccgaaccucagagcauccaggaaaugaucaggcaagaccuccaccucuccuuucaccuggcacucugcucuccuggagcuucauagaaggggagggugucagggcugagugggaauggggcaggauguaaauaggaggcuauucucaccgagagucauuguagacaugccaaccagucuggcaccggcacagggcuguguaguggccauaguggacgcugccugagugguugcaaagggcauacagcugguauacaggacuuccugcgggguuggagaugaucaaguucuauaaucagagcugugcccccacuccuuuggcuccuuaggacuuuccccaccagacucaccggcuuugucacuggcaaaguccccuaggcucagucgcugcaguggaaagucuacaccuacugaacuuuuuuugauggagccucgggaggcagaaaaucgauucagaucuaagcccugguuaaggagcauuugggaggcagugggccucugaggggaacuucuucuauccugaaagcuguccucuccccacucccgacacacugggagcaucuuguggaaaaguggguggcagacuuuuccuaaggaaaauucaauucucuggaaacauggaggaaagagaauguaugggagguauccuaagagaaguaagaaucugaagauuaggauauggagcacgaggauucgagggaaucuuuguacugucaacuuuuugguacuucgaguuuucugccgacaucggucacacaccugaauaaauggcaaacaguguuagguuaauaugcuccuaaccucaauuggcuuuucugacaccccgauccacauacaaauuuaguaugcucuucauuacagcuggauccucuuggcuucuccccuuugcucuaggaguacuagaacagaucugagacuccaacacaaacccagauacauaaauauuauuccccauaugaagacaucaugcaaucccuuuuauccacauggaguccccccaggucucccacccuuacuguaucccuugugaaccuccacauacuggggcauucuccgacucuagcucuucuuccuuagugaaaagguugaaacaaucccgcagagacaccuugcccccagcaaauccuuucugggggaaaaggggaagaaaggucaacauguucugaauuuccuuuuccaacucuucucaaucaauccaggcuucaguucugcuccagaaacccacaggguucccgcccacacucuggggguggguaggcuugggucacagagccccuguccuguccaccccggaauccucuggaaucccaccuuggggaugggcagggacaggucacaaaaaaccucgaaggucguggagcgauacccacaggccuggcacuugagacaacuuuucaacuggcccacaaacaggucuagacagaagcacagggacaggagaaaaggucauuguuggauguuaugagaugauuucuuggauuuccaucucuuccugccccuuugcuugacccuuccuuucccacuaccaacacuccuaaucaacucuucacacagcuucacauuugcaucauccagucuuguucccauaccccuugauaguaucgauuuuuccccccaagccuguaccccccucacacacuaauuuucccucauugcuuugccccauuccauacccacaaucuugcuguccucucgcuccagguaacguuuccacauuagguuggcucggucaucaucacuaccacagaucaaaggaaguggggagcacccaugagacagcaggaacacugggcacccccaacacccacugaaacaaccuacagagcccuacuccccauccacaccccugcuccuucccuaaauuucaaggaaaagucaaaagaauaaugccucaaugaacuuucuagggaaauccgaggugagaggaaaagaaaggaauguacauaagggaagaauaugcugucuuccucuaccuguaaaugaauuauccccuucuucaauuuggugacaucccuagcaugaucuucugccuccaucugcucccuuagacucccccucuuccuuccuuccuucuacuucuauguugcuucucauacuauuuucuauacuaaaggguuucccuggacccuacaucuucaaucuuuacuaguuuaguucuaugaagugugaaugaugcugauaaacuacggggaaaggagguagagggaacgacccuuaccuuaacucagguucuucuagcagagccccuccucggcgggguggagagggaacuggaccauuggcaaguaucgguggagcccggcggccucggcgguugauuucaagguguagccgcuccaugaggagcuucaggaacucuugggcauccugcuggcuacagccagacaaagaguaugggcaacugacuccucuccuaguccacagacacuauucccugcccagauauugguccccacuuccuggaugaagaacaucucaaggcucagaacaaugcugccagggcccuugcuuggcccuacccccagacauggccagagagaaaucccauagccuccagcucucccaccuguauccagagaaggagggaacauauuucuggaagacagcucggaaucgaguaggauucacagcuucgcaggagucagggugccagagggcaccaaucacaucugcaaaggcuguugggaugggaguggggaaggcaaacaaagguuaaugucuggaagaggcaagcaaaagguggcucagaggguagaaaauaaccuuuaggaaaguaggcacugggaaaaguagauacaacugccagauuuaaggguugggggccaccaccaguggcagauggaccugcaagugguuggggaaaaagggacuugaacagagggagcaggaguuguugccccaccuucagugagcucuugggcucggccuccuccaggcaccucuugccggaagucccuucucagacagaagucccgaagaggucgagugcugcucagacacugcagcacagcauucaggaagcacuggggagcaguagggacacugcuguuaucucuccagaccacugcccaggaagccuuagaagagcuucagagcucuccuuccacaugccuuccccaagcucguggguuuuccccacccccagcaccauuucacauuccuuuuagagaggaaagauaggagaauagcucucaccguguuucccagguuucgaaggccaacaugaccagagcccagaaggagugugugaugagccuggaaggucagaguacaaucggcaaguuccuauauauccuaccuggcacuuuaaccuuucaacagcaugcugcccacugccucccccaucccaugcauguuucauccccaaacucuacccuauuccccucacuagguauucuagucucccuaccucacuggucaugagcaguaagcccaucacagcugaauguaccacggacucagccauggcugucccaccuguugcccacuuacuccucugcucagcuagcugacguugcagcuccuggggcaacucccccagcaccggcaugguugcccagcugcucaccacucccaccuuucugcccccaaaacccccuccugcccccguggccccuucuugcccuucuccugcuggcuccaauugcaaucagccuagcuuacuuagcucagaaaaugugcaaccacguuugcuaagauguucugugccugccucucuuuagcuccagagauuaauuaggccuaggcagagucccaguagagaaggugcaagcaagggaaaggaagggccuggggacccaaagaagaauucuaaauaguugggguaauccccuggggaccgaaauggcacaccaugcugaagagucaccaacaacccaaaaaagggucuaggaggcucaaggguauuuaagcaagggagaggcauguccaaacugcuguaaugaagggcugagaaaggaacuucagggaaaugggggacagaaaaggcagaggauggcaggaaagcacagaggaacaugggcaugaaggccauguguguggcaaguccucaccaucuugucaucagaguagaaaggcucagaggaccgggcggauaucauguggaaggagccaugggaagcagggggcucuguccguaugcugaacaggguaggggguccaggaaagcccccuaggcggcggagagaagugcuacgucucaaaguggguggcucaggccggagggccaagcggcucagugcagccccaagcucuccggugccacggugcccucccaaggcaauccccauuggacgcaaguccccacugcucacagacuuggaacgggcuaaguugguccgagaugggagaggcaaagccacuguuggggguggugagccaggcaggggaaccccaugaucugcucgaagggggccucugggacgagggccugagguccguccccgucccagcuccaguuucuugagccguucaucaggcagaccuggccggggaggcagaggucguaacaugggguuuggcccagaggcuggguuucugcgcuccuugcugcgggcccugggggcaaaugguagcuuggaucccacucggggcuggauauuaacagguggcucucggguacggcccaggcggugcucagaggccuggggcauuguggacaccacaggcuggaccugggaggagaagagagugucagcauuugaauauggggggaaaugggaacccaggcugcuguacugaacccugccacacuaauuuucccuuauugcuuugccccauuccauacccacaaucuugcuguccucucauuuccacauuaggugguuggcucagucaucaccacuaccacaucaacgaaaguggggagcaguauacgcacugagggcaggaaccagaucuaucgaaucagccaucguauccccaguaccuggcaucguguuugguacaaaguaaauacuuaguaucuauuggguaaacaaaugaaugaaagauaagcagcccauggcuuugacccuuucuauacucccgaccccucccugcagaacacaucuuuacugaaaagccagugauaacuccuaucucggcucuaacguaacaugggaccccauacccggcuaguaaaguaggaugugccucgggucacuuaagacccuagccaaaugguaguguagaugcaagaauaacagcccaaaagacagcccuccauccucgaaucccugccucucugggcugcaaaugaagcagacuauaugggugacuuacgauccauucccucccccaccuccgaccuccgacauggugucgagguucagaaagcaguagucggggauggaggacgaacaacuccuugacccuuaaucucugcacuucucccaccacagcagggcuuuagccggguccgccccccucgagggcagaaaggccgagaccgcugauuggcuacggaauccggcggcguauuccccgcgguccagggaugcugucccuccagcccaguucucccaggccccgccgggccccacgcgccuuuguggagaguguccucucgggucuggagcagucuucccucugcgcccccccacaccccgccaugccauaacgccccggcccguaccugucccccagugaggcggcgggagaggccagccagggccaggccccaguucagggccacccccuacuacccccgugcagcccccccgugggcccggcugcagcuuuagccgcagccguugcccagaucgcucccgccgcaggggccgccgccaucuuuguuggucccgcccggccaccggccaccggcuucaccgucucucaaagcgccugcgcauccacacccgaacucc

SEQ ID NO: 12961 - RNA, 489 nt, Homo sapiens
uuuuuuuuucuguuuaauuuuuaaugaccaaaacgaagcaucuaaaaccgcagcuucuggaagaaccgcuuguucuugccugucuuguaucucucuucaaacuugaccuuggccucucaucgggccuuguguuuaagaguagggucucugaagacauccuuauugaugacaguuuuguccaaggggauauccacagaguaccuugugggcauuagcugauugugguuauaaacuuucacaaaagacuugaucuuugaccucuuagagaucuucuucuugcccauggcagcugucacuuuguggggacagcggucaauuccagccaccagagcauggcuguaggggcgaucuaagguaccaucaucaauguucuucacgaugauggcuuugcauccagaauagcauccagccagaacaagcaccaccgucccagguuucaugaacuugcccauuucagcagcaaccccucgggccuauagcaaaaaggaa

SEQ ID NO: 12962 - RNA, 12972 nt, Homo sapiens
caacagcccuacacggaucagcuaggcgacacuuccuacaggaaaccggcguucaaaagguaaaugcugaacaaaugaauuccgagacgggaucugggcaccacuuucggcuccggauccggguuuacggaacguccggguuaucaggaagcucagaggaaaggugaaauccagaucuugacccuucacucaaguucgccagacaaaccgauccccgugguauuccgcccuuaugagucauggcugccaaucccagccuuccagugggucuugaagucgccaccagccagcuguggcgccaccaauguuucccauucaagaaugcuauccucuucgaucccuuauuaccgcccuaagcagccgucaagacaaaccggcguugccagcuugccccaaagcaagauggcugccaaucucuaucucuccucccgaagugaagcuauccacuccccgauuaaugccgcugccaggcugcccucacuuacuauggcuacuccggcucaugucucacuauggccucgaagccgccacuaaccggccggguuccgggaggcgccguucaggaugcagccacccccgcccgccuguccccucccccacggccgcggcggcggcggcggcggcggcugcuggagcccggaugcggcgccgugaggcaggcccgggagagcggcgcggauggauccaacauggcggcgccgagccugagccgagagugaggcggaggggcggccggaguggggagagggagucgagcgggacggggcggggccgggcggggccgcaaagggcuuggggaaggaaaguggagggggaggcgguggcgacguccagccugagaaccucaagagagggaggugacgggacgcugagaggugggggaggggagcugccgaggggggcgugcaggggagauggcaacugcgggagagggcaggggucgagacggaggagugagggcauggggaggggcguaaacaagggcugagacugggcccagccagggguauuagagaggccgagguggggaguggggcugcgauccgcucguauugaaggggguaggagcaggagggagaggcugagggugugaaggggaagggggcuguggcaugugguuggagggaggacuggacucugaugagggguguugcgaggagguggguaaaggucagaauuggaguuaagacguuucuggggggcuucgaaaguguuaaauuggaggugggagggggaagggccuaggggagaauuuggguggaaaaggagagaacggaggcuuggggaauggagagagugucggugggaggagguaauggagaaagugagagacugggaggaagaaaguuugggaggaaggggaguggaaugggagauaggacaguggagcugcacgggugauagagguucggggguuucccuuuccccgguggagaggaggagagaacagaguuaagcagcaucaguugcagccaauucuaauugccaggcccuuagcuuuuaagagggugggaagggcagaagggaauggucauguggguuugcagaauugggguuggaugagaauucaacuggguuuguuuuccaaaagacucccuagcuuacuguucccuuguuuuuccugcuugggaaaauggggaagccggugucgcccaaguguggaggagcaaaggacuuuucuaguuuuuagcauuagcaauacaagagugggggagcagacauggcuauauuggaacccuauaugcuaagguggaggcucuggaagucugaggagggaaagagaaaagauagaguggcaucuagacagguuaauuaaaugagugcuguaguuuccagacccuuuugcuguuuuaagucuggaagggaggggguaacauggauacuguauguagaaaaacuuuucccuggugaaacauagacguaugaguggaugcugcgccauuagauauuuuguucucauugugugcuaguuaagggaaagggccaaauguagaauuuggaggauagugcuggucugcuguaaccacuuuccucccaguuuuuucuaaaggugaaaguuaacguuaauauuguaacaaaauaggaauaaggaauuguggaggaagaugagaagcugccagaggguaauugguuuucccagaaguucuuaaauuugggagcugucuugccgcaagccauugagacuggaaauucuuggaguugguauuguuuuuguaaauugacuaauagagaguuagggaagccuggagacuuguugggggugaguucucuaaaugguuuuaggcuugucuguguacuuuugcaacgagauugucuaauucuaugggccucugagguuucaaaguaaaacuugaaaauuaauuauuuuccccuccuuauuuguuuuuguuuugcugcuggcugugaaacuugugcuaggaagagaccugggaaauuaaguuucuugcggagguaagucuggaacuuuuuuauuguuuucaaacaauggaagggaauggaaauagcaugggaguuauuuugagguuggguccauuaaugaggaggagaaugccagggaaaaugaguuaucauucauccaucugagugcaugagaucuguuguaaucacugucuuuaguuaauuggagauaggaggugaaagagaaggagauuuagaugucuugggacaaucccccagcuuugguuuguuauugucuagucuucuuggucagcucugaaacauuuuuuuuuuuuaacauauggaaggcuguauucuaguacauugucuacuaaauguugcccuuggaggguugcugggacaccuuccuuccgugggaaacuuuuccucuaacuuucucuuucagcuguugggggguuccuggcauccuucuuuugaaaacauacuauguaauucugacuuccagauauuugauuacauuuccuaucccaccagcaagaauguacucuuaaccaucuuuaagauuuucuauguaguuuuaauuuaaguuucaagauaccacuuuuuuuuguaguucuucugcaugacuuuuccucugaggacuucugagagagucagauaucucuuaauucuaugaaauuacaaauaucaucccuguucagaaaagaugacugucauuuucauuucaagacagcacucuuuuuuauuucuuucaugucgcuuuccccuaagggcuucugagagagccaaguaccucaaaaacuacagauauuccugguugggaugagaccagacuuugcuuggaaguagaaacauaguagagaaggaccaaucaggaggaaauccugaagauaccuauagacuguuggcccuuggcugacuuggacuucucuaaagaaaaaagcaaaacuccaggaaauacaacaauuccucagaaucaauuauucuugggaaacuguaggggagaauucauguguuacuaucucaaauacagccagaccagucagugggaucaggacuuucugugugcuggaguuucgucucuugguauuuggcaguguuucagauaccaagacuugaguuaguucuaauuuucuguucagaggguuacauucuccucaccauucugauaccugucaucuagaaucucuguauguuuuaaguugagcucccuugcuucacugucacagaaauacgaguauauuuugguuuuagaggaaauuggucauguuuucuuuucuaauuuuacuaaucagcugaacuuucaucacuuuuuuuuuuuuuuuuuuugaggcaaggucucacucuguaccccaggcuggagugcaguggugcgaucagaguagcugggaccacagguaugucccacuaugcccagcuaauuuuuguuuauuguuuguagagauggaguugugucauguugcucaggcuggucucgaacuccugggcucaagcaguccuccugccuuggucucccaaaguguugagauuacaagugugagccaccaugcgaggccucaucacauucuuuuaauguuaaaguuagauagauucuuggaacccuuaucuggguugcauuaaguggagagggcugccucuuaaccugcaugacaguauccucauauuucucccaagcacauggccuugaggaacuuacauauuucuauguuugcuucauugaauaagcaauauaagucugauuagugaccucacaaggagaauuugcugcucauccaguuccaagacuuuaaagaugacccugaggcuuacgagcaggauccuuugugucugucuugcagaggauuacauuucuaauauccccauagaacuccagauugaacuaggucaaaguagaccuccugggauggggcagaaguggauguagaacuaccaccuguuccucagcugaauggcaacagcaggugacagaggacccaagguuggaguggcaugaaacaccuuagugcaguuggacuugggaguuaaaugaacauguauguccgacaggcuuuucuuuucuucuggaauguuguuugauggguuuggauggagggaccagauggcuuuuucuagaucuaguguggaaagugacaugcauucuuuugacccuuuaccaugcuccaccuagaauaggguuucucauccuuggcauuauugacauuuugugcugcaugauucuuuguuguggcagacuguucugugcauuacaggauguuucuuuuuucuuuugagacaggguuucacucugucaccugggcuggacugcaguggcgcuaucacaucccacugcagcuucgaccucccaggcucaagcgauucuucuaccuuagccucccaaguagcugggaucacaggugcaugccaccacgccaggcuaauuuuuauauuuugcauagagaugggguuucaccauguuguccaagcugaucucaaacuccugggcucaaguguuccucccaccuuggccucucaaagugcagggauuacagacgggagccacugcaccuguccuauaggauguuucuaaauaucccuggcuucuacucauuacaugcugauggcaguccccuuccccaccaggcauaauaaucagaaaugucuccagacauugccacauauuccccaggggucaaauuugccccugguucagaaccacugaccuaaaagcuauuauaauuccuaguacauugaugaucuagccugggaucuaggacuuaaagguggcuaguguguuuguuuccucucaaauguagggaguuaacuucaaaggauugaagcuuauagaauuacauccauugauacauaauuaggaccacagugcuuuccuguauuuugccuuauuuuccauugcgaggguauguggggacaguguuucuucauuuccugggguuuaagcacacuuuaaauuagggaacuguggagcaaccagcucuucugguugguuuaaugugaaaccuacccaaucugcuuuaucugagagccucacaaucaacagcuggcccaagggaacaggugggauagggaacaaagagaaguugcaggggcucugaggaggcucaguuuucucauguugccugcuaugagcaauaacuuauuuuccuuuagcaccuucauuuguacccaguaacagcaacaggugaaucgagaggaagaggcaaggaauaccagucuauaguugaauagcuauuucccaugcuuuggguggggcaucugggcucucaaaacuauauauggauuacauuuccugucuacauaucagaacccaugguauaggguuaagugaucccagaguguaccuccccuuuucuuaagggaaugaguuucucugugcuuucauuuuaguuuuucaucugaggaagaaaggaccaguuccuacuuacucuucagcuuucucuaucagcuuuguuuuuccaaagaagcuuauuauuuuauuguuuccuagucuagccucaguuccuuuuuguauaaaauggacagagcaaccuguuuaauuguugaguaggguagaguggugugguaugguguggguaguucuggacauugcagaggaggcuauggcuaguuagaauauaugcaugguaacugaauuaccuguaucuguuuuuaaugggguccucucuuggacuuuugugaauuuguuucuuaauuggaauugcuugaggugaucucuuggagauuaaguucaguucaacaguggguugcucccacuauauuugaggcucuguccauuacuaggcacuagggauauaaagaugaauauaucucuccaugaguugaguaggaucuaaugggauaauaaauacacaaauaauuuuaguacauggugauaaaugguguaaaggagauaugcauaguguuccauaagcgcacagaagaggacuacuuaucucugcauggggguguagaaaaugcauuuugaagauggcaucugagcugacucuuaaagaaugaguaggaguuagccaucugaaaaagagugaugauggggguguggaauagagaagggagaggggcauucaggcaaagagaagagccugaagaagguauagagaaauugcaugauguaugugaacuauaaacaaacugauaauguuagagaauaaaaagcggaugugaugggaaaugagguugggaagguaggccugaucuuagaaggcuugauguguguguaaagaauuuggaguguucggccaggcgugguggcucacaccuguaaucucagcacuuucggaggccgaggcaggcggaucacaaggucaggaguucgagaccagucuggccaauauggugaaaccccgucucuacuaaaaauacaaaaaguagcugggcgugguggugggugccuguagucccagcuacucgggaagcugaggcaggagaaucgcuugaaccugggaggcggagguugcagugagccaagaucgcgccacugcacugcagccugggcgacagagugacucugucucaaaaaaaaaaaaaaaaaaaagaguuuggaguguucuuauagauaacgauggggcaaucaaugggucugaagcaggaaagugacuuggucaguuguggacuucagacagcuaacugaacuagauguggcaguggauggauuuagguagguuaagauugguguugcagagaacuuuuaaaguuacaguaguccaggugagagauuauuguaaucugaaccauggcaguggagguggaaagguaggauagauuuaagaaauaucuagaaguagcauuaacaggaauuuaggauugauugugugauuggagagugugaccagagagugcacaguauaggaugguacugucugguggagcaguaaguaugagugacuugagucaaaguuguugaauuugggaauugauuaauggcugcgucauugguauuaccuguagcccauaacgauggaggaacuuugugaaucaagagccaaacuauauaacgaauguggagcugugauuggucauugauaggggauugguaaaugacauccaugaggaaagcuuagaaggugguauugccaaggccagguacgguggcucacgccuguaaucccagcacuuugggaggccgagguggguggaucaccugaggucaggaguucaagaccagccugaccaucaugguaaaaacccaucucuacuaaaaauacaaaaauuagcaagacgugguggugcgugccuguaaucccagcuacuugggaggcugaggcacgagaauugcuugaaccugggaggcggagguugcagugagccgagauugcaccacugcacuccagccugggugacaaagugagacuccaucucaaaaaaaaaaaguugauauugccaaauagggugaagaucaagggaguacaaauggcauagaauuacaagaaugcuuauuguagaaacuuaauguuuauuuuaaauccaugaguuuugguaaauauugauaaacuuucugagcaguuaucauuucuugaugugguuggauuguaggaaaaauguggagggaugauucugggcugcaaaggccaaggaugcuuguaucuuugaaauguuucacaaccauuuauauaaggguuacccgugauuuucucauuggauucuuaacaacucugagguguauauucauucaucccuguuuauagaugacagcacugagaaucuggaguuaagugacuugcuuacggucacacagcuacacagccuuucagugauacagucagaauuuaaacuaguucuuuuuuuuccgagaugggggacucacucugucacccaggcuacagugcaggauuauggcucacugcagccuugaacuccugggcucaagugauccuccugccucagccuccugaguagcagggacuacaggcacaugccaccaugccuugcuaauuuuuuucuuuuuuguagagauggggucuugcuauguugaccaggcugaucuugaacuccuggccucaagccuuccucccaccucagccuccugugcagcugggacuacaggcguguaccaccaagcccagcuaauuuuuucuuuuuuuguagaaacgggucucccuauguugcccaggcuggucuuaaacgccugggcucaagugauccuccugccuuggccucccaaaaugcugggauuacaggugugagccccugugccuggccaguguuuauuuuuaaacaaacacuucaaaaauuuaauaaacauguauaaagcacuauacugugccaggcauuguuagcaacugggaauaugggaaugcaugagacuaguuccugcccuugagugucucaucgguucuuucccugcccuuucaguacgguggggauugcagcugcugagcagggauucuggaaagcauugcguaccugagcccccagcauggcgggccuaaagcggcgggcaagccagguguggccagaagagcauggugagcaggaacaugggcuguacagccugcaccgcauguuugacaucgugggcacucaucugacacacagagaugugcgcgugcuuucuuuccucuuuguugaugucauugaugaccacgagcguggacucauccgaaauggacgugacuucuuauuggcacuggagcgccagggccgcugugaugaaaguaacuuucgccaggugcugcagcugcugcgcaucaucacucgccacgaccugcugcccuacgucacccucaagaggagacgggcuggugaggaaguauuaggggcuggaaucagggaagaguugugggaggccaggaaggagcagcauaggcguccaaaggggaggacacauugauccuggggaguacuuagaguaaguugugaggcccacuggggguuuggacugacagaagggaaggguguauauuuuccugaaugauuacuucuccuccuacagugugcccugaucuuguagacaaguaucuggaggagacaucaauucgcuaugugacccccagagcccucagugauccagaaccaaggccuccccagcccucuaaaacaggugagaagacauuaacucccccugcuuuccaucaucaaguaaaaggacacugaucccaucacauucugggcuuugccagcuuaaaugaaaggaugcugugcgcccacaucuugccccauaaaaaaaaaaaaucaggcgaggugacauuucuccuagguccuguauuugcucucacaugucuugucuuuuuuuuuuuuuuuuuugagacagagucucccucugucgcccaggcuggagugcaguggcgcaaucucgguucacugcaagccccacuucccaggugcacgccauucuccugccucagccuccugaguagcugggacuacaggcgcccgccagcacgcccagcuaauuuuuuguauuuuuagagacgggguuucaccguguuagccaggauggucucgaucuccugaccucaugauccacccgccuuggccucccaaagugcugggauuacaggcgugagccacugcaccuggucucacaugucuuuucaagucacauuuuuccacugcuuuuagugcuaagucuaaaugauuccuuccucauuccaacagaaguguuugaauuucugccuuuacccuacuguguuuucuucccuuuuacuuucuggucagugccuccccacuauccugugguguguugccccacuucggguccucagauguguagcaagcggccagcccgagggagagccacacuugggagccagcgaaaacgccggaagucagugacaccagaucccaaggagaagcagacauguggugaggaaguucaaggguuccagagauggagcagacuugaaggagaauauaaagaacugcugggacacugggcaguuuaugcuauucagugugagauucacuuugauugccauugcaaagugaggcugaaugguuuggugucugguggaagaacugcucuuuaugauuguggcaggguacauuucaacucuuguuaguuaauacuacaucacagggauguuguuaugacauccuuauuguaggaugagccaagucgaguauuaaaaugaacuucuaugccugguaauuaggaaaauaucuccuauaaacaaguugcuaccugugaguaaugggaacagugcugaccucggcaugucccguuuaagggaaccuccugcauucaggcaaggauuucagagauacauagaaauaguccuggggaagagguagagaagcugucaggugauauucccuacuuuuuuauucuguugugcuuuucaguuuucaagcuuggcuuguaaacucaucccuuacuguaaccucuucugcucuguaucuucuguuuccaacagacaucagacugcggguucgggcugaauacugccagcaugagacugcucugcagggcaaugucuucucuaacaagcaggacccacuugagcgccaguuugagcgcuuuaaccaggccaacaccauccucaagucccgggaccugggcuccaucaucugugacaucaaguucucugagcucaccuaccucgaugcauucuggcgugacuacaucaauggcucuuuauuagaggcacuuaaaggugucuucaucacagacucccucaagcaagcugugggccaugaagccaucaagcugcugguaaauguagacgaggaggacuaugagcugggccgacagaaacuccugaggaacuugaugcugcaagcauugcccugaccuauucccucuucucacuuuggggacuguucccaucacccaccucuggagcuuacacuguucugggguuuguucucuacccuuccaaccaaucacaccccugccuuuuuuuuuuuuuuuuuaaagaaaaagacaaaagaaaguggaagugguauuccccaccccucccugcacccaugugccugggcuuccccuuuauuucccuuuuccauuuaccccguaaugugucucuacagcuaccuuaccacugagccguaagacaaauguauaggaagaagcaaagucuacagcacauagucuuuguaagggauugaugugaacacuuuuuuuuggaugcacuaaggaguuaucaauacuucuggcuuuaugagagcucuuaaauuuugucuaaaaaaccaaagggcugugaguaagggagcuauguggaaagugggacucugaaguguauuuugaaaauuaaucgccacccucuuccaaauuauagaauuuuuuaaaaacaagcuguggcccuuuccacucucuccuggccucuggugcugcuccucucugccgccuuuccuccauuccauggcuugaaaccucugccugauguggcuccuuccuuuuucccauuugucaaacccucuucaaaggaggaacagauaagacugggucagccuagucaugccucccaacuguggugguauauguguacacacauacacaggguggauggagaagagguugcugauuaaaauacacucccccuauaaaggggaagggggagugugacacuuucuuuccauguucaagugaaaauaaauaauguacccugcagcccuuuuccccuuugcuuucuucuggcuugggcaaagggcaucauagguguaagugaaguaauuccuuuuuccuucccccuccuccacuccuacgcccacucccaugcuugggagaauggggcugggacaugcacugaguguugcacuuuuauuuagguagggaggcauguugaaugagccaggaggucuagaacuggagcuuaguccagcugguacaauaccaacuccccuucuaguucccaaaggcgauguccagacacagacuuuaugauuauuauauuuuucaaugccagugcugcucagcccucagcagaacuucaguuuccaugaaauaaacaaugacuauauaaaauuccaccuuucugaaacugcagucugaccucaggugaagcucaggugaaaguuucuuucccaagcagcccaucuguguuccaucaagagagucaagguucuccaagugaggggagcugugccuggauccugccuccaagucacaugagcacuagcucauaguggcagggugggggugggaggggcaggucuaaacucacagaagucaagucuuaagacagugggugacccagauugccauagaggucaggccugcggugcuggaacacaggcaggugucggcgcaacugucgcagauaguugaggucuauucgggcaaggcagaggccuggccccucagagcagcgggccaccacuguuccccaggggucuaccaccaugcuguggccauaacuugcucucuucucaugguggcgucca[264 bp omitted]

SEQ ID NO: 12963 - RNA, 4714 nt, Homo sapiens
cgcccacucgcugcggcgcuucuggcuccagaccgcccuccggaucggacccugcgaaugguuuuggcuauaucuucauguaggaccuacucccuaucccgucggccgcggugaaucccaccugcggugcuuuaacuuguguaacagagaugcugccucugggagaggcggggagggacgggccaacuggagcgggcggcgggaggguggagggcggggcgcggcuuggggccuggguuccuuugccccuugcccaccagggaggggugggagacgagagagggugaacuuuccccugcgagauucuggugaaaggggaaauaugcuucgagucaguaaagcugcgcaagugcacagucaaggagagagucuugggaaaaccaaggauaguucccggagaugacuuuuggacugcggaaacguuugucagaggaaagaggcuucaguuuaaugugagaucauuggaaguugaacuauucaggcggcgagcagagccccuuucuccaucuucccacuguauggucuugucccuuagccuauaauuucuuauaaagagcguuuugaagacuagguuuuuacuggcagggcccugauucaggcucacaguauaaagagagaagucagagaauccuagaaauuuauugcuugaagaagggguugguguccucauaucucaccuuccucaggcugggcuucaucaccaggccuccucacagauuccugucccuucuguguccuggacuccggauaccucaacucucaguacuuugugcucagcccagguaacacguuuuguuguguccucagugccuggcacuuagaugcucaguuuguuaaauggauagugggagacacaggagugucaacuauccacacauuugauuggugagcccuacuagcccugggucaacgugcccuguaagagcaugaucaaaaggaaguccagcuuuccugccucuccacuugcaccccuuagcauuaaauuugcuucccugugcuaugaaaucugagaauccugccuaugcuguucacaggcccagagccauggcuaucuccucuuccuccugcgaacugccccugguggcugugugccagguaacaucgacgccagacaagcaacagaacuuuaaaacaugugcugagcugguucgagaggcugccagacugggugccugccuggcuuuccugccugaggcauuugacuucauugcacgggacccugcagagacgcuacaccugucugaaccacugggugggaaacuuuuggaagaauacacccagcuugccagguaucagggaaauagcgagggagagguagaaucuuuguuggacagugucccuggguugccagauaugaggguagagccuugagaagucagugaagaguugucagugucccuuccccccagggaauguggacucuggcuguccuugggugguuuccaugagcguggccaagacugggagcagacucagaaaaucuacaauugucacgugcugcugaacagcaaaggugagacuuuauaacccuuuagccugccucuucccaugcucuucuaccuagauucuccagaauuguuucucaacucuuauuuccuugacccaaggauuuaggggugguccuacuucaguuccuagccuauaaacuaucuccuccuugggaggaguaagcaaggcuucuagaacaccagcacugauauuccuucuuucuuacuguaggggcaguaguggccacuuacaggaagacacaucugugugacguagagauuccagggcaggggccuaugugugaaagcaacucuaccaugccugggcccagucuugagucaccugucagcacaccagcaggcaagguaggaguugugaaaggaugagggaggggaacaggaauacuuugaacuggcaguagaggauagaaagcccuaagagaggggguaauggaaauaugacuagaugcugugacaaacagagcaggaagacuacuaaguaggcuguuuuucauuccaga[450 bp omitted]uggacgccaccaugagaagagagcaaguuauggccacagcauggugguagaccccuggggaacagugguggcccgcugcucugaggggccaggccucugccuugcccgaauagaccucaacuaucugcgacaguugcgccgacaccugccuguguuccagcaccgcaggccugaccucuauggcaaucugggucacccacugucuuaagacuugacuucugugaguuuagaccugccccucccacccccacccugccacuaugagcuagugcucaugugacuuggaggcaggauccaggcacagcuccccucacuuggagaaccuugacucucuugauggaacacagaugggcugcuugggaaagaaacuuucaccugagcuucaccugaggucagacugcaguuucagaaagguggaauuuuauauagucauuguuuauuucauggaaacugaaguucugcugagggcugagcagcacuggcauugaaaaauauaauaaucauaaagucugugucuggacaucgccuuugggaacuagaaggggaguugguauuguaccagcuggacuaagcuccaguucuagaccuccuggcucauucaacaugccucccuaccuaaauaaaagugcaacacucagugcaugucccagccccauucucccaagcaugggagugggcguaggaguggaggagggggaaggaaaaaggaauuacuucacuuacaccuaugaugcccuuugcccaagccagaagaaagcaaaggggaaaagggcugcaggguacauuauuuauuuucacuugaacauggaaagaaagugucacacucccccuuccccuuuauagggggaguguauuuuaaucagcaaccucuucuccauccacccuguguauguguguacacauauaccaccacaguugggaggcaugacuaggcugacccagucuuaucuguuccuccuuugaagaggguuugacaaaugggaaaaaggaaggagccacaucaggcagagguuucaagccauggaauggaggaaaggcggcagagaggagcagcaccagaggccaggagagaguggaaagggccacagcuuguuuuuaaaaaauucuauaauuuggaagaggguggcgauuaauuuucaaaauacacuucagagucccacuuuccacauagcucccuuacucacagcccuuugguuuuuuagacaaaauuuaagagcucucauaaagccagaaguauugauaacuccuuagugcauccaaaaaaaaguguucacaucaaucccuuacaaagacuaugugcuguagacuuugcuucuuccuauacauuugucuuacggcucagugguaagguagcuguagagacacauuacgggguaaauggaaaagggaaauaaaggggaagcccaggcacaugggugcagggagggguggggaauaccacuuccacuuucuuuugucuuuuucuuuaaaaaaaaaaaaaaaaaggcaggggugugauugguuggaaggguagagaacaaaccccagaacaguguaagcuccagaggugggugaugggaacaguccccaaagugagaagagggaauaggucagggcaaugcuugcagcaucaaguuccucaggaguuucugucggcccagcucauaguccuccucgucuacauuuaccagcagcuugauggcuucauggcccacagcuugcuugagggagucugugaugaagacaccuuuaagugccucuaauaaagagccauugauguagucacgccagaaugcaucgagguaggugagcucagagaacuugaugucacagaugauggagcccaggucccgggacuugaggaugguguuggccugguuaaagcgcucaaacuggcgcucaaguggguccugcuuguuagagaagacauugcccugcagagcagucucaugcuggcaguauucagcccgaacccgcagucugaugucuguuggaaacagaagauacagagcagaagagguuacaguaagggaugaguuuacaagccaagcuugaaaacugaaaagcacaacagaauaaaaaaguagggaauaucaccugacagcuucucuaccucuuccccaggacuauuucuauguaucucugaaauccuugccugaaugcaggagguucccuuaaacgggacaugccgaggucagcacuguucccauuacucacagguagcaacuuguuuauaggagauauuuuccuaauuaccaggcauagaaguucauuuua

SEQ ID NO: 12964 - RNA, 2646 nt, Homo sapiens
cacuuccuccaaccauaguccauuccaggugggggaaaggaguccugaauuccuuauauaaucccugucacuuguccucuagauacagaagaucauugagacacugacacagcagcuucaggcaaagggaaaagaacuaaaugaauuccgggaaaagcacaacauucgucucaugggagaagaugagaagccagcagccaaggaaaacucagaaggggcuggggcuaaggccagcucagcuggaguguuggucuccuagggaccaaggccuuugcauuuuuuucuacccugacucccacuucuaauuucucuuuauuguuauuauuauuauuuucucugcuauuguaauauuuuuuuguuaauuaaauguuuuggucagaaucuuagcuguagccugaaguuuucucccacuuggggguggaaauuguuuugagacacggaacagcauaugaugugugguuuuuguuuccaucagguuaaugacucauaauaugagaguaggacccauauuuauuuuauccuuuccuugcaaauaaagguauguccacuuauuuacugcccuucccccuccccccaaaaauuucagagacaaaucuugagucucagauugaaauuuaauaagcauuugaagugaagcagauagcucuggugauaacgcuuuauagguuugcaacaaagcaaaacaaaacgaggcuuagugaugugucuuggcacuauuuagauaaaguccaggaugcaaaccuguggacuggcuguccugccauccucaccaaaacccccaaccagguaaagcugaucauuccaaaggcaggugcgauggcccaugcguuucaucccacgaucugcacaggggaaguggaaccacaaaggaggagaugugccuguuggauacgggcagagggugguuauugaggcaguagcacuuugucauucacagaauucaacaugaccaagggcuugcccauuguuuuucugcucacuugauuuguaggccucuucaaaugcuuaauauucuguguacuccuuuaacuccugucaacuaauuuuuccuccucccuaccccaucacuccauccucuuucuguagucuucagguucccccaucuucccaccuucccccccuucagccauuagucuggcucucacgaguaucauagauguagagaucauugcagauggugucucuagcucuggucagaguuucuccaccaaacagcacagcaaagggcccgaccacagaacaugagugaugccguaguccauggggccccuucugggaccccugcccacugcucacaagccuugcaagcuguuccaucaaaugaggagcaacaggugguuccuccuuggggagaaagaaaggacuguccgaagagaccugggcaucacaauuuuagccucuucccauccuaaacaagaugugugaggagcuaauaccuuaauuuucccaugacuccaaugcccagcuacuucugguucagcuaaguugcaaccuccaaagagcaauagcugaugaccuggaugggguccaggaguuuggagcagggccgcacagugaccugagcgugaggcuguguggcagccuucuugcuuguagcuguggacaugcagaaauucagggcugaguggguuuucuggaaaauguaagugccaccgcccuugccaaggauggauggagaagaggcauggggcagugcgguaggugggauaagagggaggguaauacuguagagagcucagcuagcuuaaacaugguagguuccccuggaaggagggugcuagagugaggagguggauaaauugccugagaaaucugcuuaggcuuuuguuuuucgagaguguggaugagagugaaagguuuugggcggagggugccauaccaauaggugcgggcgcugggguccagccuuaauguguagaugcuuccauagcgucgcugaguguggauaccgcccucccggccagccaccugcagcucucggucagagauucgggugcaggugugacuacugaggccggcgggggggcagucaccaggggucccuguccacgccucccacacaccgcgcucuguguccagugcggucacuguggccaagcggcgagacccgucccagccgcccaccacgcagagccaacgcccguccacgggugccgcgucguggugacugcgcggggggcugccccgggcucccaaucguacggccuggccccuagcugggucgaaaaccaccguaucgcugcugggcucucucgcuccuccugcuaggagaccaccuacgagauagaaccguccccgcaguucggugcaugaauggaaagcucuagccaaaagcgcgucccgcgccacuggccuccaggcccagccugagccugcggcccgacccgggggcacggccaccgccaugggccccggggagagggagggcgguggggucugcggcuuggaacgagccccuacauggcaggccaggcaccucgccuuccgcgggcuuccccgggaaccucccccuaccggacgccagccgggguucccaccucaagucccggcuuucucuccguggucgcccagcaaccacugcagcggcugcagcgcgaccgcugcaaaccgaaggucgcaaagcagcaguuaccguggagacaggac

SEQ ID NO: 12965 - RNA, 985 nt, Homo sapiens
ggcugcaagagggugugagccuuccauaaaucgucuguguggccuuaggcaagccacuuccucucucugggucucaguuuccucaucuguuaaacggugauaauaacgccuaccucuugggaaggcguuuuguagauuuaauaagguaaugaacugaaugugcuuugcaagcccaaaugcuccaggaguuccggucaccuuugcugucauuaucauuaugacugugcucccccagcucuggcagcaccccuaaugguggcugucccucucugcccccugcaggccggugccccgcgggugagcuggagaccucagacgugguaacuguggugcugggccaggacgcaaaacugcccugcuucuaccgaggggacuccggcgagcaaguggggcaaguggcaugggcucggguggacgcgggcgaaggcgcccaggaacuagcgcuacugcacuccaaauacgggcuucaugugagcccggcuuacgagggccgcguggagcagccgccgcccccacgcaacccccuggacggcucagugcuccugcgcaacgcagugcaggcggaugagggcgaguacgagugccgggucagcaccuuccccgccggcagcuuccaggcgcggcugcggcuccgagugcuggguaagcggggaucucuggguacggucugagccgcuguggaugcagggggaagcagagauggggacugcagagauggauggggcagagguagaacaggaauaaaaaguggggucauguucaggugagggagcuucauccagcuagcuauccucgcacccaauccagaaauucucuccaaguaaccccaaaagcuggggaagaauccauuuauuaggaaguucuuccuuccgacgacaugaaacucccucuguuacuuuugcccuguggcaauauggcacuggcuuauucucuuuucugcacaacaaccuuuccaaaagcagaggcccuuugucgugccccaccc

SEQ ID NO: 12966 - RNA, 385 nt, Homo sapiens
uuauuuuuuauuuauuuauuuauuuuuacaaaaguuuauucuuaaauguacaacagcuccaagacaacacuuaauuccagcuauacguggcaaaagauguuauggcagggaauagagagguuuaaauacagaugaaauaaagggucaccaucuccucaggcacaaggaacagcuuacuuuuugccagauuucuuaauuccaccuauggccaagagccccuuccccgcggccuucgcuuuuagcuccucgaguuucuucugcuccucuuuuuguuucugcuugaaagccuuaucuuccucguccaucuccuuggccuacuucuugggcuguuucaguggcuucuucuugccaccuucgcggccggacauggcgccugccgccgcuu

SEQ ID NO: 12967 - RNA, 5789 nt, Homo sapiens
accuggugcuagaacgaggucacuuuuauuuuucuuuuuguaugaaauuggggaugcaaccagaaggaaucacacagagauaugugacacagaccccuggggccugcucuugggaguaucaggaagaggcaagggucacagggcaggcuggggagagaaaagaggcagaugggaccagguaggauugucuagggguggagggaguugaggaaggacauccaggagcccuggagcugggggaggagcacuauccuggaggacuagagugucaggacagguggaucuggggaaaggauaugguguggcaagcaaagggcaugcucacacacaccaggaguugaagaaggagcaagaaaaggaaaggcguaagcagggaggaagcaagagagacccagcuagagcugcugggagccccucacucuaccccaaagugcacaacucggcaauaaauagcaauauuuauaaauaaauaaauaaguaaauaaauagaugaauaaauaaauaaauaaauaaauauacuuguagagcuaggaguuuggugcgagggaggagggagcacagaaaugcagugaguucauuucuucuaugcagguucuaaggcccuucauuccacugcugacccugagcuauagugcgcagguggggaucagcagcauggaguaggggcgcagaguugggggucucuucccuugccaaaggcagcucaaggaaagagaaaaaaauguaauaaguaaguccuagggccaggagaacugugcauuuucagagggcaacaauugggcauccuccuugcguuggggggaggaaccagugagggugcugcacauuuucagagugggcugagaugaggaagcagaagugagauguggcccacucguugccugagccuucugcaaauacuccgggcuguuugggaugucauccccuaauccggaaucuagguuuuuguuuuuuuuuuucucuagugacacacagggagggagaaaauugggacaguaggagucagagggacagggaaguagccaaauagcucaaagagggcaaggcacucacuaccaaguaagaucugaggucuguaugugcuaagccacaggaacaagauggacagaaacaggaagaguuuuuccauaauucccagcuacugagauuccccucacaggagucagggcaccaaccccugccuccccagggccucaccccucugccaagcacugagagacugagaucuuggaggaagaagcccacuccccacucuaaccccagccuuccucccuugcaauucugacagcccauccccaccaggggcaggagaagcuagaacagauaggauacacagcugaggucugugguggcugaaaauuuggacauagggguagaagaggcagcauucagugagagagcuugggggcagacuccaaguguggcuggcuuaguaaagccagcaaggauuccauaccaaccacacuagcaaacaauucugcacagcugggccucagcaauaaaccccggaaggaacccaggagaauagcccucgaggugccugggucagagaaaggaagaggcccucaugaccagccggugggcucucugccugugcccagggccuuugggacuccaugccaagguauaagggcucggggaggaugcggccuuucuaagcagugagcgguggaaaggggccccagagaggcccgggaggugggagacaggcugaguucagacguccagcacgugguucagguaggagauauagcagauggccaggcgcagaaucucaaucuuggagagcuucuugucggggggcagcguaggcagcagcuugcgcagcucggcgaaggccagguugaaggcuuccacgcggaugcguucucgcguggcgugggccgugcgguacuuggcuguggcgcggcgccggcgccggcgcuccucgcggcucagaugcugcaggucuuuccggccaggcucucccggcucugggccucgggccuggcccccucccggacccccaggcccggcaccaucagggcccgccccgcccccacagucacugaagcccgacucagucucugagugggugggcggcagguccagcuccauggugucugaguugagcaucaugauggaagcccccugcccugugagaucaggauccccuccccaccccucccucugggagcuugaaagcugguggugggagggggaggaagggggaggaagggucguggggucugccacugagcucuagaagucacugccacuucaggguuccauggucagggugccagucugaagccugaaaaagagaagagagaagugauagcagcggagggaggagggaaugcucagcucagaggugggaaagcagguuugagaugggcugggagggguaaggaacugugaaugugagggaagaacagcagaaacuggugggggucgggggguggggagaggccgagagacagagaggcagguggacagggugaaaggaagaggaggacgaaagguaguaagaagggaagagaaaacgaguaacaggaaaggaacagaagugaugagaaggauacaccaggcagguuaaaacugagcaagaggauuaaagacuuaaaaccauaaaacuccuagaagaaaacauagggagagaccuucaugauguuggacucagcagugauuucuuggaaaugacaccaaaagcacaggcaacaaaaagcaaaaauagaaaaaacgggaccacaucagacuuuaauuuauugacgaacauaaucaacagagugaaaaggcaaucuauggaaugggagaaaauauuugcaaauuauauaucugauaagggguuaauauccagaacauauaaauaaauccuacaacucaacaacagcaaaaaaucaaauaacccaauuuaaaaaugggcaaaggagggauugggaggggcgugaaaugagaaauuacagaauggguaccguguauguuauucaggugauggacauccuaagagcccugacuugaccauuaugcaaucuaugcauguaacaaaauugcacuuguaccccauaaauuuauauaaauaaacauuuuuuaagaaaaaaauggguaaaggacuagaauacacauuucuccaaagauuuuauacaaauggccaacaagcauaugaaaaaauguucaacaucacuaaucauuaaaaugcaaaucaaacccacuaugaaauaucacuucauacccauuaggauggcuacuauaaaaacaaaaaccaaacaaacaaaaaauaagucuuggcaaggauguggagaaauuggaacccuuaugccuuguugggauugcaaaaugaugcaaccacuauggaaaacaguauaaauguuccucaaaaaauaaaaaauagaacuaccauaugcuccaggaauccuaccucuggguauauauacaaauaaaguagggugucaaagagauauuugcacacucauguucauagcagcacuauucacaauagccaagagguagaagcaacccaaauguccaucaauagacaacagauaaacaaaauguauuauauacauacaguggaauauuauucagcccuaaaaaggaaguucugucacaugcuacagcaugaaugaaccuugaggauaugaugauaagugaaauaaaccaguaacaacacaaauacuguauagcuccacuuauaugagguauuuaaaguagucuaauucauagaaacagaaaguagaauggccguugccaggggcuggagggaggggguaaaggggaguuguuguuuaguggguauagaauuauacauuugcaggaugaaaaauugcuagagaucuguuucacaacaaugugaauauacugaacacuacugaauuguacacuuaaaaaugguuaagauuauaaauuguaugcuguuuuuuaucuaaaugaauaaauaaaaggaggaaaaaaucugagcaagacugcagccacagccccaagagaaguuagcuaugacucuagaugcuucccaguugugaggggagaauacaagccuuggcccugugguccccucccucucagggccccucuccacccuugcugccugagguggaggagcggauaaacacacagauugcccauuguagaauagacuaggacauauggagcucugcgcagcugccccagcucugcacagcuccccucccaguuccccaaaccuucccagcagaaccauuguagauaugagauccuguccacuaaaaccaggggaagauaucucuucucaccaccaccccacugugcacaaccagccucuuccuccaccucugucuucgaaauuuucagcccuugccauucccuggcccuuuuggaggcugggcaaggaagauuggggaaagggaacauaaucaaccuucuacccccauacucucccauagcccaaggaagguucagacacggccugcagaggacacagacagauuuuuggagcuacccuuaugggacucagcuaagguuugcuuguccuaggaccagaggagaucagggcaaggcagcacaaacauggccugggaaaagcuggggaaagggcuuugcuugugugcaguguuaaaggggaacagugggccacucaccaucagcucaacuaagaaugauuagaaacagaagcaccaaggugccugcaccaucacuaucuccccuuccuccccagcccuggcuuuccugucugauagauacucucaaagggguuaggauccucccaagccuugccccaccccaccacacagaagauagguucaagucaagccaacaaacagcuaugaagcucuggagggaugcaaagucauccacaucugaugacaaguacacacacaaucuuaacaggaaacagaaggugguuagugcugaaauugagaacacauuccauauucugggguucaaaugaacuauggggggauggcaauagugugggaggccccaaagucagcaccucccaguacauguuuagugcccccaacuccccaccccccaugcuggggcugggagcaggaguucagcugcggaguucccaacacauuuaucacaucuaucacaggcuaauucucucugcccggucccuauguuccuucaucccucaucacuuugccaugcccuuccuuccccucuccgugcuccccaucuggccccagucucaucuccaccuggccccauuguccuccccaguuccagucccggcagcagcuucuauuuacccaucaaguccucacccccaaauccacuucuggucucaaaguuccaggguccaaggaucaggggagcagcaauuccaagccugcaggacaggacuucccaccccacuucugccagcccuaacccaacugaggauagauaggcacaaagagucgaaggggaggaguggagaagagggacacgcggagacagggagagacacagcgcacaagggagagaacuagagggaggcucuaggaaggggcuugagccagagaaugggagggacacgcccaucccuccccgcccaugguuuccccuuuaccuagaaggacccugucaggggauccaagccggcaggacaaggggcagcguugacagccccagucuccucugggugcucaaggcucauccgucugcaaaguuagugaccagcuuucuagacucucagggguagcguggcauggcuguacaggcuccagggcagauaagagggguacacauuguggggguguagggcccagguggaaguggugggcuuggccagguacuggggccagccacacucacacacacacccucagacacacacaccugagcug

SEQ ID NO: 12968 - RNA, 54278 nt, Homo sapiens
uggcggucgcggcggggccgauccgagaguuccccuuagagaacggagcucacgggcggggaggccucaccugcuaguaggacgcagaaagacagaaggcgaaggagaccccgacuucccgggucagccccagagccacccccugccguagccaucuugccucucugcugagcggaagcccccguucggcuccugucuguuagcggccucucuaggcuaccacugacaccgucucuguggcccggagccuaagagaccggaaguucguguuuccaggcgcuuccggaaaccgcgggagagggucgcugacguggaggcguccgaagggcagcagggugugucggggcucggauuaagacaucggagucggagaccugagagauguuaaccaaauucgagaccaagagcgcgcgggucaaagguaguggagaauaaaagggggaacauggagguuggaugucaggagcggcgcugacaccggggaagagaaaauggguagagguguuggucgaaaugggcccaccagacggacccggaggaagacggagggugggagagagguugggccuggcuagcgguucuccaguccccucuucuuugguguguccuugggcuucgauuuaccuauaaaguggcucccacacugcaggggauuccuuagacccccucccuauucuuucuucccccuuucucucuuggcugugcucccgauuuguguuguucugcuccaaaggcccugugaucuguuggcuuuuugaugacuguguuauauggaguggcccugggaacugagucucgaucucuguuacucgcacccgagucaguagccuuuuuggagacgaguaguggcaaccucacuuaaggaggccuuggcugcagcaucucaacaucagugccuccauucggcuuuauuuacuacccggaaauaguacuugaggcuuauaaccccaauaaagucucaacuugauagaguugccagauaaaaugcaggauacccaguuaaauuugaauuucagguaaacaaugaauaguuuuuuagucugucguugcuuaccagaaguucaaauuuaucuggaaaucucguauuuuuauuugcuaaguacggcagcucuagagcucgagugugggucguuggggguggagggcaaauacugagaucgcaguauuagccucagaacguuagaaugugaaagucagagaaguaaggucuccgaagaccuggaaaaaauaguaucuagaauauuuagugagaugcagcguaacaaagugguuaggaacuuggucuuugaagucagaugggcuugccuuggaauccugagacauccacuaacaagcugugacuuggaugacuuacuuaaugucucuaagucuguauuuccucaucuguaaaaucgucuuuuauagagaguauuaaaaugagaaaguauauggaguguauuuauuacagcgccugguguagacucaguagcucaaaaacuggagguuguuaucaaugugugaauauauucugagcaguuucuaagucucuugggaaacuugaccuugaaagauggguaccauuaagaauuucugagaccuguauaggugaaaugugaaaugggucuucauaaucuuucaguuuucuuuucugcuccuaauuucuugcugggcaguacagaaggaaaaacaaagaugucauaauauuugagggcaaacauccauuguugaguguacuuauauaucauaauuaaaaaaaagaaccuaauggaaaaauagacaauuuagaagaaaaauuguaaauguucaauaaauaauuaaaauaguuccaccucacuaguaaugaaagaaaugcaagaaaaaaaaaguuaaguuacuuuuuuggggggagggucuuagauuuauaaaacaaaacaacaaauagcugauagcagccugugugcaaaaugggcaccuccauaaacuucaugagacuguauauugauacaguguuuuuacauuuaaacuauauguacuaaaauguuaagugcacauauucuauuccugagcaaucucacaggucuuuagccuagggcaguaauaaugcaaauaggcuagauuauguguagaaguaucuucaguaggcucuucugauagccaaaaauuggcggacaaaaugccuguuagaauaauauaaguguaguacauuugucccuuguaguuaaaaagaaugagguuauguuuauauguacuuccaugagauccauauuauauaguuaagugaggaagaaguuugcagaacaacaucauaacgugauccccacuuucauaaaauacuaaagccuaugucuauguguaacugcauuaaaaaucugaaaggauacacuucaaacuguuaguaguuguuaccucuggggacuuccauuuccagucaugauagaauaacaagagccagauuuaccuucccaccuuaacuauacaacugaacaaaauguaugaaacaaagguucauacauugcucacagauguugggcaacaggcagugcaggaaaauaauucuccagagaaggcaaauaaacaaggugaguccugugauugucguagauuacugccuagagaguuuuuaggcuucagugaagaggggaaucccuuggucuuucugaggagacauaaauuuagaguguggggaagcaaagauggcuagauuuuguugggcaaaauaccggagaagagggggcugcagagagagagcacuagagaucugcaggaugucuucucaggucuuuguuugaguacugaucugcaugugagaaaacuauucaaaaccugaaaaaggaccacuggaaaggagaaggcagagcaauccccagaguucacacuagugaacugggacuaguuuguguuccuacuugccagaaaggaaagacuuccuaauauuacagggcuucaaauagagaccucagauggcuauugcuuuaauagugguuccagauuaagccuagaaugaaggcugcuguagccccucuguaauaaaaccuaaaagcaagccuugaaaggaucaacugauuccaaguaacuuaauuguauccuagagcaaagcccaagaauauguaaaggaauaugacaaaaaucuaguaccaaacauaaaauucacgaugucuggcauccaguaaaaaaucaucaagcaugucgaaugaaugaaccuaggauuaaccuugauguuucuuuuucuuaucagaauugacagaaggugacaucauggggcuuaguuagcucauuguaucauuuucuauuuuuuucagggcucagcuuucaccccaaaagaccuuggauccugacuaguuuacauaauggggucauccaguuaugggacuaucggaugugcacucucauugacaaguuugaugaacaugauggugagauauuucuaggaggaaguuaaaggaguauaaguauuuauaauauccugggguauuuuaagccuuguuugacauggauuccucuaugauuaaagaauguggaaaugauagaacugaaaaauccugaauaggaaucaccuuagagauuagaaaggauagcucugucuaacauacauugccugccuucuccaccagguccagugcgaggcauugacuuccauaagcagcagccacuguucgucucuggaggagaugacuauaagauuaagguacagagggucugucauaacugagaauaaaggaaagaggaugugggaagguuugggaaucaugaaaggaacugaaagacaggaaauuucauucauacagagcucaggccuuugacaacauuauccggagaacuuacucagcaaacauuuauugaaugcuuacuguguaccagacacuguuuucuuuuuagggaauucaaaaauaaauaagaaauggcuucuguuuucaaggagcuuuuauucuaauacagaagauaaacauauauccaaguaauagcauguacaguuugguaagcaauauaauagagagauauucacagugaaauaggaaagagcaguauaggugcaaagacaaaaagcaugacacagcuagauacagggcagcuguuauugguuuuguauggagaaaaccuggagaaauggugagagaaggggcagaagaugagaggggccagaucauggaguaccuguuuguggcgcucaggaguuuagauguuaucaugcagauaacuaggagccauuugaggaacuuaaauacaggagugauaccagauuuauauguuuuuaaaaugauuacuuggugguaauuaaagaaaagauuggaugauuugggcaagacaggaggcaaaaauaccaguuaggaaaccugagcuuagguaguagcauuugaaauggagagaaggagauggaugugagaauuuaaggaaaugaaucagugugucuguugggugauggccaauaaggagaaauaaaugagauggccaauaaggagaaauaagggccaauaaggagaaauaaaugagcugacuuucaggcuucuaguuuaggucacuggguaaagggggugucauuaacuaggaaaggaaaaucaggaggagauaguuuucuggaguggaagagaauggauaaugaauuccaucuugucucuggugauuuugagggaccuaagggacagucuaguugaggugucugugcuagaaauauauuugugauuugucgucaugaagggaggagccaaaggagaagcaguagaagauauugcucaaggaguacguugaauaagaagacagaccaucauuuaagggagagagaggaaguagaguuaguaugggaaacagugauucgagggguucgagaugaaccaagagggagaagaagccucuuggaugccaaggaagaagagaauuuugggaaggagaaaguguucagaauaagaucaagauugagaaauaaccuuugaauugcuuaauuuggaaggccuuagugugaaaugaggaagcagacagaauauaggcaauucuuuaaagacaacugacuaucauaauagcaaaaguuagagccagagacuagcaaccuauaaaaauaaaucaaaauuuccucuguuuacuuccuuuaguuguuuucauuaagucuaugugucaaaccgaaccagugaaauuuaauucauaaaaagguaaagucuuuucauaagcaacuucaagaaguuauauauugugauuauaccgcagaacuuaggugaugggaguaaagagugacagcugccuacagagaaaagagcuauuagaauuauaggaaggacauuucuuucuguuuucuaguuuuuaggcaccacauccuggggcaaucaaaacucaaaccaccugacagaucucaaaagcccauaaggauaucaccucauuauaguauuuuuguauuuguuauuuauagugaugaacauugaguaucaagaaugguuaacuugggauucuuauaaucuguuuaaaaaggaaaaacuggguguuaauuaagaaaaaguuuucccaaaaugacuaauauuuuggaaaagaaauuaucuuccacuuaugaaauguccagaauagguaaaucuauagagacagaaaguagguuagugauugucuaggguuggagggguugggaggaaaugagaagugacagcuaauggguaugaauuucuuaggggagugaauaaaaauguucuaaaauggaugguugcacaacugugaauauauuaaaagccauugaguuuuauacuuuauaugaauaaauuguaugguauuugaacuguaucucaauaaagcuguuauuaaaacaaaggaauucuuuauuagcugguagguguguagugcuaucauuugguggguuuuuuugguuuguuuuuuguuuguuuguuuguuuguuuguuuguuuuuugcgauggagucuuguucuguugcccaggcuggagugcaguggcgugaucucggcucacugcagccuccaccucccggguucaagugguucuccugccucagccucccgaguagcuggaauuacaggcaugcgccaccaagcccggcuaauuuuguauuuuuaguagagaugggguuucuccauguuggucaggcuggucuugaacucccgaccucgggucgucuuccugccucggccucccaaagugcugggauuacaggcgugagccaccgcacccggcccauucggugguuuuaauuaauuucucugaugacuaauaaacuugaacauuuuuccauaaaaagggggauuaucuagaaaagucaugucuguggaccaucuuauugcuugcuauauccagauaaauguagcauuaguuauaauccucguugacaaagaguaagacaaggagcccagcaaauggucagaguauucaucuaaaaccccuauaaguuuuuaaggauuuacaguuuuggagcuugacuuaggccauuaaaggagucaagacauuuugaaacuagaaauaugaaaguuuaaaacacugaacucuauaaggggaaaaaagucaguuaaagaauaguguuuaugguauggucuaauuuuuaugugaaacucuacuguguacauguguauuuauauguagcugauugaauagauagaggcaaagguauuggaauaccuuaacuuuucauguuauucuuauuuccauacauaaugcuuacugagcacuuaccuaaugucaggcacuguguuaggugguaaggguauaguguugagcaugauggacaagaacccugccuuuaaggaacucagcauucuuguuuggaagaucauacuuuuggauugucuggacuuguuauaggaaaugaaauuuuuauaauuuacugaagaaaaguuaaaaauuagaaauaguaacaagcuggcccagauugauuauaaacaaauauuaaaaagaaauuuaaaaaaauuaaauaagaagaaaaaugcaucuggucucuuauuuuuguacauuuuaggggauuuucugaaugaggaagauaagcuauuuuauauuuaugauccugguuuucaugucuucaguuguguucauugaugccuaguacuuugguaguugacucaacuucacaucugaauaugauauuguuucucugcuuagcucaggcuuacugagcaauguaguauuuuccauguaauaaguuaaggucuguuugcuugacaggugaguacagaccacacauguaugggcguuguuugccaucaaguuaggagccuaagaagcugaugcccuauauuauuguuucccuuggagucaugguaucuaucuguccuacuuuuuuuuuuuuuuuugagaccgagccucucucugucgcccaggcuggagugcaguggagcgaucucaacucacugcaaacgccgccucccagguucaagugauccugcugccgcagccucccaaguagcugggaucacauccggcuaauuuuuuuuuguauuuuuguagagacaggguuuccccauguuggccaggccggucccaaacuccugaccucaggugaucccccugccuugaccucccaaagugcugggauuacagguaugagccaucgugcccagccugucauacuuuuuaaaagugauggguaaagcacuuaaggggucuauauucaagccaagagcacaauuuugcaguagaaaaaagaguugcaaaucaagcccuggauaaauaucuccugcuauuaaaugcagauggcuucuucccaaagaaagaaaaacuuuuuuuuuuuuuuuuuuuuuuugagacugagucucgcucuguuacccaggcuggaguacaauggcaugauuucggcucacugcaaccucuuguauccugaguucaagcgauucuccugccucagccucccgaguagcugggacuacaggcacaugccaccacgccuggcuaauuuuuuguauuuuuaguagagacaggguuucacuauguuagccaggauggucucgaucuccugaccuugugauccacccgccucgaccucccaaagugcugggauuacaggcaugagugaccacgcccagccugaaaaacuucaauaauuuuaucuuuagcuuuucccuaauccuaccccaaccccauguuguuuaucugaccuauauuuucauucuuguucuuuuccccucaaaucuuaaacaaggcuuucuaccaagguuccuaccuauuuagaaaugccaaaauacaaauaauguauauaaaucuauauuuauauacauauuucuaucucuguaaagauaucaauuucucugagccuuuuagaggcucaauaacuauuucuguuucuuaguuugauuugucuuugcagguuuggaauuacaagcuucggcgcugucuuuucacauugcuugggcacuuagauuauauucgcaccacguuuuuucaucauguaaguagucaugguggcgcuaguuuuggagcauucuuaguuuccccauaguaaucuuuauuugauccuugagaacccauguuuuaauaauagaguuguuuuuggaguggcucuucuacaaucugugugguauuguccuuucugcuuuuuuucuuucugcaaaaggaagcacuugggauuauacugaauuuaauuuuauuggauucaguggauucuaugggaagucauuguuucucuguagggaaaaguagggauuugauuucagauuugcugaaccaaaaaacaaaaguuugccagcuaaucccauguaggguauuauuaguaaguaguaggugugucuggaagaaggucagacuaagaugccauuuugaucagcuaacaaacguuucgaaguauuaacaaucauaccccucuauccuaggauuuuugggucugguggaggcuguucccuuagccaggcuuacuacuuucuuugaucugccagguaacauaguagauuuagauagugaggugcagauuacagacucccaaccucugaauccaguugcacccugacaggaucuccuuauaguucuguguauuagcauuaacuuacacuauucuuugauugccaguaaauuaagucucuuuaauuaaguuagaaagaauaugaugaaauaaacaauuuacugguugaguauauauuauuucuuuuuuuaauuaaaaaauucuaggauaggagagaaugagaaaauuacagcuuaaacauuugagaaugauaaccacucaauaagauaacuuauuaaguaggaauuauuugucauugccauaaaggacuuccugaagacccuugccuagaacaaguugccaucuaccuggaaaguuacgaaagaccuuauuuucuuucauuuuaccagcucacuaaauaugugugugccuuauacuugcuaagcuuugugcuaaauacugaagguagagauacuaucucuauugaaaauagaaauaccaucuauuuucaguguuuaacacaaagcuuagcaaguguaguaagaaggaaguguaaauaagaaauacuuccuuuucucaacaaucuuauagacuccaaaaaggcuaaauugucuuuacauguuacuuucugcuuugcuugcugagaccugggaauuuuuugaaacuggacagaaagaagucagacaauaaaauaauauucccauccuagaguuaaagguagaagagucuuucacaggaucuuaauuuacaugauuaacuguauauaaauacacacacacacacacacacauauagaaguaaauguaaauguauguuucacuaucugccucugagaauguauugugccucuaacuggcuuccauucuuaagucuuauaggugaaagugccgaaguugagaaaagcuguuagagugguagagaaaaggagacagcuaaccugauagcaaaagcagcagccccuuugcuaauguagcugagccguuaagcaaugcaguucuuuagagaaaaaugauuacaagaaccugauagaacagauuuguuuaauguuuaaagccuuugucuggaauaucuuucaggaauaucccuggauucugagugccuccgaugaucagaccauccgaguguggaacuggcaaucuagaaccuguguuugguaaagcaggaggcagagggcucgaaaagagucuucauuuuuccuaguuuuucauaaugagcuucucuuagaacaaucuucucccuucucaaauggacuaugucggcugauuaauuacugauuguauuuguaggaugcuuuuaagugcaaaauaauaaauguagaggcaaucccauauaugaaucuggacuuccaauaauuucuuaccaggaagagaagucauauagccuuuuagaacaagaacuuuuagcugguuuucaauuauuuucccauaaaaccugagucaaggucuagaccuuugucuuauuuuguguuuggagcuggagcuuuacauagaacuuuccaugaagaguuagggaccauuuaaagugauggccuuggcccggcgccauggcucaugccuguaaucccagcacuuugggaggccaaggcaggcaaaucaccugagguuagaaguucgagaccagccuggccaagauggugaaaccccgucucuacuaaaaauacaaaaauaagcuggacgcgguggcgugugccuauagucccagcuacucgggaggcugaggcggagaaucgcuugaacuggggaggcagagguugcagugagccaagauugcgccacugcacuccagccugggcaacagagugaaauuccaucucaaaaaaauaauaacaauaaaaaauaaagugauggccuuuaaaagggauacccuacuaaaaucucacagauaauuuacaguauggauuacugagauuacauuuauuuugauauuuuaaaauauuuuugagagaagagcuauguaaucuuaguccuccugaaauuaguaauauuuaaauacuaaagcauuagaggcaagaagagaacuauuguuaaaauagcugacugggcuuauuauuauuaguucagaauugguaggaugaccugccuuugucuccauaaaaguaaaacuggauaagcauuuauugaauauggagaaagguauuuaguuuaggagucuguugacuuccaccucuaauuugguauugucuuuuuuuuuucuugcaguguguuaacagggcacaaccauuaugugaugugugcucaguuccaccccacagaagacuugguaguaucagccagccuggaccagacugugcgcguuugggauauuucuggugagcugcccaaguucagaggacaaccuggucaucucuggugcaaaacugcaauugcuuaaaauagugaggagaguugacuuagaacuggaaaauuuagaauauucuguuuuauaauagcaucuuuguuucugagguuguugaauuugcuuugaugguucuucauauuggaagucuucucuaagaaaagagguaacucuagaaaauucauuugauuugaagaaauuuuaacuuucuaguuacaucagcuuuuguuaaaaucuauuuacuguugcaacauuugauuaagaaucaugcuuuccacucaaauaagaaaaaauacaucuaugacaaaaagaaauuuugagaauagauuaauacagggaaacaagacucuuggacccuaucgcuuuauuuaaaaauaguaaaaucucucuauuacguuucuucuagugcggggagcaugguuggguucuaggaguuggugacuuuuauguccagaauaccuuuuuuuuuuuucugagagggagucuugcuuuguugcccaggcuggagcgcaguggugugaugaucuuggcucacugcaaccuccaccucccggguucaagcaauucucccucagccuccugaguagcugggacuacagaugcaugugaccacaccuggcuaauuuuuguaucuuaauuagagaugggguuucaccauauuggccaggcuggucucaaacuccugaccuugugaucugccugccucggccucccaaaguacugggacuacaggugugagccaccguggcuggccuguuuuuuuuuuuuuuuuugagauggagucucacucugucucacccaugcugaaaugcaguggcgcaaucucggcucgcuacaaccucugccucccggauucaagcguuucuugugccucauaaguaacugagauuacaggugcacgccaccacgcacagcuaauuuuuguauuuuuaguagagacaggguuucaccauguuagccaggcuggucucgaacuccugaccucaggugauucuccugccucagccucccaaagugcugggauuacagacaugagccccugugccuagcccagaauaccuuuuaauggacagauuuaggacuagaaauuaaauaauuuauagauuauggauaguugggauaauuccuccuuuuacaguuuacauaucuuuauuuugagacaaggauuuaaauguuuagucuuauauagaggagaucuaagaaagugcuaccuagagaauuuaaauguagagaauggacuguaccugugagaccuauggaagcgcuucauguuggaauagggaaaucaaacacuaaaugcuguaguucucugaccaguuaguauuuguuguuucuuucuuucuuuuuuuuuaacuuuuauuuauuuauuuuugccaugugccaccaugcccagcuaauuuuuguauuuuuaguagagacaggguuucaccauguuggccaggcuggucucgagcuccugaucucaggugauccacccaccuuugccucccagagugcugagauuauaggcgcgagccaccaugcccagccuguuguuucuuuguauucauuuccuuagaaauucuuggagauuugaguucuuugaaaugucagugacuggacuacaaaacauguuucauucuaugaaaggaaggccccccucauagaucuuuguuugguucuuuguaauaaaggagucauccucugcauuguacagcugaggugauaacuauucccaacuccauuguggcaugggggacuggggcaauaauggcacuuguucuuauagaccauuaaugaacagcaagcugaaaauuuggauucugagauacagcauuuggaauacugcaauagcaguuuagguuaauguagcauagaaacaagacaagaggagauggggacaauuguagaguagaaccucuagauaaugcugucuuuguaguuuucaaaggcauagaaugaaagggaggaguauaaacaagagguauuggagauagggcaguuguauucucuuucccuagggcuuugccauugcaguuuuucaucagacugacaagguuuuuugaaguacacccagaugugaccagccaugccaacaggaggagcuagacacaggcacugugaaccuguguccucuccucacugccaguaccagggagcuuagcaucuacucucccaguaaccuugcuauggcuuuccaugguuuuucacugugcacacauucaaagcacucucucugucucaggauauaggagccugaugggcuuggaucccaauucaugcuauuccagcugaucaggggcaauuuuuuuuugggggggguggcgguggggacagagucucacuguuacccaggcuggagugcaguggcaugaucucagcucacuacaaccuccaccuccuggguucaagcaauuauccugccucagucuuccaaguagcugggacuacaagggcaugccaccaugcccagcuaauuuuuguguguuuuuaguagagacaggguuucacuauuuuggccaggcuagucucgaacuccugaccucaagugauccagcugccucagccucccaaagugcugggauuacaagcacgagccacugccccuggccggcaauuauucagaauauccuuugucaaccuggauucugugagagaauuaagugcuauagaaaguacuuucaguggcuguuuucguaguucuucuaagaaugguauauagcuaaugcuauucuaguucauagagaauuuguuacauaccuaaacugaugccuuucgggcauuaaaacuuaauucuuuuccagaacgccggguugagaagggcuccacuguaaaaguaauguuugugccaccugaugccagccuugcauguucccugcagucuagccaaugcaguuugggggcagucaggugguuggauucuugguggucaugaaaugcucaaggcaugaaauacuuuucuuuaccuuuugcagacagagaacauuuuuacaucaaaauuaagggcccuagaucagagaagagagggagugugaccccaugggguuuauacuugcucuugaaugugugaagugcauggauuacuauguaauaaccuugcaauugcuauacuuuauuuaugugauaguaagaauuuugugcuagcuugcuguacuaauguuaaugcucuuuuuaccauuucuaaguguuguucuuuacccacaacucuugacuuccaguaaccccuuaaccagaguggaaggagaugcuuugguauuuaacaaagugcaagaagcuuuuggguuagacuuuuauacuuuccuucucuagaaaucagcauauucuuuuucagcaggguucuuuuuugcuauuggguucaaauaagucugaaaacaggaagaggaauuagcuuuccgaucuguuaaagaccagugcuuauauuucugaaagggagaaguuaguucugaaugagaguaugaauacucccaaauuuagaggacuaguucuaauuuuuuugacuauuuuuuuuugaaagggacacucucugaguuaguuaagcaguaagagaauauagagaucuuuaaaggaaaaccuaucucuugguaccucucccauagggauugaaccccacagggcuuagcuuaaccugaaucuuuuguguuacccuggcaaaaacuauuuguuuaaaagggaauguauuuacaaaccuacauauaaaagguuacuuucuuaacuugagcuucuaaguaaacugacaguuaaauuauuuuaauaugcuuauaccuuugcaugucaagcccauguaauucaggcucagucucugaaaaggcuacuaaaaaaguauuaauuugcugccaaauccuguuaucaucccucucuuuuuccugcuuucccugguccguauugggaggugugcaucaaacugguccauucugagaguguccucuccucccucuggauuuggguagcugcuguagaaauuuuccaucugucguucaguccuagcgagcggcuuguugaaggcucaaauauuucuucucugaguaucuuuucacugccugucaccauucaucugucuguuuuugcccuuccccuuuucccggaucauuacacgcaaaugcaacaaagccuuccauucugucauacggcuuuccuuuuaauguguuuguugaagcuuauuggaggugaaguuucucacagcugucuaucuuuguauuuuccuuugaaucuguuucauauaccagacucguuagaaaaaguugacagaucuuauuaaagggacaagugaaauaagugaaaggaggcaucccagcgauaaaguauuuaugagccuuugggagaguauauuguaaaacaucagcuuuauuucucucuaccuacuggcuaaaugcucaucuuggacagaggacaagauaauuaaaauuguuguggccuucuaagcucuugcuucuccaguguuaacauguaggugccaccauaacagaagagauauauuauaauuuuaaaacaauaaauauaaaugcaguuauuaaacuuaaguucuuauauuuuccuacagauggcaaaguuuaggcuuaaaaugacuuagguuuucuuuccuuuuuuugagacggaguuucacucuguugcccaggcuggagugcaguggcgggaucucagcucaucgcagccuccgucucccggguucaagugauucuccugccucagccucccagguagcugggauuacaggcaugcaccaccacacccagcuaauuuuuguauuuuuaguagagacaggguuucaccauuugagccaggcuggucucaaacuccugaccucaguuguuccaccugccuuggccucccaaagugcugggauuacaggugugagccaccgugcccagccuccuuuuuuuuuaauuugagacggaguuucguucuuucgcccaggcuggaguaaaguggugcaaucuuggcucacugcaaccuccgcgcugcgccccccccagccccgccccccggguucaagcaauuccccugccucagccucccuagcagcugggauuacaggcaugcgccgucaugcccgacuaauuuuuguauguuuaguagagacgggguuuugccauguuagccaggcagaccucaaacuccugaccugcggugguucaccugucucagccucccaaagugcuaggauuacaggcgugagccacugcgcccagccuuuagguuuuauuuucaaugagaguuuuuauuuuccauuacacauaacugucuuuuuaaaaaauauuuacaagugcuagguaauuucaucuuccacuauucccccaaaauacuucaaaauauaggauuuuagucucaauucuuuuuuucucaucuacaaacuguuauaauuuuaccugcuuguucauuccaaagguuuguuaucagaguccaguuacauaacauacucucugaaaaccacaaaguacuuuccgaaugugagauaguagcagugcuaucauaauuuugguucugacuauagcacaaauagcuuuuaaagauagauuuacuugagccauauauguggguccucuacaaauaagacuauuauuauucuggugucuuuuuccaucguuuuuaaguuacaggauaauuccucccaguaaaacuagccuccaaagguuuuaauggcaaaauccaaguauucaaaucuauaaucagccuuuuaagcaggaacuuaaaaugacaugacaguuuuaauuaucuuguucuucguccaagagucaaguaguaggcaugaguacacuuuuuacauggcuuaugguuuuacguuaucuucuaccaaacagcuguuuuguacuuaauaggccuaguuucuguaacccauuuggaacuucccccaucagcugucgaaaggcuucaaguugagaaacacugcacuguggcuucuucaaauggcuuuucuuuuuugagauagggucucaaugucacccaggcuggagugcaguggcgccaucauggcucacugcagccucgacuuccugggcucaagccaucccccuaucucucagccucccaaguagcugggacuacaggcucgcgccacugcaccuagcuaauuuuuauauuuuuuggagagacgggguuuugccauguugcucaggcugaucuuuaacucuugggcucaagcgauccaccugccuuagccucccaaagugcuaggauuauaggcgugaaccaccacgccaaccucaaauggcuuuccuuuaaaauuucuugagccuaguccgaagauagugaguuaucucaguugauuguucacagucaguuacagauugaacuccuuguuccacucuuuuccccauucucacuacugcacuugacuauucuuuaaaaaaaagaaaaaaauuucugaaaugaucggggaaaagcugcuauaaauuuuaugaaguugagaguagaaauugaauguuuaccauuuggggccacauuucaagaacacugaagaauggaaagugggcauuaacugaagcagacaccucuugagguaagauuuguggaagaagagguuaaagugugccagaaauuuggguuacccuccucuagaaagaaauuccaguaauggaucuguuuaaguguuaagggagcagaagagaagacggugaauguacuucaauauuuugaacauuuuuagaaauaggaauucuugagucucuuuucuuucuucagucuuuuccauuucuuuuucuuuucuuuuucacuguaauuucuguguuucugauacugugcuguuuuagauaauauuauguuuacaucuuucaucccacuccuuaucccuucaaaggucugaggaaaaaaaaccuguccccuggugcgguggaaucggaugugagaggaauaacugggguugaucuauuuggaacuacagaugcaguggugaagcauguacuagagguacuuaucuuuauagccaggggcugaauaugggcugucaucuugggaaagucacaguauguuguucauuuauucauuccuucaacaaauauuuacagagugcuuauuaagugccaggcacuguuugagguacuagaaaucaaauugugcgugaaccaacagagaaaugaagcuuaugugccaccugagggagagucuuauuaccuuauaaacccagugggaaagggagaaagccaggcguagaccucaucaccaucccaaagcagagcccauucucaagcuuucuguaaggcagggcagcaggaaauuuaaucggaguuaucgagaaccagccauguguaacuuuugugcaggugggaaaacagaaaagcauaagggaaagaaacuaguuuuuguucuaaaaaauuaucuaaucuucauagcuacccacugaaguagauauuauuaucccuauuuagcagacaaaaaaaaaaaagagauuuagagaaauuaaguggucuaccaaaaucuacauauaucuaguaaauaaauguaagaaauaagauuugaauuucgaucugacuccaaaacccaggugcuuuucgcugcaucaugauacaucucaauaauacugcuaauucaaaacugccuuauccaggauucugucacaauauaccauauaacuguauaaauaggguauacaguaucuuaaaaucagcaguucuuaaacuuuuuggucugaagaucucuuuauacucuuaaaauuuauugaggaccccaaagaguuuuuguuuauguggguuauaucugucaauuuuuuaccacauuuuagauuaaaacaacuuuuaaaaacaugaaauauaucagcacacauucuauuagcugucagagcgaugauaucacauaucaugugcugggaaacucuauuguauacuuacgaaagaauaagaaugaagaagauaaauaggcugggugcagugggucacaccuguaaucucagcacuuugggagaccgaggccagaggauuacuugaggccaggaguuugaaaccagccuaggcaacauagcaagaccuugucucuaccaaaaaaaaaaaaaaaaaaaauuagcugggcgugguggugcucacuuguaguccuuugggaggccgagguaggagaaucacuugauccuggaaguuugagacuucagggagcaauuaauaugauugcaccacuacacuccagccuggaugacacagcaagaccucaucuuaaaaaaaaaaaaaaaaaaaaaaagaaugaagaagacaaagucuuaguaauauuaugaaaauaguuuuuaccuugcaaacuucuuaaaauaaucuuggagcuccuucaagaccagacugagauuucugcauuaaguuauaaaaguuuucgggcgggcgcaguggcucacgccuguaaucccagcacugugggaggccgaggcaagugaaucaugaggccgggaguucaagaccagccuggccaagauggugaaaccccaucucuacuaaaaauacaaaaaaauuagccggguaugguggugggugccuguaaucccagcuacuugggaggcugaggcagagaauuacuugaacccgggaggcagagguugcagugagcugagaucgugccacugcacuccagccugggugacagagcgagacuccgucuaaaaacaauaaaaaauaaaaaauaaaauuugucuggagauauuaauaauuauuuguagaaauaagauaaaaauaggcaaguaaaaaacaaagcagaauauccuaaaugcaaaugaggcugaguuuagggguuagaaauauguauuuggaaauucacaugagaauuugggguaauauuggaggacagacaugguaauucugaugcucaaaauuuuagagcagcguagucucuugaaucuguucacaugaagaauaaaucagagacauuuuuuacaacgaguagcuugauucauugguuugcuuugaguaaugacuauaaagauguuuuagaagaaccacucuuuucuacagggucacgaucguggaguaaacugggcugccuuccaccccacuaugccccuuauuguaucuggggcagaugaucgucaagugaagaucuggcgcaugaauggugagugaaccgguuacauuaucgccauaucuaagaaacugccagccagcaagguaaaguagccaggucuucuggacucugaccuauuuuucuaccuuaggugauuaauuaaugcuaaucccaggagcauagaaauuauuuuacaaauaaaauauaucaucuuuacaauuuuuauguguacaguuaagugguaauaaauauauuuauauucuguuuuccuccauuuccuccuucacccuccuucccauucuacucucgaucuuaauaauauccacuuuuuagcuuccacaugugagugagaacaugccauauuugucucuuuguucuucccuuaacauaauggccuccaguuccauccauuuugcugcaaauaacaggauuucauucuuuuuuauagcugaauaauauuccauugugugugugugugugugugugugugugcacgugcgcguauguaauuuucuuuauucaucccuugaugagcacuuaaguugauuccguauuuuggcuauuguaaauagugcugcaauaaacaaacauggggaugcagauaccgcuuugauauauuuauuuccuuuauuuggauauauagccaguaguggaauugcuggauaauauguuaguucuauuuuuaguuuuuugaggaaccuccauacuauucuccauugugacuauacuaauuuacauucccaccaacagugcaggaggguuccccuuucuccauacccuugccagcaucuguuauugccugucuuuuugauacaagccauuuuaccuguggugaaaugauaucucauuguggauuugauucgcaugucuuuuuuucuauauauauguauauauauuucagccucuguguuaaggacacauugauuugcauuucucugauaauuauugaugagcauuuugcccagacaauguccugggacauuuccccaauguuuucuucuaguaguuucauaguuucuggucuuagauuuaagucuuuaauccuuuuuugauuugauuuuuguguguggugagagauaggaguuucauucuucugcauauaguuacccaguuuucccaacacuuuauuguauguucuuggcaccuuuguuaaacaugaguuagcuauagauuuguggauuuauaucuggguccucuguucuguuccauugguuuaugugucuguuucugugccaguaccacaguguuuugguuacucuagcuuuguagcaaauuuugaagucagguagugugaugccuccaucuuuguucuuuuugcucagaauugcuuuggcuauuuggggucuuuugugcugccauauaaauuuuaggauuuuuuuucuguuucugugaagaaugucuuugauauuuugauggggaauacaauaaaucuguaaauuacuuuagguaguaauuuacccuaucauuuuuacaauauucuuucaacccacaagcauggacuaucuuuccauuuuuggggguccucuucaacuuuuuucaucagaguuuuauaguuuuccuuguauggcccuuucacuucuuugguuagagugauuccugggcauuuuauauuuuuuguaguuacuauaaaugggauuucuugauuuuuuuucagauuauucacuauuggcauauauaaaugcuacugauauuuugagacaggaucucgcucuauugcccaggcuggaguacaguggcucgaucuuggcuuacugaaaccucccccucccagguucaagugauucucauacuucagcgucucgaguagcugggacuacaggugcacaccaccacaccuggcuaauuuuuguacuuuuuuuagagacgagguuucaccauguuggccaagcuggucucgaacucuugaccucaagugaucugcccaccuuggccucccaaagugcuggguuuauaggcaugagccacugcaccuggucaugcuacugauuuuuguauguugauuuuguaucccgcagcuggacugaauuuaucauuuugguugagucuuagguuuuucuaaguauaugauaaugucaucugugaacaaggguaauuuuuccaauuuguuuguccuuuauuuguuucucauaccuacuugaccuggccaggacuucuaguguuuugucgaauaaaagugguaaaagugggcauccuugccuucugguccguagagaaaaggccuucaauuuuuucccauuaaguguaauauuaguuguaaguuuaucauauauggccuuuauuguuuugagguaugcucuuucucuacccauguugauaauaacuuuuguuauaaagggauguugaauuuuauccaauguuuuuucagcaucugcuuaacuaucauaugguuuuuauuuuugauuuuguuaaugugauauaucauguuuauugauguauauugaaccauucuugcaucccugaaaugaaucccacuugaucuuaguaaaugaucuuaucaguauacuauugaauuugguuugcuaauauuuuguugaggauuuuugcaucuauguucaucagugauaucggccuguaguuuucucuuuuugugguguccuugccugguuuuguuaucagaguaaugcuggccucauagaaugaguuugaaaauauucccuccucuuccuuuuuuuuuuuuuuuuuuuuuuuuaagaguuugaauaggauuggcauuaauucuuuaaauguuugguagaauucagcaguaaagcagucagguccugggcuuuucuuugaugggagaauuuuuauuaaggcuuugaucuaggcacugguuuuuagaaguuuuucuauuuuaucgugguucaaucuuuuuuuuuuuuuuuuuuuuuuuugaguuggagucucgcuguguugccuaggcuggagugcagcagggcaaucuuagcucacugcagccuccaccuccuggguucaaacaauucuccugccucagccucccaaguagcugggacuacaggcugugccaccauacccagcuaauuuuuauguuuuuaguagagacaggguuuugccauguuguccaggcuggucuugaacuccugaccucaagugauccaccugucuccaccucccaaagugcugggauuacagacgugggccaccaucccuggccucgugguucaaucuuuguagguuguaugugucuaggaauauauccauuucuuguaaguuuucuaguauguuggcaugucauucucguaauaguuucuaaugauucuuuguauuucugaggucucaguuguuauguuuccuuucucauuucugauuuuauuuauuuggaucuucucuccuuuuuccuuaguuggucuagcuaacaguuuguugauacuaucuuuucaaaaagcaaguguuucguuucauugauagucuguauuuuuuuuagucucaauuuuauuucugcucugaucuuuauuguuuguuuucuucuacuaauuuaggguuuggcuuguuuuuuauuaucuagguccuugagguguaucauuagauuguucauuuggagucuuuccuuuuuuuuuuuuuuuuuuugacauagguguuuauguuauaaacuucauucuuaguacugcuuuugucauaucccauaaauuuuguuacauuguauugccauuuucauucguuucaagcaauuuuuaaauuuccuucuuaauuucuucauugauccauuagucuuucaggaacauguuguuuaacuuacauguguuuguauuuucugagguuccucuuguuauugauuucuaguucuauuguguucagaaaagauacuuaauauaauuucuauuuuuuacaauuuuuucaagcuuguuuuguggccuaaaguauaguuuauucuggagaguguuccaugugcugaugaaaagaauauucuguagccguugggugaaauguucuguaaauugcaguuaggccuauuagaucuaguauguaguuuaacuccacuguuucuuuguugauuuacuguauggaugaucugucuguuuuugagagugggguauuagcucuccuacuauuaucauauuguagucuaccucuccuuuuggaucuauuaguguuugcuuuauauacuugggagcuuugguguugggugcacagauacuuauaauuguuauuuccucuugcugaauugaccccuuuaucauuauauagugaccuucuuugucucuuuuuacaaucuuagguuugguagucuguuuuaucucauguaaguauagcuacgccugcucuuuucugguuuccaguuucauggaauaucucccacuccuucguuuucagucuaugugugucuguauagguaaauggguuucuugagggcagcauauaguuaggucuucucucuuuauccguuuagccacucuaugccuuuuaauugaagaauugagagcauuuacauucagugauauuauugauaagcaaggacuuauuacugcuguuuuuugcuuguuuucugguuuuguuuuguuuuuuuuugaggcuucucucuuccuuuucuuacugucuucuuuugugguuaagugauuuucuuugguaauaugucuuaauuugaugcuuuuuauuuuuagugaguauauauuaauaguuuuugugcuguaauuaccaugagauucacaaaaaaaaaucuuauagauagaauaagguauuuuaaagagaugacagcuuauuuuauaucacaaacacaagaacaaaaacaaaggcuaaaacacacucagaaauuauacauuuaacuccauuucuguuccugccuuuuugacuaucucuuuaacauguugcuauagcuauuauugcuuuugauauauuugucuuuugggcuucauaguaaaguuauaaguggauuguguaccaccauuauaguaauauagucuucuggguuugucuaugaacuuaauuuuacaucuuggguuuuauaucuugaaaaguuuucuuuuugcacauuaguguuuuuuuuuuuuuuuuguuuuuuuuuuuuuuuuuuuuuuuacaaauauuguuuauuuuaaugaagcugguacagacaauguccauuuaaaacccauaucccaggccaaaaaguacaaauaaaaucaaaaagagcaguguucuguuguauucauuucugcauguauagcuuuauuaauugcuaaugaaaauuagaacuuuucugggaucuucugacaagauuuuuaaaaaaucuuaaaaugccuuuucuucaaugaagccaucuuuggaguuagucauuacucucuccuuaucaguuaucuugacuucaacccgauauuccucuucuuuugguccagacccucaaauuuaagaguagcuugaaguuaaggaaaggucauuuuuccacaguuucaguucucugaaacacuuccaucucccacugaaagucacaguccaggagugaaguaaucacaugcuagaacaucagggccaauucgcaaguuauuaugaacgcuugcauuggucaaucuuauuuaucaccacaagccugaaaaugcaauguccugaaaaaggugggcucucugugcacacguaauuuuuaaaaaggagaggguaauaugaaggggacugaggcuugaucaccaaaaaucagcacaaugaaaauaaacaauaaugaauaaugagcacuagaauucagauuaccagauguuucaaagagauggggugccaguuuucaauuccguuuuuaacaccacauuacaaaagaacuauuuuuaaaaaugagaaaggauugagggaaaagaaaaaaaauaaaaagaauaucuaaacuguugaaugaccccccauuuguuccugauaaacuucaaucacaucuucuuccuccauucccaguucuuuuggaguaugauuaucagcaauucucugacccucaaagagaaaccugaaugaauucauuggaacgcccugucuuugacaguaugauucuuugaguuucuugagauguguugucauuuucacuuugaagugaaucucacugcuauccuguccaaugacuuugaguuuaauauauucaccuuccuucuuaucccccaaguccucaguugaagguuuugccuccuggucagacaugaugacaguggcuucacccgggggucuccgcacagcagcggccucggguaagcagaaccucacuccgggguuuacaaauccuucucccuuccccacagcacaacaccgcagcugcaguaacuuccgcuaccacauuaguguuuuuuucuuucagaucgaagaacuacuuuuaacacuuacuguaagauggaucugguggugguaaauucucaccuuuuguuuguaugggaaauacuauccuucauauuuggaaaauaaaauaaucuugcuggguacaguauucuuagaugucagguuuuuucuuugagcacuuggaaaaugucauuccucucucucuuggccuguaugguuugcauugaaacaucuauugccagacaaauuggagcuccuuuguguguucuuugcuucuuuucuguuguguauuuuaggauccuuucuuuguccuugacuuuugagaguuugacuuuuauaugccuuaggguagucuuacuuggguuggaccuguuugguguucucaggccuuccuguaccuggauauuucuuccucaaguuuuggaaaauuuucuguaauuauuucuuugaauaagcuuucuacgcuugcucuugcuuagcucccucuugaaaaccaaucauucuuuuuuuuuuuuuuugagacagaauuuugcucuuguuggccaggcuggagugcaauggugcgaucucagcucaccaugaccuccgccucccgaguucaagugauucuccucccucagccucccgaguagcugggauuauaggcaugcaccaccacacccggcuaauuuuguauuuuuaguagagacaggguuucuccauguugguuagggugguugcaaacuccugaccuuagaugauccgcccaccucagccucccaaagugcuaugauuacaggcaugagccaccacgccagccaauuguucuuaaauuuggucuuuugaggcaauuuucuguaucuuguagucuuguagguagucuuuguuccuuuucauucuuuuuauuuuuuccucugacuucuuuuuuuuucaagacagggucuugcucugucacccaggcuggagugcaaugguacaaucucagcucacugcaaccuccaccucccggguucaagugauucuccugccucagccucccaaguagcugguauuacaggcauccaccaccaggucuggcuaauuuugguauuuuuaguagaaacaggguuucacuaugucggccaggcuggucucgaacuccugaccuugugauccacccaccucggccucccaaagugcugggauuauaggugugagccaccaugcccagccugacuguguauuuuucaaacagccagucuucgagcucacugauuuuuuuccuccacuugguccagucugcuauucagagucucuaaugagcucuucauuucagcaaauguguuucuguuucaagauuucuguuugauuuguuuucauuguuucaaucucuuuguuaaacuucucugguaaauuucuuaauuguuuuucagccaucucuuggcgauaacaggguuuccuuuaaacuaccaguuuuaauucuuggucagagaucacaaauugcugucauuuuagggucagucauuguauuuuugcuuuguccuuguggggagguuaugguucccuguuugcuauuguuuauuuuggguauacaccuaugucuuuguauugaaagauuaguuacuuauuccaguuuucucuguuuggcuugcuuugguuuuuauuggauauauuugcuuagcaaaucuguacugcuaggucacuuccuccucuuuggcuuuaggugacaccuuaaguccggguucaccuuggcuuuaguaaaugaccagagcauugucuguccugaauggggaggucccaaagggauuaucccagcugugugucaaggcuggcuagagguucguguaugggcagaccuguggaauauacuuccugcaaugcagugcugcugagcagccacucugauuuggcaucuccuuuggccaaguaacagagcagaguuucuggggcugggugugauagucuugccuccccgcuuucucucugccuguccucagggauauuuccccuuucaggcagucgugaugcuucccauggguuaagucaagguuagaucuccugccagggcacccaggaagauggggaagguaguugaccuccucagucucacuuuuuccaguguagaaaccaugaguugggggagggccauugcagauguggaaaucagaugcucuuaccaucugcucagaguuuuuucaucucucuguggccccaggaacugucucauugucauauuugaguucuggguuguugcugaugaaaaucucagcacuguauauuuguuuuggguuuucuguggaggggagugaagccagcuugcuucuauaccacuguuuugaaacugaaaguauuccuucuuucccuuuuuuccuguggugguacccuuauuuugaggaguaugaacauagaauucauccauucauuugacaaauauuuauugaguaccuccuuuguacuagacuuuguuuaaggcucuggagauacagcggugacuaaaacagauaaggccccugucugaaggagcucauauuuguucuaaaauggcaacuccuaaaguggcaggucccugaaaaaaagaaaaaauaacaaaaauugaaaggccaacuaggacaguuguuaucaggacagauaaaacaggauaaagggauggagaaugaugaaaaagagguguuuguuuuuuugagacagggucuugcucuguugcccagccuggaguuugguggugcauucacggcucacugccgucuugaccuuuugggcuugggcgauccucccccucagccuccugaguagcugggacuacaaacgugcgccacaacacccaguuaauuuuuguauuuuuuguagagaugggguuuuuuaccauguugcccaggcugaucucgaacuccuaggcucaagugaucccccuaccuuagccucccaaaguucugggauuacaggugugagccaccaugucuggccaagagaagagguuuuauaaucaauaagagggucagaaugaaagaaccaagacauguaaagauuaagagacuuaaaugaagaagauugccauauuagaaagaaguuggcaauuuagcauucuguaauaguacuuaguucuugaugaagaggaugucauaucuccaaauccuaaaguuauaguaguagggaauugugaugaccuaauucuuuuuguccuucagaaucaaaggcaugggagguugauaccugccggggccauuacaacaauguaucuugugccgucuuccacccucgccaagaguugauccucagcaauucugaggacaagaguauucgagucugggauaugucuaagcgguaagguaguccucaguguugugugaacuuucucuuacucucucuuuuaaaauuagauuggaauacuucuuuaugucucucaucaucuucagcauguagacaaaucaaaucauauauuaugaaaauuugaagagaccuagagaucagucaacauuuacaaauuuuccaucaaauagaaaucuccauguauauuauuuuuugccucuaaauuuaaacauguuuucuucuucccccuuuccccaguucuguagcuagagaaguaagaaaugcggaaugaggccgggcgcgguggcucaugccuguaaucccagcacuugggaggcugaggcggguggaucacgaggucaggagauugagaccauccuggcuaacacaaugaaaccccgucucuacuaaaaauacaaaaaauuagccgggcgugguggcgggcgccuguagucccagcuacucaggaggcugaggcagaagaauggcaugaaccugggagguggagcuugcagugagccgagaucgcgccacugcacuccagccugggcaacagagcgagacuccgucucaaaaaaaaaaaaaugcagaaugaaagccauaaaauuaugcugaaaaggggaaaucuauauaucauaauaauauggucaguuuugaagucuccucuuuuuguuccuugguagaauuuaucacgacuacuguuacuuaggauaugcaguuuacucucccugauuuacauuuuaaucagcuugcuggcuuaccauuuaauauucuuguguaggaugggcugaagauuccuaggaaauuaauguuuuucuuuuuguguaccuuuucuaggacugggguucagacuuuccgcagagaccaugaucguuucuggguccuagcugcucacccuaaccuuaaccucuuugcagcagguaagggccauuuucucucuuuuuucuuugcuuaauucaaaguuuauaagucuugaaagugauuauuagcuuugucucuaguaaauguauaguaggaugacaagaagaagaaggacucucagagccacuuaguugaagcuuuucuccuuuuuuucuuccacuuuauauguacguaaaaugauguguggugaaaaaugcuuugaagaaaaauuaaagguaaggcagauagagacagaugaguauggggacugcugcuuuauauugggugguucagaaaagugaaaggguaugaggcaaugggaacagcaaaugcagagacuguguugugagaggugcuuagcaugucaccaucacaugcuaaggaacaccaaagaggccaguuggagcacagugaguaagggacugaguaacaggugaggucuggccagaucguguauugccuucuaugccaugguuagaacuuaagauuuuauucugaauacauggaaagccauuggaagguuuugggcaggaaagugacaugaucugguuuauauuuggagagcagacaguaggagaacaagaguggaaggguuuucuaagggaugauggugcuaguagggaaagagcaaaacauuuuaaaaaacagaaucacaaaggguuuuuaacauccauuuuuucaguaaauacuucuuauacucuuuuuauaugcuagagacuggggaaggauggaaauuauaauuucugccuucagggaauucauguuacaaugugggugauagaccuaaaugauuacagugcaggaugauaaguacuguaauggagguuuguacaaagcauuaggggaacacagaaaagggcaguguggauagugacacuaaguguggcagugugaauaguauuaggaaaggauucacagagaauuauuuaaauaaagauuccaagaauugugagaauuuaggcaaauaagggaugcauucaggugucuugucuuacagauauaaucuucauccuuacguaucuccaauuuccagguuuuuuucuugccuacagcuuaauuuuuucuccuccucucccugucccccaggccaugauggugguaugauuguguuuaagcuggaacgggaacggccagccuaugcuguucauggcaauaugcuacacuaugucaaggaccgauucuuacgacagcuggauuucaacagcuccaaagauguagcugugaugcaguugcggagguaaaucggacuuguuucuuuccuccaaacccucucaucugucacccugauacaacucccacaaacaagacucuucuuuucuuucuuucauuuauuuauuuuauuuauuuaauuuuuuuuugagacggagucucgcuuugucgcccaggcuggagugcaguggcgcgaucucggcucacugcaagcuccgccucccggguucacaccauucuccugccucagccucccaaguacugggacuacaggcgcccgccaccacgccuggcuaauuuuuuguauuuuuuaguagagacgguuucaccauguuagccaggauggucucaaucuccugaccucaugaucugccuggcuuggccucccaaagugcugggauuacaggcgugagccaccgcgcccagccuauuuauuuauuuuuaaauuuuuuuuuuuugagauggagucucacucugucacccaggcuggagcgcagugaugcaaccucagcucacugcaaccuccaccuccuggguucaagcaauucuccugccucagucucccaaguagcugggauuacaggugugcaccaccacaccuggcuaauuuuguauuuugaguagagacgggguuucgcuguguuggucaggcuggccucgaacuccugaccuugugauccgcccaccucggccucccaaaguucugggauugcaggcgugagccaccgcacccaaccaagacucuucuuuuaaaugacauuuuggaucucguauucugucacagauggaauccccauuagaugagcccgcucaguuuaaacccaaugagugagggaggcaaggaaguggucaugaguagaaugauaguucccuucuugagaaugcuagugaccuuguggauggaaaaucauucugccacaauuugcugggucucuugcaagccagaggaaguuucuugauagagaauggcccaaacugguaacagaacuuuucgccuuuguuuggcauuucuuuucuuuaacucucccuugccuuccagcaaaaagugcacaacucugaaccagaauauaugucccuggaaacucuuaauucugaagauacaauaaccucugggaugccuggcaaaaggaccuguccuuuugaaaagccagcugcaucagcaugcugaaacauucaugguggcaaaauuuggaaugagguuuugauaaccacccuuuagcaucauuacaauaaaaaaauggguuuaugugaauacuccaagggacaggagaaaccagccagagacaaaucacauuauguuacucugugguguccacugcaauuacguguaggaauuuguauccaagcagaaccagucccacucacuacagugaguguuaacccuaccuaccuucuguugaauaauuugacuucuacuauggcuuacuuuuuaaaacuguuuguucaaagcugagcuagggaaguugccaagccuuaaaggaagagaauacaauauuuauucauuuuauuccugauuauaaaagugaugaguauauaguguaaagauuggauaaguaggaggugugggggugauuccuuucuuccuucuauucuuaugccucuucccuguuuucuccuuuuucuauauauaucucuagugguuccaaguuuccaguauucaauaugucauacaauccagcagaaaaugcaguccugcuuuguacaguaaguaaccuguggagcccuccuagguucuccucauuuuccauaggucucuuucuuaugcccuuagggaaucuuuaauggcuucuuagaaacuauuuaauggucauuuugugagagcugacacagugaucacucagagacucaaaucagguagguuucaguugucguaaacauauugagcauuugugaacugccuaucuuuccuaaagcugaacuuaauggagcaucagaaugaaugacccagaucacuagaaauaauuugagagaauguuuagacuauauauauauauuuccuauggaaagaaaauguuuaccuugaucccuuccuuugggugaaaauagaagaacuauuauuuugagaggaaguucauaucagugggguuggcuucagagucaucaaugacuccucucuguuucuugcaacagaauuugcaaaaaaaaaaaaaaaagaaaugacauucuaauuuuagugcccucguggccaaguuaaaaggaaugaaguuaaaugucuuuccucauauaacuauauugucuaaucuguucuucuuuaauaucuaguagucccauacucugaguuuucuugaguguuuuuucuuuucuucuuuuuccaauaaacauuugcauuccuauagugucuuuucuuugaugucuuuuuuuuuuccuuuccagagguugaguacucaguugaugaguccucagggugggguaccagaauaucaggguccuagucuguuaauuuguggaguagagagcauuucuuacuuucauucagauaauaucugcaucuuuggaggauaaagaaaauaaagugacaucagugcugauguguuuggcaaagagcccuauaacucauagauguagaaacagucaaaugcccucugggugaaggguaagaaaaguaugguuucagauuggugucugugcaauggaacuguuuucucugucagaguaaauuggaaaacugguaucuugggugcuucucacuaacauuuuaauuuccccuuuucuucuacagagagcuagcaaucuagagaauaguaccuaugaccuguacaccaucccuaaagaugcugacucccagaauccugaugguaaguguucuuuuugucuaccccacucugcuuccagcucuccucacccgcaucauaacuccucuucaaguuuuucacauuccauccccaagccauggccacaucacucaugucuguuggcaggugcugcugacaauugcaucagaggcgaccauggugugaaauauucauguuccuccuccauuuuauuaccccagcuagauauauauauuuuauaauuugguuauuagaaacucuccauucucucuuucagcacagcauguuauccuaguuuauugucaguugauaugacuuucacccugguaguuucauuuauuuaaaaaugugguuccaaucuuauaaugccucauccugggacuagggauuuauacuguccuauccacauccagauccgauuugcuuccuuuugcaugucaaaaagaugaggcugcuaacagccccacaccccaccugggaucccaggauccagcugagacuccugccuaccucuuccauuaccacuaucccuuguugauguccuugugauuagaacuugcugacaaaacauucucagaauggauuugacuauugccuauggucuuuugggugcacuucuuccagcggguuuauggcuaguaccaggucagagauuuauucugcagauccccacucuuacuggcauauuuuaaugauauuuuagaccccaucaacagauuccuaagaaauaauuugcuagcucuguuucuuuugugggugccccuggguuauuauuguugcuaaucgaucuccucucuuuuaaauguguucauagugagagaaagaaaagauauuuguauuugguauccauaagucaaagucucccuuauaaauuagucaguuaagccauuucugacuaaaucuuaugguuugguaccucccaacuagcucuuugcuuuuuuuuuuccccaucuguguuuacaauuaauagaauuuaaaauauuuuguuuuguuuuauuaccacuuuuauuuucuguacuucauuuuuugagggagauaauaauaaaggagcagcccaguggugggcaacagagaugggcuugaauaaugcagauuccuggccccuggaaaacgggaguguugguuuugauaauaauuaguuucauaaauugccugccacuccagaugccaggggcaagacuggccagcauguucucuccaguuuucugcuggucuaauagguaaaagaguauuuugaugcacccuucuguuuauccuucuacaaguuucccagagaauggaguguccauuucaaaauucuaauaagccacugaacugaggaacauuuuguaacucucuucagggugauaagaauggucaguugacauuuacagagcaacaacuugguucuaaauaccgcccagcaccaagcucuccugucaagauuuaguugggagugcucugccucacccugcccuacuaggaagucugcauuugcauguuaaaagcagcagagagcagcugcauccuguggaggggguccuaugacacaggcuugcuuugccgcagcuuggccagggaggcccugcucguuagcuugauggagugugcugucucccaagaugggcggcccuucugccaguacaugauguuggcugaaaugcaaccacuuggccuagagaaaagagccuuggcagggguggugguugguguuuggaggggacugguggggaaaagucacucaauaauagccccagguuauggcugaauuaguuaggaagcagcucaacuggcaaagccaagauggcauccagcaagacuggcagcuccauggcacccgacuaugucaccugccagugacucaccacaugcucccacccuuugguuuuguucuucucagcgccugaagggaaacgauccucaggccugacagccguuugggucgcucgaaaucgguuugcuguccuagaucggaugcauucggugaguuaagacuaaaagcagaaacuaauuuggggagugugguggcaguggccuguguauugcaaaauaaagaccauuguuuuuucuguucucccccgggcagccgugauucucauguauuggcuguaccucugucucuagcccuacacuaagcccucuugggggaauggcauuaaaacugauuugauuggguugaugaucgccguggcucuggguuuaagaaccaagcuaaagucacucuugacuacaggagcccaaaacgcaucaaaucugaagugagugggcuggaugaggaaauuucccuccuucugcugccuccauuguuacuugaaauguaauagguccagcacaagauaaagcacucugaagaaaauauuuaacaaaauuuaagccccagaaacaguguuuucucucucucauucauugagaaauucagacuuuaguugggacuucucaggauguuuuaguuggaggagaaaaaauaauguauuaaggcccuuagagaagaucuugguuggcauggucugucugcagugguaauugacauggacaggacaaaaaauacuuaguuaauugaagcuaaggaacaauugcugaggaacaucaucaguugucaucaucaucuauacacauuucuucucuuaaccccaucuuuaauacuuauugcagcuucugaucaagaaucugaagaaugagaucaccaaaaagguacaggugcccaacugugaugagaucuucuaugcuggcacaggcaaucuccugcuucgagaugcggacucuaucacacucuuugacguacagcagaagcgguaacauaucaggugccccuaagcagacagcccuguaguuggggagaguggacaucuuuagugggaaccuuuuuuccccaagugaguuugucuuguggcuuggccacuucuugugcuccaagacucuuuauaguaacuuuucccuucugugaucacucuccauucuucacguccacacuagcauuacagugagauucuugguuauuuaucuguuuuuacaguacuuaccugaacaaagcguguucuccgagcuuagaaugagagagagacagagauuaauaacauaguuccuacauuuaagggagcuugcaguccaguggugaaaacagacauacacagauucccuaauaauacaaggaaaugagggagaggggguugaggaagggguaagugcacaaugugagccaaaauguuuaagucacugagcuacuauguaggaauuacauuaaguauuuuauguaauuagaauuacauuaagaaauugggguuuacauuaauuagagggugcaauugauguagaucaaagccugagacaagggaaauagauccauucauguuugcacaucucuaucuaucucaggacucuggcaucugugaagauuucuaaagugaaauacguuaucuggucagcagacaugucacauguagcacuacuagccaaacacggugagucuucauuauauccacccugauuuagagaccauucccuuccaccccgaucccugccagucuacggcacuuacccuauccaacagaacacucaugcccuuugccucuuacagccauugugaucuguaaccgcaaacuggaugcuuuauguaacauucaugagaacauucgugucaagaguggggccugggaugagagugggguauuuaucuauaccacaagcaaccacaucaaauaugcugucaccacuggguaaguuaauuaucugggauacagaaugggagaagacagcuuccugaaaucacugucuugucuugagauguaacugaaguccuccaugaauuuucuucauggaaaagccuuaccuggcauauaugugcaaggggcaucagaacauucuuuuuucaacuuuuuuaaaauugagaaaucuaaaacaaauauagacaauuacauuaaaaaaaaauagaauaacaaauaaguuauguagugaacaucagcauaacuaccacccaagucaaaaaauagaacaguuccggcaccccagaagcccuuugccacguggucacaacccucccuguuuccaccaacaguaacauucuaguuuuuacaguaauuucuuccuugcuuuucuuuguaauuuuacugcccuguguuucuuaauaugauuuaguuuugccugguuuugccuucauauaaaugaaaucauacugaauauauuauuucauauuuugcccaauauuuuguuuguaagauucauccaucuuguagcuccaauguauuuauuuucauuuuuguauaauuauaugauuaugccacaguuugucaguucuacucuuaaggaauauuugagugaauucuaguuuuuggcuuguaugaacaaugcucuuaaacauucuuuuuuaccuguuuucugggguacauguacauacauuucucuagaguguauccccagaauagaauugcuaggccauggauuaugcauaucuucacauuuauuaggcaaugugaaacugcuuuucuuuuuuuucugaaacggagucucgcccaggcuggagugcaguggugugaccuuggcucacugcaaccuccgccuccuggguucaagugauucuccugccucagccucccgaguagcugggauuacaggcacacaccaccacacccagcuaauuuuuguauuuuuaguagagacaggguuucaccauguuggccaggcugguuuugagcucuugaccuugugaucugcccaccuuggccccccaaagugcugggauuacaggcgugagccaccgcgcccagcugugaaacugcuuuucaaagugauuguaccaauuugcaugcccaccagcuugguauaaaaauuuccuuuuggguugggcgugguggcucacgucuguaaucccagcacuuugggaggcugaggcaggcagaucacuggaggucaggaguucaagaccagccugagcaacauggagaaacccucucuccuaaaaauaaaaaaaaauuagcuggguguggugguggugccuguaaucccagcuacuccggaggcugaggcaggagaaucacuugaacccaggaggcaaaggcugcagugauccauggucguaccauugcacuccagccugggcaacgagcgaaacucugucucaaaaaaaaaagaacaaaaaauuuccuuucuugucuucuugacaaguuuggugagacuuauuuuuguccaucugauggaugcguaaugguaucuccuuguaauuuuguuuugcuguucucuguuuccuaaugagauugagcaccuuuucaucuggccauccaguaggauuuccucuuaugugaauucuguucaaaucuuuaaucuauuuuauauuaucuuucuuuuuugcaugucaguccuuugucagagcuacauguugcaaauauuaguaucuccucuuuuguagcaugucuucugauuuucuuuaugguauccuuuaaugaacagucuuaauuucaauguaguugaguuuaugaaucuuuaucuuuuauggauauuagguuucauccuauuuuuaaaauauuuauugacucccaaaucauaaagccauucuucuguauucuucuguaaaaacauuguaacuuugcuuuuuauaucuaggucuauaaucuaccugacauugauaguuauguauggugugagguauagaaagcucaaucccacuuuuuccauaaggacacucaauugcccagcagcauuauugaaaagaccguucuuucuccauuguucugcagucucgucuuuguuauacauaaaucauguuuucaaauguggucugucuaucucugcucuaauuccacacugucuuaaauaauguagcuuuaugauaaaucuucacaucugguacaacuuuuccuuugauccuauuuuguuuauuuuuuaaaagucguuaggguauuuucaaguaaauuuugccuucucacguaaguuuuguuguuguuguuguugcuguuuugagauggagucucacucuguugcccaggcuggaguacaguggcguaaucuuggcucacugcaaccucugcuucccagguucaagugauucuccugucucccagguucaagugauucuccugccucagccuccugaguagcugguauuauaggcgcaugccaccacacccagcuaauacuuguauuuugaguagagaugggguuucaccauauuggccaggcuggucucgaacuccugaccucaagccauccucccacaucagcuucccaaagugcugggauugcaggcauuagccaccaugcccggcccuucauauaaguuuuuaaaguaacuugugaaauuccgggcccagcacggucgcucacgccuguaaucccagcacuuugggaggcugaggcggguggaucacgaggucaggagaucgagaccauccuggcuaacacggugaaaccccaucucuacuaaaaauacaaaaagcuagcugggcgugguggugggcgccuguagucccagcugcucaggaggcugaugcaggagaauggcaugaaccugggaggcggagguugcagugagcugagaucgcgccacugcacuccaaccugggcgacagagugagacuccaucucaaaaaaaaaaaaaaaaaaaaaaaguaacuugugaaauuccacacaaaaaaaguuugugguuucguuuggaauugcauuaauucucuacaucaguugggggauaacugucaucuuuacaguccuuacaguguucaguuuccuaaucugugaacuugguauagcagcucuucauucauuuaggucuucugaaacauccuucaauaaaguuuuauaguuuucucuauagagaucuugcauuucuuugguuagauuuauuagacacuugaugguuuuaaaauucuguuuguaaauggauaauaucuauuuaaaauuuuaauuuucuaauuuuguugauauuuagaaauacaguuaauucaauuuaaauacaauaaaaucaauuuaaaauugauuuuaggaaucuugcuagacucuuaucaauuccaggauuuauuucuauuuccuuuacaaauaaucauaguaucuguggguaaugacaauuuaguuucucuuucaaguacuuauauauuacuauauuuuucuugcuuacugcacugacuaggaucuccagcaauguggaauuaacaugaugacagcaaacauucuugucuuauuccuaacuuaaagggugaacuuucaguguguuagaauuaugugagcuuacaguagauuuuuaaaauguauaucccuuuucuaugaaggaauuuugcuauuucuuuuugcuaagaguuuuuuuuuuuaccuugguaaaauucaacauuuaccaaccuaaauguugaauuuauuuauuuauaucuauuuauuaaauuaauguaauuuaacuauuuuuggcagagagucucacucuguugcccauuguguaguggcacaaucuuggcucacugcaaccucugccuccugggcucaaguuauccucccagcucagccucccaaguagcugagacuacaggcauaugccaccaugcccagcucauuuuuguuuuuuuuguagugaugggguuucaccauguugcucaggcuggucuugaacuccugggcucaagcagucggccugccguggccucccagaguguugagauuacaggcaugagccaccaugcccggccuaaauauugaauuuuauuaaauaacuuuucugcauauacagguugagugucccuuacuugacaugcuugaaaccagaauuauuuuauauuucugauuuuuuucugauuuuggaauauuuguguuacugauugaacaucccacauccaaaaaucugaaauccauacugcuccaaugaacauuuccuuugagugucacuucagugcucaguuuuggauuuuggagcauuucagauuuccuguuugggaugcucagccagcauugggguagucauacaauuuuucuccuuucauugauuaauguagugaauuaaauugauuuuuuuuuauuuuuuauuuuuuuugagacagagucucaccccaggcuggaguacaguggcaugaccucagcucacugcaaccuccaccucccggguucaagcaccucagcucacugcaaccuccaccucccggguucaagcaauucuugugcaucagucucccaaguagcugggauuauaggcaugagccauuacgccuggcuaauuuugaauuuuuaauagagaugagguuuugccguguuguucagguuggucuugaacuccugaccucaggugauccgccugccucagccucccaaagugcugggauuacaggcaugagccacugugcccagcugauuuuuuauaaauguuaaaucaacacuauauuccugauguaaaccuaacuuggucuugauauuuuuacccuuuucaaauauugcuagcuuuagguugcuaauauuuuacuuauguuuucacauauuuauaagugagauuaccuguaauuuucccuuuucuuacuguccuuguuagguuuuaguaucaagguugugugaauuucauaaagcaaaguaauguauuuuuucuguucccucaaugaguuugcauacaacuggaauuaauucuuccuugaauauugguuagaauuugcccuugaagucauauggacauaggacuuucucuaugggaggauuuuaaaaaucugauucaguuuauuuagccauuauaggacuauagguguuuucuauuuauuuuugauucaacuuuggcaaauuuuauuuuuuaggaguuugauccuucuauuuauuuauuuauuuauuuauuuauuuauuuauuuauuuauuuauuuugagucggagucucacucccagucucacccaggcuggagugcaaugguacgaccucggcucacggcaaccuccgucucucggguucaagugacucuccugccucagccuuccgaguaguugggauuacagacaugcaccaccacuccuggcuaauuuuuguauuuuuaguagagacgggguuucaccauguuggccaggcuggucuugaacuccuggcuucaugugaucuacccgccucggccucccaaagugcugggauuauagaugugagccacuguaccuggccaguuugauucucuuaaaaaguuacaucuuuauucugcaagaucuguagugauauccccuuuuucauuccuauuguuuucuuuucucugaauuacccucaugagaggcuuaucaauuuuauucaaguuuugcuuucauugaacuucucuacuguaguuuuuguuuuuuauuuaauuucuacuauuggcuucauuauuuucuucuaaguacuuucuuuggcuuaaaaagaacaguaaauuuuuugagaugacugcuuguuaauuuucaguuucuccuaauauaugcauguagaacccaauaauuuuuaauauuucuucuaaugcagucuguaaauuaucuguuaaauguugcauuagcuauauugacaaacuucaauuugcaaucuauuuauuauuauucaguucaaaauacuuuguuuuuuauuauuucuuuaucagaacucuucacaucuaccucucuucuacuuucaguuauagauuauaaaggaguuaccuguccauaaucaccuacugauuauauaucagaacuuaagauuuaacuuuuaggucugauuccuauagccacaucuguuacucaucuucuaggauaauagcauauaaagaucgugccaucuaccccaucguagaaagaauaugauaaauuuggcauuuaguucugcucuuuuuugaaucacuucccaucuauaucauuguucaaauggcacuugacaaaagaccguuuccuagguuuguuccguuucuucacaggauggauuuucccucucacuuacugaaagcugugcccucuguucuuagggaccacgggaucauucgaacucuggauuuacccaucuaugucacacgggugaagggcaacaauguauacugccuagacagggagugucguccccggguacucaccauugaucccacugaguucaaauucaagcuggcccugaucaacagaaaauaugaugagguaugaagugaggaugcaaacuagaguauuaagagaggcagcacucuuuuuuuuuuucuuuuccuguaagugaugucuacuucuugcccgacuccaccccaaaugucuagguacugcacauggugaggaaugccaaacuaguuggccagucuauuauugcuuaucuccagaagaagggcuauccugaaguggcacugcauuuugucaaggaugagaaaacucgcuuuagucuggcacuggaguguggaaacauugaggugagaggaauauggucaucagccccauauugucuuagaggugagagaguuagagugccauugggagggcauuauucugggcuugcuucuuuagccagaauaaugaaauuugggauuuuuuuuaguuguuacauugagccaucuuccuguugcuauuugcccaucucuacuuuuaccugccucugcuucugccaccgcauuucuauuuuugucaaccucaauuagugugaauucaguaacuucuaggauaaaagcaagauggcauggaauuugaaaaucuuauuauuuccuugacacuugaucuugcugacuggcuacuuagaugaaagaguaccuacuaagcguuggggccuagaauguauaggcauuguuuucuaaggcgaaaagagcuuaugaaaacguuuuccaguucugaacuucuuccuaguaguauuucuucugucuuugcuaaagccccuguggaucuucaaaccuggcaggugggaaguaagguagcuaagcaagaacuggcucuauggaaucagcaacugcuaggugguuuuguuguaaaaguaaauuucugaggaggaggaggaggauaaugcgauguaauuauuuccaucucuguauccaaagggguccuauguguucacuggauuuucuuuuuuuuuuuuucuuuuuuuugaggcggagucucgcucuuguugcccaggcuggagugcaauggcaugaucucggcucacugcaaccuccgccuccuggguccaagcgauucuccugccucagcuucccgaguaggugggacuacaggcgugcaccaugauucccagcuaauuuuuuuuguauuuuuaguagagacaggguuucaccauguuggccaggauggucucgagcucuugaccucgggauccgccugccuuggccucccaaagugcugggauuacagaugugagccaccgcacccagccgauuuucaauggaauuagacuaaaagcuaggaguaauugaaaguauaggaaguucuucaggaaaucuauauagaugcagaugcuuugcagaguccuugguuuugagucacauuguccuucaaccuguuaacacgacccuggggauucuuuagauugcucuggaagcagccaaagcacuggaugacaagaacugcugggaaaagcugggagaaguggcccugcugcaggggaaccaccagauuguggaaaugugcuaucagcguaccaaaaacuuugacaaacuuuccuuccuguaucuuaucacuggcaacuuagaaaaacuucgcaagaugaugaagauuggugaggcccucaaacuaaggaugggaagagggguucuugggggaaggaggaaggugaauuaaggagaaagagaacuuaagagaaaagaccuaacuuggugucucuuacuuggugcagcugagaucagaaaggacaugaguggccacuaucagaaugcccuauaccugggugaugugucagagcgugugcggauccugaagaacuguggacagaguaaguauccgagacuugccagcuuuuucagggucugaggaaguauuuuucuguuuuuguugaguuaaucuguguauaguggugagggauuucucuuuauugugcauuuuuuuaggagagacaacaugcuccuacugugcuuagaagauuuucuucaaagccaaagggaggugcagccagaauauucaguccagccaaacacccuuaggagaauaguuauucaugggggagauaggagguuuuaaaaggucuugaguggacgcccuaguaaaugcacuugguuggaugccauuagaauuuuauucuuuauuuucaguuuggagguuucacucauuuauucauguauauagucaagggauauuuuuugagaacccacuauauaccaagcauuauauuagcauuuaagauacauuaggaaacaagcaaggugaaagaugagguuuggaccaaggcgcuauuaguggaggggugagcaguggucagauucaggauauauuuuaagguagaaacaacaugauuuauugcgguaacuagauuugagauguaacagagaggagucagggauauccaagguucucagcacggauggauacgucucaaagauaagcagcuauauuaguucucuauuucuguguaacaaauuauccccaaauuuaguaguuuaaaaccacaaacauuuauuauuucacaauuuguggcauggcuuagcuaggugccuccggcuuaggaucucucaugaggcuacagucaaaguguuggccagaacugcagauaucugaagacucaccggggagagaaucuacuucugcacucacucaauggccauuggcagcccccauguccuugcucccuguugucuaagaaacaucacuuucuuuucguguugaccucuccauaggaguuuguaacgugguagcuaguuucccuuacagcaagugagcaaaagagggcaccccaagauagaagccacaaucuuuguaaccagaucuaggaaguaacaucccaucacaucugccauguuccauccauuagaagcuauuuaauaaauccagcccacacuuaagagguggguauuuugcaacaacuugaauaccaggagucagggauuacuggggggccauuucagagguugcuuaccacagcagcaugcauuuggaaauguaccuauaccacaaagucuguuuucucuacagagucccuggccuaucucacagcugcuacccauggcuuagaugaagaagcugagagccuaaaggagacauuugacccagagaaggagacagugagucuuuauuuacauaauugucucuuauuacaggauuaacucuaggaucuuagaacaauuuaaaauuaugaaugucacucucccaccugguuaccaggagaggcagagaaacaaaugagaucaaaggaggcuccauaacuuuccuuacgugacuuccaagugcuauuuguuuuuagccucuuuucuucuacuauucagaucccagacauugacccuaaugccaagcugcuccagccaccugcaccuaucaugccauuggauaccaauuggccuuuauugacuguauccaaaggauuuuuugaaggcaccauugccagcaaagguaaguaccuauuucucccauagcacuuuuguuguuuguuuugugaagaacuguccuagagaauaccauuagcauuuaguuuaacuuguccuuuuuuucugcauggagccuaauggaauauugaaaugccagucauuuauggugcagucuuaaaaacuuaagauagcauuuucaggucauuaaagaaaauuuggaaaauagggagaaaaaaagggaucccucuacuaccaucaauaacuucgguuaauauuuugguguauuuucuuagguuuuacuauauauguagucauguucuuuguucaguauuuuaucauucaugacauacaaucuuaaagguacuaauucaacuaccuguaauuccgguauguggguauaggcagaugugugcuaucacccuccaccacuuccacccuuaaccuccuccuguuuucugggucuccuaguucauuucccgugaguaagagccuaaacagacucuugagcauuuugugccaaaccccacucuuuucuccaccuccucuaucuacccuaugccugaugcccuguacacauuguaguggugguagcuuagcaaagcgcucaggaagaaauucaagaguugguagccaaaggcugguaaguacaaauuauuuaagagccaguuuuugguagcaggaaggccaguuccuuccaucugucuucuauucccucccucugugaaagcuacugcaaguuagcauaacauauauaccacaaaaauaaauaauacacaaaaauaaauaguaaguaggcagaagcuuggcaccuguuuuugaaaggauuuaaccugccuacagaaaaggccguaucucagacuugcuggacuauaaccaguuccguucuguuccuucccucuguagggaagggaggagcacuggcugcugacauugacauugacacuguugguacagagggcuggggagaggaugcagagcugcaguuggaugaagguaaaagugcuguuuuaagacuguucuggggugauggacaccuuggauugggacuggguuguggguagcucugcagacuuccaggccaugaaacgaacuaggauugauuuuacuuccuuuggcuaagauuaugccacugcccaaaucuguuuugagcuugaauuuuccuuacagauggguuuguggaggcuacagaagguuugggggaugaugcucuuggcaagggacaggaagaaggagguggcugggauguagaagaagaucuggagcucccuccugagcugguauguggaauuuguacccuuagaagguucucuccguaucucccuguggaagccagaggccuuauuguccccuaccacuauccucaggucuccuauccuauccccuaccacuauccuaaggucagcccuucugggaaggggacuagacccuccuagucugaugcuuaucucccauuugaaagaaggaagauggcugggcacggugacucaugccuguaaucccagcacuuugggaggcuaaggcaggacaauugcuugagcccaggaguucaagaccagccugggcaccauagcaagacccugucucuauuuuaaaaaguaaaagaagcaggaagaacgagagagucaaaguuaguggccuugucacuuccaucuauccugauaugcuccaagaggagaggauguaggacuuaucucuaaucugaugcuuaacucccauuugaaagaaagaagaaugagguaaucagcguucugccagcagcagcuuaugagaagguagcaagcuguuucaucugaauuggaguuuuugauaugucauuuugucacuggugagguggcuccuauuuuggcagccuucucccacaacuaucaccccucuuccucagugggggcagggaacaauguaaaugguuguguucuagauucaacagaacaaagugcuugaauggcuuaaaaaauuacucaauuuggcugggcacaguggcucacgccuguaaugcuagcacuuugggaggcugagccaggcagaucacuugaacucaggaguuggagaccagccugggcaacauggcaaaaccccaucucuacaaaaaaauacaaaaauuagccagguguggugacucaugccugcagucccagcuacucgggaagcugagguuggaggauugcuugagcaugggaggcagagguugcagugugccgagaucaugccucuguacuccagucuaggugacagagugugacccugucucaaaaaaaaaaaaaaaauuacucaauacucaauuuuuguuuuuccccuaggauauauccccuggggcagcugguggggcugaagaugguuucuuugugcccccaaccaagggaacaaguccaacucagguaagcgggaagaaaccuagcacggcagggaugaguggcuaauacuugauugguauauaacagguguuggcuacuuuucuacuauaguuacagaggagaauagagaagggacaaaguuucacuuggcuuggguuuuuuuguuucuuguuagaucugguguaauaacucucagcuuccaguugaucacauccuggcaggcucuuucgaaacagccaugcggguaaguaaccuuggcuuuuccucuugagugugccuagcccaggguccccgggagaugguugacucauuuuaaucaagggaaauuauccuacccauaaggggaaagguguauauuuuucaugaaaacucuuuaucuuuguuaaguacacuugccuuccuguuaucugccuuccacuuggccuaguaaucucuuagggcauauccuucagucaucuuccacccauuuauagcuugcuuucuggcucauaucagugagauaaguaccccuuuccaagcagaggucuguuuugaacacuaagccaguauuguuauaauaacaacaauaaugauaacacugcaauaacugcuaacguuuauuuaauguucacugugugccaggcacuauccuaaauacuuuaauagguaucauuaaaugagguaggucuuacaauuaaguguauuuuacugaugaggaaacgugaacagagaaauuaauuaccuugcccaaggaaaaguagcuuuuuaugcagcagggccaaaauccuuguuucuuuccuucuguuccagcuccuucaugaccaaguagggguaauccaguuuggccccuacaagcaacuguuccuacagacauacgcccgaggccgcacaaccuaucaggcucugcccugccuacccuccauguauggcuauccuaaucgcaacugguaaggcccuuuucucuuugcuuucaucuguuccaaguuguggucgauauuucagaugguagccucagugacauagucagaauucucucagagcuaggguuucccaguagaaaaagaucuuugguuuguuacucuaugggguugguuuacaccugcugucauccucuuccccagcuacuuuaacaggagacaggaggguagcuaugaggauguuugccagaaaaggaaauuggguccuaguugccuacugacuauccugucuucuuccuacuuuucccuuuccaggaaggaugcagggcugaagaaugguguaccagcugugggccugaagcuuaaugaccucauccaacgguugcagcugugcuaccagcucaccacaguuggcaaauuugaggaggcuguggaaaaauuccguuccauccuucucagugugccacuucuuguuguggacaauaaacaagagauugcagagguaggagggucuagccgcugucccaguucugggcacuuccacauucuugucucuguauccugaccuucugcccccucuacaggcccagcagcucaucaccauuugccgugaguacauuguggguuuguccguggagacagaaaggaagaagcugcccaaagagacucuagaacagcagaagcgcaucugugagguaagaucuauaggacccugagcacaacagagacguccuucccuucacccuucacuagguuugaauucuuuaauuucaaacccagaucugaguggggaugaagagaaauuuaggcccuucauuucuaugaggggaggauacauuucuucauccuacuuccucaucucaccaguccuccauaccuaggagguagaagaccucucagcuuuauagcccaucauccuauuuuguguuguguuuuuuaugcauguguagcagcuuagaaaugacuucuaccagguguagcaucaaccuggcauguguuccuuuuucuguccaccagauggcagccuauuucacccacucaaaccugcagccugugcacaugauccuggugcugcguacagcccucaaucuguucuucaagcucaagaacuucaagacagcugccaccuuugcucggcgccuacuagaacucgggcccaagccugagguggcccaacagguagauggaacuccuucagugaccauagggaagccagaucagcucuuacauggagggagcagaccaagguccuugccucugaaacaaagcaauaaauaacaacauucaacaaaaagccaacagaaugcuacccucuguuuacuuccugacuugguguuuccuuuguuccuggaaaauuaauaguuuauugagacauggcacucgucuaagagugccgugcaaccuagaauagcuccacugcagcugaaaguaaccccaguccuguccuuaagcuccagauaucccaucacaaccaccacaaagcuucacauacacaucucauuacuuguguccuccaaaugcauucuuuuugggugauggaagucuguuuuaacccuuucuaggaccugacccugauaaucucuagaguugguggaggaaugugggucuagauuauggagccacuuuuguauugagaaggggaaaguuugauacaauaggaauggugauuguuaacccuucacauacauccaguacagagguugggaccucuuuucacgcaguacaguugugucucacaucaacggaacuaccaaaccaugguguugggauccuuugagguguugucugcagccuucuguccuccuaaauacuccuuccuuccccuagacccgaaaaauccugucugccugugagaagaaucccacagaugccuaccagcucaauuaugacaugcacaaccccuuugacauuugugcugcaucauaucggcccaucuaccguggaaagccaguagaaaaguguccacucaguggggccugcuauuccccugaguucaaaggucaaaucugcagggucaccacaguaaguacuguccucaauaaauauaucuaggauauugagcgaaggggaaaaagaaagaaacauggugguccuuuuuuucuucuugugcuuguccccugcucccugaggcagugacacuggagaaagcuagagcaucuccccacugcucuuggccagucagugaugaacaccccaauaccugucuacugugcccauugagggguauagggaauacauuuucuaggguucucaaucuuacaaaucucuaacuuguuccuuuguuuguuuuuccacaggugacagagauuggcaaagaugugauugguuuaaggaucaguccucugcaguuucgcuaaggcccccuuugugugcaugggucagucaccauauguuccccccagagaaugugucuauauccuccuucuaacagcaccuucccccugcagcuacucuucagaucuggcucucuguacccuaaaaccuaguaucuuuuucucuucuauggaaaauccgaaggucuaaacuugacuuuuuugaggucuucucaacuugacuacaguugugcucauaauuguccuugccuuuccagcuuaauuauuuuaaggaacaaaugaaaacucugggcuggguggaguggcucauaccuguaaucccagcacuuugggaggcuacggugggcagaucaucugaggccaggaguucgagaccugccuggccaacauggcaacaccccgucucuaauaaaaauauaaaaauuagccuggcaugguagcaugcgccuauagucccagcugcucaggaggcugaggcaugagaaucgcuugaaccuaggagguggagguugcauucaacugagaucauaccacuucauuccagccugggugacagagcaagacucugucucaaaaaaaaaaaaaaggaaaacucugugauggacauuuguuuaguaaaucccuucaguauuuaucccuccuuuccccacagcagcuuucuuuccugucaacuagaaaggagcaggauguaauaaauacauuuuggugugacuaggccacaccaacucuuaaucaucucccauuuuccuuagacauuuaaauuucaaggcagguacccucuguguacucagaaauuugaagaaguuauuugguuuuccaaaaugcacacugcggguuauugauuuguucuuuacaacuauuguucucauauuucucacacuaaauaaaucucuaugagagcuucuug

SEQ ID NO: 12969 - RNA, 8131 nt, Homo sapiens
ccuacggcaagucggagguagcaagauggccgccgcugaggaaggcuguagugucggggccgaagcggacagggaauuggaggagcuucuggaaaguaagagcccauagugggaaaggcccgaagagggcacgugugaggacccauucuggggguuaagugaaccugagauauuagggacgggcaggagaggcucuccaaagguuaaaugggggcggagagucugacccccgagccccccaaaaaucucugggucauccugccccaccccggcgacuggagcuggggagcucaccuggggucccucagugguccggaugguggauguuuccgcaggacggcguuucaugauaccucuucaaacuccucuuuagguuacugaguucuuaaaguucgacuucagcagcaguagcagcagcagcagcauuugguucuugcuggguagcgaacuacgcacucacugauugcuuacauuaacuccuagcaagcucguggccgguccuugugugccucguccugucuuccuuaacacgaaagacacuuuucuccuccuaguccuuuucucuuucucucguuaggccccuuaacaguucuuucaucuugucaguagcucaagcggacuccuuucccuuauuuugagaaacugaggauguggcgauuucaggggaaagcaguucacccuccugaaagacgggggauguuuucuuagcauuacucuccacuccccuguugacuuccugcccagaguagggccagugcucucucccuaggccuggcgaacagaaugguggugaggacacaggcuuuucagggcagaggugaauuuguaaucgcuugcucaaucacggagaugugggcaggcagaaaaaugaacagaaacccugaggagugccaagugacuguguaaauuaguguacgguuaucugcagagaucaggccaaagggagcucuagaagguuguuggggagcacuaaacuggagaauaagagaagauaguuuaaugccguaccauggagucugguauguagucccucagucugugcugguaccaguaccaacaggaagcugggugggauguccugugcuuucucaccaaguuauuccuuuuagagcuccagagugaguucagagggaugaggacaucuguguucucuacuacuguuggguauuuguaugggauuucuagggaaucguuaggguguggcaagggagacacuauagauggagaugucucugcagaacuuuuuaauccucuccucccagcucugagauggacauuuguuccaccuuaagggauuucuuugccuuugcucacaauaaauuagguaauccagaaggaaguaggaggcucauugaggguggucuggggaggugggggacucaaggaggaaaauugaggaaaguuggcaauuugaaaaaucauauuccuaaugcuuugcccagaaaccacccagccuugcuugcauucucaucugucgccaacacacacaccaugucucuugucucugaaggugcucuugaugauuucgauaaagccaaacccuccccagcacccccuucuaccaccacggccccugaugcuucggggccccagaagagaucgccaggagacacugccaaaguauaaauuccacccccuuaagggauggggaggggaugggcaugcagcccugagcagagguugggcaggccccuaugggccagaggggaaugugggaggguaccuuggccucacauuggugagugcucuugccagccucaguccuugugaaauaaggacuugagguugagugggggaaucucagaguuccuugaaaaaauaguagguuuaaaugguuggauugguaugccaucccauacccuccuucaaugacuagauaccuuuuuugcuauccucauuaggagcaguaguuagaauguccaguggaauuggguaggagggaggugcauuucccauagccacugccuguggcuucuaucagaggccaggugcaguguaguccuaaguaagagacgcauuucagccauccuucccccgcaggaugcccucuucgcuucccaagagaaguuuuuccaggaacuauucgacagugaacuggcuucccaagccacugcggaguucgagaaggcaaugaaggaguuggcugaggaagaaccccaccugguggagcaguuccaaaagcucucagaggcugcagggagagugggugaggagaccccagauacauggaaauaucugaacagacucuuaagucuuuguugccugaaaacaccagaauucuuagugaaguugauagcaaucaugaugucacagccaaggaacggguaaaggcaaugagagaaaggaugggaaucccuguuaaugaaaaggggugagauagguuggaaaguaauagaaaacauuauucaaaacugaccauuugaaaggucacaguguuauuguggguaucaucauggagaauaaacugaugcagaguccguguacuaaauagauuuaugaaaagacuaugaagauaaccauaggguuuuccaagauugggagugauaaugauucacuaguaaaugcuucauauccaagcuguuaaccaguucagucuaggcaaggaaacaaacuccuaaaugacgcuggcuuuuuuaaucucuccuaggcagugauaugaccucccaacaagaauucacuucuugccuaaaggaaacacuaaguggauuagccaaaaaugccacugaccuucaggugaggagaaaguaguaggggcccacaagggguccacucccagacauuucuccagcagagucucaaaagacagaugcuuugaguaucaucccaagucuguugcugucuuauuguuuguuacaggcaaguuuagauaguuuaucuuugucaccugagagaguggugagcaucccaagaagguaguauaccugcucaccucuuacuuguccuaucuagaacuccagcaugucggaagaagagcugaccaaggccauggaggggcuaggcauggacgaaggggauggggaagggaacauccuccccaucaugcagaguauuaugcagaaccuacucuccaaggaugugcuguacccaucacugaaggagaucacagaaaagguuugugaacuuccauuucugcuuuuucucuucauuuuccaucacaucaacugaugugggcuauuuugucuacucagagccugcagaaagaguaacucgagugugcuuuuuuuccuucuuuauuuauuugaggcagggagaguuggggguuggggagaguugugucucugagagaauaaagcugucacacgguauguugggguauaagagguauaacguuuggggucuaagaggaaauccuucaguucuaguuuucuauaaacugguucaagacucugggauuguugucugaucaaucuugcauuucugacuucauuucuccagcaagaauuuggcugggcaugguggcucaugccuguaaucccagcaccuugggaggccgaggcggguggaucaccugaggucaggaguucgagaccagccuggccaacauggugaaaccccgucuguaguaaaaauacaaaaauuauccuggcguaguggcucacgccugugaucgcaacuacucaggaggcagcaggagaaucacuugaaccugggaggcagagguugcagugagcugagauugugccacuguacuccggccugggugacagagcaagacuccaucugaaaaagaaaaagaauuaacugaggauuuacuuacuggcuuugugaugugaacaguguaagcguaguuuaaaugauggucccugccauaaaagagcuuauaugugugguuguaucauuuuguuuugagacagggucuagcuccaguuggagcacaguggcacgaucuuggcucaccacagccuccccaucccaggcucaaguguuucucccaucucagccuccugaguggcugggacuacaggugugugccaccaugcuuggccaauguuuucaaaauuuuuuguagaguugagcucucacuauauugcucaggcuggucucaaacuccugagcucaagugauccucccaccucagccucccaaaaugcugggauuacaagugugagccaccacaccuggcuaaagaguguauaguuuuacuggagagauaaaauacaggaauagaagcuuuucagugacauggggaaauguggguaaguguguaaugaauaguacagaccacgagucagcaggccaagaccugggugggacaaauccaacucucuagcaaauaaugguuuuuacauuuuuaaggucauuugaaaaaaacuacaaagaaaaugugcaauagccgagcguaguggcucacuccuauagucccagcgcuuugggaggccacgguggacagauugcuugagcccaggaguuuaagaccagcuugagcaacaugaugaaacccugucucuacaaaauacaaaaaaauuagccagucacaguggugcacacuuguagacccagcuacuuggggaggcucaggugggaggauugcuugagccuggggagaucgaggcugcagugaguggugaucacaccaucacacuccagccugggugacagaguaaaacucugucucgaaaaaaaagaaaaaaaaaacacaauagagaccauauguggcccuugaagccuaaaauauucacugucuggcccuuuacagaagcuuaccaaucucuggugaccauaaaugcuaacauggccaggugaucugguuggagucagugccgcuuuucaugaugaacuuacuuauuuagcuuuucguuuuucuacgucccuuucccuuucacauuuuaaucacauuguucugauuacccauccauauccauuguucacuuaauucuuuuccacccauucucucuuuucuuaguauccagaaugguugcagagucaucgggaaucucuaccuccagagcaguuugaaaaauaucaggagcagcacagcgucaugugcaaaauaugugagcaguuugaggcagagacccccacagacagugaaaccacucaaaaggcucguuuugagauggugcuggaucuuaugcagcagguaaggccucuugccuucugcccacuggugcuguccacuuagguguucagugaaggaaguaucugggaaggaugcaauacugcuagaccuagguggaggagggauccucucuugugaucucucucagaagaaauagagagaucauucauuagauuccucuucuggauccucuguuguuuucugggcuuuucucuauuucauguuccauuuuccuuauuuucuagcuacaagauuuaggccauccuccaaaagagcuggcuggagagauggugaguaugucuuauuuuuccagauuuuaauuugaguccccaauuuccagaauucuuuaaccucucaggauuccaccuaaggugaaaauuguggcuacuggggauggaucuucacgucuguccuaaaaaaugagcaacuaucugagucccuucaucucuuccccagccuccuggccucaacuuugaccuggaugcccucaaucuuucgggcccaccaggugccaguggugaacagugucugaucaugugaaacacaacacguuuuccucucugagucccagcuauggggaacaucuggagucagcagaaccauugggaccugaggcaggagugucaccugcgggagaagucugcccgcugcccucugucaucccauucaagauugugccauaccagcugagguuuuuccucugucucucuaggaauagggucuguuucacaggccauuucugugaacccuacuccauugugguuucugccacuaucaaaguuccagcuaccugcaaggugaaggaaggcaucccuuuuggggcaugcacuuucuuuccuuucucaaaauaauguuauauguggccacacugauguucaccuuuacguccagggucuuugugccuugucucuacucccucucuuggaucuggggaggaggggcagagaccugggacucuguauuucuauaguucuccuggcagagccuuugagaauggggagaaacagccugggcuggggcuacaggucugucacuaugcucucuugccuucagacagaccauucugaauucucuaaagggaaagggcuuuugcaucuaaucacaauagaguugaaagagaggccuuaggauucuccucucucuaggugcugagcccucaccucccuguuccaggcugagaacucaaaugguuacccugcuucuuccuacaaugcugugugauaugggugaacccagccccugaccuuccucuauccccugcccauccucccuuuuaccuccucucuuuuuuaaacaccuguuuaucccaaccuuuuugagcucaagcugugauaaagaagggcccauccuauuuccccucaucuaguccauuuacgauucucacugacuccccgucuuccuggcagacacaaauaaacccagugucaggucuaggaaauuaauggcuauucuuccccagauacauucuggcuuauuugagauacaugauucucuuagaauccugucccuugguucaggaaaguagcuuggaaaaggaguagggguauagcuugggucccuuuuccugcaaggccccauggggcagaauauaauaaauauucugagugaggaguguggucuuuuucugaucuuccucagcuuccguaaguugcagagugagguauauuaggagacuaguucuacacaauauuguaaugcuggguuccaucaacacccaccuuccacaacucagucugcaccucaguuggcaaaggagacuggauggccaucuuuccucauguucccuugaguauuucaauguagaaagcccuucaagugguauuauauuuuaaccuuuuacauuauuguuauuaauguuaguaauauauuguuauguuuucuaaauuauuuuucuuuaagcugacguggcuuuuuuucuguggcucccagugggucuacggaccuuggcugacauauguugguagguacucuggucagcucagcuggcuguccugguucacucagaagauaagucucuccaaagcaaauucacaugcauuaugagucgcuuugagcuucugacaugucacuugccccgagguuaaaacuuuucaccccuugaagaccuuacauguuuuaugguauuggugaggaaggaaauguucucaaggucucaggcuauuugggaaauuccaacuccuauaccuuaccagagcauggaagagcccagaucugaauguaaaacgucucuguucugccagagauggaaaaaauacagguauacuugugauauagucauggggcuucagugucacuauuuucuccuuaaagcuccagccaaaaacuggacaaggauagagaggaggagggaagaacaaaagagcccuucucuaugaaccuugugccuucuguccuaccaguuuucuuuuacagauucucacuucugcuagccuagccagggcuuacuccaggaaucuaaauagaugcccuaguccacuuuaucuuuguucccaaggcacucauuuuuauuuugauuuugauugaaugugagcagguugaccucaggucacacuuuguuccaaaaacuuuuggaauuauuccaggacuugugguggaguuaugguacucuagggcagucuuucucaaacuauguaugguaaaggaccagguuuuuuguuuuccaguccuucacuuaucaauaugcauuccuauugcccaugacagguauggaguucacacugugugcugccgacccggcaaguuugacagcacccaaacuggccagacuguucuguagguuaaguccauugaucauguacuuggauaucacagcaacauugaaaugcuaaaaaguuuuuaaacacucucaauuucuaauucaccaugucacagacuggugaaaaaaaaaaaaagguguucacugaccagcacaagucugcagaucaucuuugaguagcacuguuuuggggcccucggucucucugaagacccuagcagaacugauaccuaccuguaucucuuguucucuccuauuugaguuucacuuccagagaacuuguucuucagcaagaaugugucacuaguaaggacauc

SEQ ID NO: 12970 - RNA, 10061 nt, Homo sapiens
ugcaauacaaucaaucaccuuuauuccggguuagaacaaggccgugcacacugcagacagaagagcacaagauaggggcaaucucacagcaauauaaggagugggugggcagguuagucuuuuuagauuauuuugccuuacagagaaacuacuagacucugcugaaaagaacccugucucucuucucccauuucuuccauaagaaaggcuccuuauucucucucucacucuaauguaacauaucccaaauggaaggacaguucaugcucauuccccccacccaauucuacaaguaucucucucuucuuaagggagaagccagacagggaaagggagacuugggaagguccuuuaaggcaaaacuguggaguccuagagguguguguguuaaggcaggugucugcagcaguggccagaggggcagggcacgcuaggcugggcuaggaguuaagaguacugucuaaccagucuggcuucuuccuucuuccagcagccagcccuccccucccauuaaaguuuuacucccacauccuaaaagcuccuaacuugaacuuugucuaaauagucucugagacugcaugugaauuuaauguuuuuugaaaaagccuucuuuuuuguuuggacuauguagcaauuugauucugccacucccuucacuguggcauuccccucccacccccgcucuggccuagacaauaaguuaaugcuagacaccacaaaaaagggcagacauggcagugcaguuuuaauauacauauauguagaauauauauguacacacaguuagcacggucaggguggggaggggcaucuugggguaggcaggaggcuggggucacucacuguacuguagugauguggcuaggagguguucacaagcccagggggccaggauaucuaguaaagaaggguuuccuaaguaagucccuuccgggauugaauugggguggggaucggugcaaaggaaaacacuguaguuaacuucuuucuggcuugggauguucuucaccaaggagagagggaagguugccuacaauaaccaaguugggacccuauagaugguggugucaggauucguguuaaaaccuaagggucucauucuucaaccucccuagguuuagagugcaacagucugaguaggaacaacugaguggaagagggggcuccccucucucugcccucauccccaucucaggcucagugguacauguucccagcacagucucuccagaguacaggugggugggggcaucuaacgcuggcugcuccaugggguuugaucuuagggaccaggaaaggaucccuggcucauaccuaugcuaggcccaugagagacaaaaagggaccugcugguacucaggaaacaguccagcacaggaguacaaacauggaacucuggcuuuucuuugccccuuccagguggggguugaguggucucuuugccuuccguccccacugcuuuucccuggauccaccuaccucucccauaccuuaccccuaugucagcuccucaauguaggaaaaugcagguccuuucugcuuccacacuuuaaagauauggggggaguggaggaaagggaaguaggaggaaugugcugauuucuauuugcauagaaauagcccccaccuccuccuaaaguggggaaacucagcccccuccccuagccccugacccccauccccuuaagaagaggaacuagaugagcuagacauauagacaaacagccagagcgugcgcacacgcacacacacgcgcacaguaaggggguuaggaccagguuaguaaguggguagaugguggguugcccuugcccccucuccuggaggaugggggaagggaguggucugaugaagguccaaccuuccuccucuuccucccccuugcucaggccuucuucggugggggagccaauuugaugaucucuuccucagagggcugccggauaaugucugggggcaaaaagguauguguccagggacagcagugugggagaugccaggcaggcccauugggcaucugccuccacucucccaaaacucaaguacuccaaggauagucaacgggacgaggcagaggugcagcuaguuaaaggaguggccgcuuaccuuuguacuucuuggcacuggggauacggguuagcuugguguccagcucauccuccucagagaucuucagcacacggguucuguagucaaccaccauagugaguaggucaggacggcgggagaucucaaagaugugcucaauguaggagagguugucuggaggaaggcaggagauagggucagagcuaggcuguagaggucagcuuccccuacuccaccagacuagugaccuggaaccaaagcugaguugcugacauugguuaugggaggguacaacacuggaggaagaggggcuacuaauccaggagaagaaagcuaagguacccaaacaacaauacagaggacuguucgcaggaagggcagauaguuggucagugaaguuucuagauugugguuagaaugagggguuuagcuuagauacuagcucccauauguuguggggaggggacaaaagaaaaaucaacuugacuuccagauaccccacccccacccccauccuuuuccacuuuccauccaaguaaguaucagaauuugcugacagcacauguaggaccagcaggguggaaucucuaggcaacccaggagagauucugggccuggugagaaagguuauucuaaaugagagaagguauggacaccaccagaaggacgauguccauggcuuggccaauuccaggagauuauagaugcccuuagaccuucuucccuggcuccuccccucugacuguugccauacagucuaacuguaacacguccuccuuuauacguucucccugccagccacacagcagucagaauaguauaucugaagggcccugaguucacucaccucaccuauccaauacccaggcucucuacaacacagucuuaccuuaccuucccagccauuucuaaacacccuacauccuagucaagccaagcaggacugauugcauuuccaaacacacuagauacucugugacaguguuccucugccuggcaugcccuccuuuggaucuugccuuagaaaucccacucaccuuucagggccaucuuaaacaccaauucuucccuaaagccuccagcugugagggauuacucuaauccauagaucccacuccccaagcaguagucucucaaaguggauaagaaaaugauagaacuuguaguuuuaaauuuuaccaguuuuuaaaaaaugcuuaacaaagauuaguauuacuauuuaccaguuagauuacacuucgaguucuccccucauucagguauucuuccauuuuuauugucuagaauucuucccaauuuuugccacuuaaaauuuuacuauuuuuagauuguuuuuauguucuguuguauaugugauaauagcacaggaguaucugaauaacauuuuuuaccgaugaggggcacagugaaaaaugucuaaggcccccauacucuuagagcaccucucuucugccuugcuauagagggguacacauuguggauguaaaagcuuugagcucaucucuauuugcugaaugaacugagccugaaugacugaugacaggaccccugugcuccccucccccaccuuuguccagcuuguuguggcucuccaggaagcuaaaccaggcacugccaguagugaucuccucacucuuuucgcuggggaugucuuccuugcaggccgacuugagcuguucuagaucuucaagggugauguuguuggucaggucuugcaggagggucccguacucagccaugacugggguugggaggcgacaaagggauaggaguugagcuuaagguauggagucugguuuacucacuggcacuacccuccuacuccccacucugcccuaccaggcaugugccuggaacauggaggcuggagguggcuagggcuggagggagaaaaggaagaccuaggggaggcagucaggguagacgggaagcuaggagccaggcuggagccuagagugacaagucauaccuccuuccccccaccaucuuuuucuucuguuuucccccucuaacaguaacccuggcaacaguuccccugacugaggaggcgguuaccauagcaaccugcucccgacuuucucacccgcucucuccaaguccccccucagaaucgccccacccacuuccaaccccuccccaugucagggaaaaaaaacuccaaaacaaccagggcgaggcuugcuguggcagugagaagcugagaaagagcuggagggucugguaggaacucauguguucuagcuuccccauucugccucaaaggcaaaggggucccucacuucaacuccccaccaccccacuaaugacucauuuuggauagaugccuaguugcuuggucugaugguuccuuggccccaccaugcuagccuuguauucagucauuaggguucgaggugggggaagcaauggaccacccccaccuuuguggagcccauuuucuccuuugaugguuaccaggcccccacucagcucucucuccuacccuuugugcugugccugcagcccccgugcccaagaauaccaagcaacuggcucuggcccccugcccaguucccaggcuggcugggugguggggggaggggacuuuagaugcggcuuugggagaauggcaaaaggggacugcccccccuucucguaucguaucaacauccuacuggcacuaccuucagcauggucugaugagaucagcaaggccagaucucaccuaggcuuucacccuaucccucuuucaugauccuuaggugagaaguagagaacauucaaggccuuccuuccacuaagauaggaacuguggcuaagacagaagaaagaaggucagauguuugaauggacuuucuggauuugauaaaaugugacacuagugguaagcucaaaaauggaacuuauuuccacaaugaguaucuauuuccuuuuagucagaaaaguaaagcauguuuuaaaaaguaaauuguaucauaaacacucuguaugcgacuagaccaaggggugggcaagcagcaagaugaccuugucccugacggaggcugccugcaaaucaccccagcauuaggcugggaauguggcagaucaaaggggcuugguugacacauucacauuuuccuucuugcucuacugcaggggaacugagauuggcaugguggucacaaaauaagagauacagacccagaaguccccauucccagcccccuaccuggaccagaauaaacaagccucccuugguggcaggcaccaugacacaggcagacaaugagccagacaggagggcuaccaugacccccgcaagaaacaggcagucauaggcaugcucaguugcacacccaggugcaaccagacagaagggcccagcaguggcccugccaggccgggccaggaacaaugcucucugacugucagcaccaggaacugucucugccuugaaaucuaggucacagcagcaagcucuggagcccaaccccccucacuucacugauaauccaaggacagaaggagggggguacgggugagggggaugauggggaggggacuagagauggagauaagaaugaguaggggggcaugaguacaacuggaagggaaagcgcagcaggagacaagaagacccugccccaguggaggaaacucuggggccaagcccucagcuggaaaagggggcaggauuggggguuauacuucccugcuuucauauggaaggagaguuuguaaauauuacagauccugcgggaggaaagagugcaucugugugugugucugugugugugugugugugugugugucgggaggaguucagauuuagggcuuugaaucuaaaacagaucuacagaggagguaggcgggaagagauuaauguguguaacacacucacccacaaagacuugggggcaguggguaggagcuuucuaagagagugaaagauacaaggaggccccuaagagagauggggguaggaauguuaaaguggcagaggagaaaugugugugugcucggaucuuauggaugcuaauccccggguugugggcacagcucuggaggaggcaguggcuggguaucuguggguguguuuggauguucugguaauggagguguaugugccagcacuggauauauggcugugggugcacuggcugugaguaucugucauguguguguuuguaugugucuaaaccagccaagagcauguguaagaaggcauauaaccacaggcucacauccagaggggugaggggagccuacagaauggagaaagagagcuggaguugggagacagaaagagacuaaggcugcaaaugaggcauggggggcgagggggaggagagcauacaguccacaacuauagaaggcuguagccucaucucaucuguuacuauagcaaccucaguucugggugccccccacccccagucguuaggaugacaccacuagaugggaggaguguagggaauggugaguaagaagggacagaaaggauaggaauaaggcccccugacgguacaaggaaaggcagcccaguugccucccuucuuggagagauccauuugccuaggccuuaguauggcagaagaagcaaagggaguguuguuuaggggaacugcucucaauucucacugaucaacaguuguaccugggcuggucuggccuggccaugguggggcuuggcagagcuuguuuccuucauccuccaugucacuuuccucaccagagauucagauuuccuuagggcucguggagaaaucugcucucugggcucugaaaaauccuccugauuucuggagcagugcagagagcugcucagggaucaccaggcagucugggcggaggccauucuugggacaggauaccagggcaggaaucaggaaccggagccccggcugccaggaagucaguccucuucccucccagcuuucugugcuaggcucaccgcuuccucacaccuuccuuccuuccugccucccucuccuuccaagcuggccccaggcacagcccugacaaaggucaaaccaacugaggaugcuggggaagaggggcaggagguaaggaccauuauauacugaccuuuuagggugggacaggugggagcuccaugggcacugggguaagaagagccaggcccugggagugcuuugagaagccuggcaauugggauaaccaccuguggaggagguggcagcaccaaaagaauuucugugcauuuugacauuaagucgugguagauuaucccuucuaacguuugguuccaaauccucuguaaauucgagaaggaagccugaagauuaagaguugcugcccgucccucuuccacaucuguugcagcugccuaagccugaggggaggggccaucccagacagcugcaaggaccuagaggucccuguauugggcaggaggggacucccaggcacucaagucugucagucuucugccugaaguuggaaguaaucacggagaggcagagggguuggaagggagagaguagggguccagcuuuccuauuuuaaauuauaacugggccccaaauucaagcaguccuguaguuuauuuccuuuaauaucauucucaauuaauuucuucuuuaagcuuuuuauccagcuuugugggggaggaggggguugucuuuacuccuguaacaaggaaauugaggguucugaggcuccagggucagccuggaagugacgagaggcaggacaucugggcccuaaaauguucacuucaguccaagaagcaaaauggauuaccuuugggcauggggacaaggauuagccuucagcccuuggucuagaaagagccagacccaagauggggcaucaggagauagcuggcacuggaucaggcagagcagaggagggccggcugauggcgaggaggggaauggggccuaggacucuccccagcccaucucuguuuccacucuucugguguggcacucccugcuucuauuucugucucucuccaucucucucacucuuugucaugcauuuccuuucuacuucaucuuucagucucucuuuuccuccuuucuauaggcuuucaccccuucuagcauuuccuacucaccuauccaacuuagugguagccaugaauacuuaggacuccugagaucugugcuucacuguccccaucugaauauucggagcugcaauuaggaaggggugagcaucccugcuacaaaagacagaguaaguuuggucggaguggcuuggagauucagugguuggcugccuaccagcuggugaagauauccaucaugacauugugcgugaggaucugugugagagagugaggcgcucugugauucugugacccucuucaugcaugauaauacauccacacaugaugggcacggaauugaggaaguaggcaaccagggaagccugcagccuagggcaucacuggcaauuuccccaauggaguauuuaaccacaaagggaagagcaauuaaagcuaaucgcucugacagccuggggcccagacacacguaccacuuucccuaacucccaguggucucccccaaccuucauccucccuaauuuguuuagugcacucucaaacacuguuugcacuucucugaccaucucuuucucucacuuccucccucucccugguucccugacuaucucuagaccucucuggagaugucugucugcuucucacacacauuccucucauucucucucugacuuggguuccauucuuggcugacucauacccauucuuuuuccucuccguuucuuccacccccuccuccuccaucccuuggccacucuuacccagaaacuagccacucccagcacgcuaagcccuaacuggacccaggaagagaagccaccagaagccccuacccucauuaguccgcaaaauccugucuccuuguguuagaggaaugagaccaagauuuucucccaucuuuccccacaguuuuaaagaggaacaaucugaaaccauggggcugggaaaagcugccagaaaaucaggauggauuuggggacaguggcccuuucuguccacucagcuguccugucggacugaugacuuggagcccgcaguucagaagacuccucaugggaugccccaccccacagaguggggguguggugggcggccggaugcguaguccagggacguuugugauuuggagugugcuagacuauguguauaagucacaugggugugugucacugugugugcuggcgugccuuauaggugugcguguuucccugucaguuuugacacggauuauaugaaauuaauaaggguuuuuacguuagauauacaucacuucucuacacccccagcuccuccuucccucuggacaagcuuuccgccaagcccaccucuuccccaggugcagugagcugggggugagggcacaugguaccagccgcccgcggaaccgagacagggcugggccgggagaccgccagcggaggcgaguccgaagccugagcggggagggaggggcgggcgcuggccuggccgagccggcugggcgggaagcaggcugcauccuaauccacaggccccgguccgacucccaaacugccguucagcguggaacgggcuggccggagccacgccgccuccagcacacgcucggcgcucgggacgcaccgaccgagggacggaccccgugaggccugacacaaaguggacucguccgggguccccacacuccccgucuggcccccggugucccagaucguugccccuccaagccuagaccccgaaaucugccccuuccccgcgacaugucuccucuccgccccucucaccgccucuggagcugagcgcucagggcgcgggcacuccugaguccccgguuccuaagcagcguccggaaccuccuccucggcucccgccgccgccgccgccgcuucugccgccgccgccgccucuuccgcccgcggagccggagcccgagcccagcgccgcucacuccacccggcuggccggugaugucagagccggggaggggcggggggcg

SEQ ID NO: 12971 - RNA, 10061 nt, Homo sapiens
cgccccccgccccuccccggcucugacaucaccggccagccggguggagugagcggcgcugggcucgggcuccggcuccgcgggcggaagaggcggcggcggcggcagaagcggcggcggcggcggcgggagccgaggaggagguuccggacgcugcuuaggaaccggggacucaggagugcccgcgcccugagcgcucagcuccagaggcggugagaggggcggagaggagacaugucgcggggaaggggcagauuucggggucuaggcuuggaggggcaacgaucugggacaccgggggccagacggggaguguggggaccccggacgaguccacuuugugucaggccucacgggguccgucccucggucggugcgucccgagcgccgagcgugugcuggaggcggcguggcuccggccagcccguuccacgcugaacggcaguuugggagucggaccggggccuguggauuaggaugcagccugcuucccgcccagccggcucggccaggccagcgcccgccccucccuccccgcucaggcuucggacucgccuccgcuggcggucucccggcccagcccugucucgguuccgcgggcggcugguaccaugugcccucacccccagcucacugcaccuggggaagaggugggcuuggcggaaagcuuguccagagggaaggaggagcuggggguguagagaagugauguauaucuaacguaaaaacccuuauuaauuucauauaauccgugucaaaacugacagggaaacacgcacaccuauaaggcacgccagcacacacagugacacacacccaugugacuuauacacauagucuagcacacuccaaaucacaaacgucccuggacuacgcauccggccgcccaccacacccccacucugugggguggggcaucccaugaggagucuucugaacugcgggcuccaagucaucaguccgacaggacagcugaguggacagaaagggccacuguccccaaauccauccugauuuucuggcagcuuuucccagccccaugguuucagauuguuccucuuuaaaacuguggggaaagaugggagaaaaucuuggucucauuccucuaacacaaggagacaggauuuugcggacuaaugaggguaggggcuucugguggcuucucuuccuggguccaguuagggcuuagcgugcugggaguggcuaguuucuggguaagaguggccaagggauggaggaggaggggguggaagaaacggagaggaaaaagaauggguaugagucagccaagaauggaacccaagucagagagagaaugagaggaaugugugugagaagcagacagacaucuccagagaggucuagagauagucagggaaccagggagagggaggaagugagagaaagagauggucagagaagugcaaacaguguuugagagugcacuaaacaaauuagggaggaugaagguugggggagaccacugggaguuagggaaagugguacgugugucugggccccaggcugucagagcgauuagcuuuaauugcucuucccuuugugguuaaauacuccauuggggaaauugccagugaugcccuaggcugcaggcuucccugguugccuacuuccucaauuccgugcccaucauguguggauguauuaucaugcaugaagagggucacagaaucacagagcgccucacucucucacacagauccucacgcacaaugucaugauggauaucuucaccagcugguaggcagccaaccacugaaucuccaagccacuccgaccaaacuuacucugucuuuuguagcagggaugcucaccccuuccuaauugcagcuccgaauauucagauggggacagugaagcacagaucucaggaguccuaaguauucauggcuaccacuaaguuggauaggugaguaggaaaugcuagaaggggugaaagccuauagaaaggaggaaaagagagacugaaagaugaaguagaaaggaaaugcaugacaaagagugagagagauggagagagacagaaauagaagcagggagugccacaccagaagaguggaaacagagaugggcuggggagaguccuaggccccauuccccuccucgccaucagccggcccuccucugcucugccugauccagugccagcuaucuccugaugccccaucuugggucuggcucuuucuagaccaagggcugaaggcuaauccuuguccccaugcccaaagguaauccauuuugcuucuuggacugaagugaacauuuuagggcccagauguccugccucucgucacuuccaggcugacccuggagccucagaacccucaauuuccuuguuacaggaguaaagacaacccccuccucccccacaaagcuggauaaaaagcuuaaagaagaaauuaauugagaaugauauuaaaggaaauaaacuacaggacugcuugaauuuggggcccaguuauaauuuaaaauaggaaagcuggaccccuacucucucccuuccaaccccucugccucuccgugauuacuuccaacuucaggcagaagacugacagacuugagugccugggaguccccuccugcccaauacagggaccucuagguccuugcagcugucugggauggccccuccccucaggcuuaggcagcugcaacagauguggaagagggacgggcagcaacucuuaaucuucaggcuuccuucucgaauuuacagaggauuuggaaccaaacguuagaagggauaaucuaccacgacuuaaugucaaaaugcacagaaauucuuuuggugcugccaccuccuccacaggugguuaucccaauugccaggcuucucaaagcacucccagggccuggcucuucuuaccccagugcccauggagcucccaccugucccacccuaaaaggucaguauauaaugguccuuaccuccugccccucuuccccagcauccucaguugguuugaccuuugucagggcugugccuggggccagcuuggaaggagagggaggcaggaaggaaggaaggugugaggaagcggugagccuagcacagaaagcugggagggaagaggacugacuuccuggcagccggggcuccgguuccugauuccugcccugguauccugucccaagaauggccuccgcccagacugccuggugaucccugagcagcucucugcacugcuccagaaaucaggaggauuuuucagagcccagagagcagauuucuccacgagcccuaaggaaaucugaaucucuggugaggaaagugacauggaggaugaaggaaacaagcucugccaagccccaccauggccaggccagaccagcccagguacaacuguugaucagugagaauugagagcaguuccccuaaacaacacucccuuugcuucuucugccauacuaaggccuaggcaaauggaucucuccaagaagggaggcaacugggcugccuuuccuuguaccgucagggggccuuauuccuauccuuucugucccuucuuacucaccauucccuacacuccucccaucuaguggugucauccuaacgacuggggguggggggcacccagaacugagguugcuauaguaacagaugagaugaggcuacagccuucuauaguuguggacuguaugcucuccucccccucgccccccaugccucauuugcagccuuagucucuuucugucucccaacuccagcucucuuucuccauucuguaggcuccccucaccccucuggaugugagccugugguuauaugccuucuuacacaugcucuuggcugguuuagacacauacaaacacacacaugacagauacucacagccagugcacccacagccauauauccagugcuggcacauacaccuccauuaccagaacauccaaacacacccacagauacccagccacugccuccuccagagcugugcccacaacccggggauuagcauccauaagauccgagcacacacacauuucuccucugccacuuuaacauuccuacccccaucucucuuaggggccuccuuguaucuuucacucucuuagaaagcuccuacccacugcccccaagucuuugugggugaguguguuacacacauuaaucucuucccgccuaccuccucuguagaucuguuuuagauucaaagcccuaaaucugaacuccucccgacacacacacacacacacacacacagacacacacacagaugcacucuuuccucccgcaggaucuguaauauuuacaaacucuccuuccauaugaaagcagggaaguauaacccccaauccugcccccuuuuccagcugagggcuuggccccagaguuuccuccacuggggcagggucuucuugucuccugcugcgcuuucccuuccaguuguacucaugccccccuacucauucuuaucuccaucucuaguccccuccccaucaucccccucacccguaccccccuccuucuguccuuggauuaucagugaagugagggggguugggcuccagagcuugcugcugugaccuagauuucaaggcagagacaguuccuggugcugacagucagagagcauuguuccuggcccggccuggcagggccacugcugggcccuucugucugguugcaccugggugugcaacugagcaugccuaugacugccuguuucuugcgggggucaugguagcccuccugucuggcucauugucugccugugucauggugccugccaccaagggaggcuuguuuauucugguccagguagggggcugggaauggggacuucugggucuguaucucuuauuuugugaccaccaugccaaucucaguuccccugcaguagagcaagaaggaaaaugugaaugugucaaccaagccccuuugaucugccacauucccagccuaaugcuggggugauuugcaggcagccuccgucagggacaaggucaucuugcugcuugcccaccccuuggucuagucgcauacagaguguuuaugauacaauuuacuuuuuaaaacaugcuuuacuuuucugacuaaaaggaaauagauacucauuguggaaauaaguuccauuuuugagcuuaccacuagugucacauuuuaucaaauccagaaaguccauucaaacaucugaccuucuuucuucugucuuagccacaguuccuaucuuaguggaaggaaggccuugaauguucucuacuucucaccuaaggaucaugaaagagggauagggugaaagccuaggugagaucuggccuugcugaucucaucagaccaugcugaagguagugccaguaggauguugauacgauacgagaagggggggcaguccccuuuugccauucucccaaagccgcaucuaaaguccccuccccccaccacccagccagccugggaacugggcagggggccagagccaguugcuugguauucuugggcacgggggcugcaggcacagcacaaaggguaggagagagagcugagugggggccugguaaccaucaaaggagaaaaugggcuccacaaaggugggggugguccauugcuucccccaccucgaacccuaaugacugaauacaaggcuagcaugguggggccaaggaaccaucagaccaagcaacuaggcaucuauccaaaaugagucauuaguggggugguggggaguugaagugagggaccccuuugccuuugaggcagaauggggaagcuagaacacaugaguuccuaccagacccuccagcucuuucucagcuucucacugccacagcaagccucgcccugguuguuuuggaguuuuuuuucccugacauggggagggguuggaaguggguggggcgauucugaggggggacuuggagagagcgggugagaaagucgggagcagguugcuaugguaaccgccuccucagucaggggaacuguugccaggguuacuguuagagggggaaaacagaagaaaaagaugguggggggaaggagguaugacuugucacucuaggcuccagccuggcuccuagcuucccgucuacccugacugccuccccuaggucuuccuuuucucccuccagcccuagccaccuccagccuccauguuccaggcacaugccugguagggcagaguggggaguaggaggguagugccagugaguaaaccagacuccauaccuuaagcucaacuccuaucccuuugucgccucccaaccccagucauggcugaguacgggacccuccugcaagaccugaccaacaacaucacccuugaagaucuagaacagcucaagucggccugcaaggaagacauccccagcgaaaagagugaggagaucacuacuggcagugccugguuuagcuuccuggagagccacaacaagcuggacaaaggugggggaggggagcacagggguccugucaucagucauucaggcucaguucauucagcaaauagagaugagcucaaagcuuuuacauccacaauguguaccccucuauagcaaggcagaagagaggugcucuaagaguaugggggccuuagacauuuuucacugugccccucaucgguaaaaaauguuauucagauacuccugugcuauuaucacauauacaacagaacauaaaaacaaucuaaaaauaguaaaauuuuaaguggcaaaaauugggaagaauucuagacaauaaaaauggaagaauaccugaaugaggggagaacucgaaguguaaucuaacugguaaauaguaauacuaaucuuuguuaagcauuuuuuaaaaacugguaaaauuuaaaacuacaaguucuaucauuuucuuauccacuuugagagacuacugcuuggggagugggaucuauggauuagaguaaucccucacagcuggaggcuuuagggaagaauugguguuuaagauggcccugaaaggugagugggauuucuaaggcaagauccaaaggagggcaugccaggcagaggaacacugucacagaguaucuaguguguuuggaaaugcaaucaguccugcuuggcuugacuaggauguaggguguuuagaaauggcugggaagguaagguaagacuguguuguagagagccuggguauuggauaggugaggugagugaacucagggcccuucagauauacuauucugacugcuguguggcuggcagggagaacguauaaaggaggacguguuacaguuagacuguauggcaacagucagaggggaggagccagggaagaaggucuaagggcaucuauaaucuccuggaauuggccaagccauggacaucguccuucuggugguguccauaccuucucucauuuagaauaaccuuucucaccaggcccagaaucucuccuggguugccuagagauuccacccugcugguccuacaugugcugucagcaaauucugauacuuacuuggauggaaaguggaaaaggaugggggugggggugggguaucuggaagucaaguugauuuuucuuuuguccccuccccacaacauaugggagcuaguaucuaagcuaaaccccucauucuaaccacaaucuagaaacuucacugaccaacuaucugcccuuccugcgaacaguccucuguauuguuguuuggguaccuuagcuuucuucuccuggauuaguagccccucuuccuccaguguuguacccucccauaaccaaugucagcaacucagcuuugguuccaggucacuagucugguggaguaggggaagcugaccucuacagccuagcucugacccuaucuccugccuuccuccagacaaccucuccuacauugagcacaucuuugagaucucccgccguccugaccuacucacuauggugguugacuacagaacccgugugcugaagaucucugaggaggaugagcuggacaccaagcuaacccguauccccagugccaagaaguacaaagguaagcggccacuccuuuaacuagcugcaccucugccucgucccguugacuauccuuggaguacuugaguuuugggagaguggaggcagaugcccaaugggccugccuggcaucucccacacugcugucccuggacacauaccuuuuugcccccagacauuauccggcagcccucugaggaagagaucaucaaauuggcucccccaccgaagaaggccugagcaagggggaggaagaggaggaagguuggaccuucaucagaccacucccuucccccauccuccaggagagggggcaagggcaacccaccaucuacccacuuacuaaccugguccuaacccccuuacugugcgcgugugugugcgugugcgcacgcucuggcuguuugucuauaugucuagcucaucuaguuccucuucuuaaggggaugggggucaggggcuaggggagggggcugaguuuccccacuuuaggaggaggugggggcuauuucuaugcaaauagaaaucagcacauuccuccuacuucccuuuccuccacuccccccauaucuuuaaaguguggaagcagaaaggaccugcauuuuccuacauugaggagcugacauagggguaagguaugggagagguagguggauccagggaaaagcaguggggacggaaggcaaagagaccacucaacccccaccuggaaggggcaaagaaaagccagaguuccauguuuguacuccugugcuggacuguuuccugaguaccagcaggucccuuuuugucucucaugggccuagcauagguaugagccagggauccuuuccuggucccuaagaucaaaccccauggagcagccagcguuagaugcccccacccaccuguacucuggagagacugugcugggaacauguaccacugagccugagauggggaugagggcagagagaggggagcccccucuuccacucaguuguuccuacucagacuguugcacucuaaaccuagggagguugaagaaugagacccuuagguuuuaacacgaauccugacaccaccaucuauagggucccaacuugguuauuguaggcaaccuucccucucuccuuggugaagaacaucccaagccagaaagaaguuaacuacaguguuuuccuuugcaccgauccccaccccaauucaaucccggaagggacuuacuuaggaaacccuucuuuacuagauauccuggcccccugggcuugugaacaccuccuagccacaucacuacaguacagugagugaccccagccuccugccuaccccaagaugccccuccccacccugaccgugcuaacuguguguacauauauauucuacauauauguauauuaaaacugcacugccaugucugcccuuuuuuguggugucuagcauuaacuuauugucuaggccagagcgggggugggaggggaaugccacagugaagggaguggcagaaucaaauugcuacauaguccaaacaaaaaagaaggcuuuuucaaaaaacauuaaauucacaugcagucucagagacuauuuagacaaaguucaaguuaggagcuuuuaggaugugggaguaaaacuuuaaugggaggggagggcuggcugcuggaagaaggaagaagccagacugguuagacaguacucuuaacuccuagcccagccuagcgugcccugccccucuggccacugcugcagacaccugccuuaacacacacaccucuaggacuccacaguuuugccuuaaaggaccuucccaagucucccuuucccugucuggcuucucccuuaagaagagagagauacuuguagaauuggguggggggaaugagcaugaacuguccuuccauuugggauauguuacauuagagugagagagagaauaaggagccuuucuuauggaagaaaugggagaagagagacaggguucuuuucagcagagucuaguaguuucucuguaaggcaaaauaaucuaaaaagacuaaccugcccacccacuccuuauauugcugugagauugccccuaucuugugcucuucugucugcagugugcacggccuuguucuaacccggaauaaaggugauugauuguauugca

SEQ ID NO: 12972 - RNA, 11339 nt, Homo sapiens
uucaugcugccccagaugucuuuauugaggccucucauuugacccaaauacauuaacaagugauugcugagauacagucccaaacacaguauucucccuuccuucuggccaaggacaggacagucagaaagauacaggauuagagagagugggggaaagcugugcauagauggagggaacagaacagagauggggcccauauauauggcuagaggagaaucacaagaaagaguauggagagugauggaagagacacauaauagauacaaguaaguuaugggauaagaaacagaagucagauaagagagagcuggccuggugucuagggaaaaguagcucauuugcucaucaaaugagggggaucagugucucagcacccagcauauagaccccaguuagcucuauggcagagaauaaccuagucucccuggaggaacucagggaaggacaagggaaggcaggagagagcaugaaaagaccaguggggcugaaagaugguugccauagcaacuagucaucaucaucaucgucaucguccucuguguugaucucgcccuccaggacauccuccagccaguccuccagcuccucagcagaaggcagguccuccucaucguccauuuccauccauacgcuauccgccuaggagauggcacaggcagggacggaagcuaaguccaacccgggucuuaggaucugucuucccacucacuggacucuguacauccuucccuacauucucagucccuuccuuucaucugccaaaggccagggaaacuguccaggugaagguauggguuauggguuagaauagugacaggugagagugggaagaaaaguuggauuggcaaauagaccuucucccuucaaucugucucccgugcucuugccacacugaacuucccuauuaugccuuuggugcaaaaccacugguagcucuucauggcuuauaagaauaaaguuagcaacucuucggcauucaggacauuucuuucuuucuuucuuuucuaaaagagacauggucucacucuauugcccgggcugaagcgcagaggggcagucauggcucacugcagccuugaacaccuggccucaagugauucucccaccuuggccucccaaaaugcugggauuacaggccugagccacuacccuggccccagggcuuuucauaaccugcuuuucuaguaccauucucagugaucucuagacucucaaccauaaaaauccaccugccuuuuccgggaaccugauauucauuuuccuguuuuuaacuuuugaucuugcuuuuuccucaguuuggaaaugacuucccugaaucaucacuuguugaaaucguauacauuguagaaucuccauuuugaauaucacuuuuucuuaaacuuuucucugauucugucaagcagaaaucaaugugauccugugucuuauuuguaucguuauuauaaaguuuaucagaucuggccuuguaguuaauggaacacuugccucucuaauuagucugagaauucuaugaaagcagagacuguggcucauucaguucaacuuagcaguuuugaagcaccuacugugugugcauaagaagacuucugcccugaacaagcucaaaaaucuacuggaagagacacacauaauacauaaauagccauuuaaaugucauguucucaauggcuauugagcccugggagugccagggagggaaugauuuuaaaugggagaucuggaaagacuucacagaggagaaagaauuugaacugggccuugaaggaugagccacugauuccaacaugugggacagggccacauucagauccuaagucucccccuccauccagccacuagacugggcaugucugcguccugugagaagggcccaacuccuaguuagcagagaggaggagagcuagcuaugcuaggaaguagagucgggggucaacccgggaugaggacaggaaacucacaucaguaacauugacgacuccuauuuguggggcugacaagucgaugucaaacgucuucucccaguaugggaccagcuguagagagaucaaaauacagcaacuuaauagauacuagggagcacaugaauccaggaggaugagugugagggucagcccagggauggagaggggacagugcgaacuggcaguggauggggacagguccaccugugagggcaucaaggcaaggguagaacuaaacaacaaaagaggagaaauccuaaagggagagaaucgggagggucagcugggugcacuggccccucuuuucugaggaaaacuggauaggaaacccuguucugauccuggaucagauccuuguguucaaggucaagucacuucucucuggcccucagaucuuacauuucuaaaauaaggcaaguauaccugguaagugccaauguuucucacguuucucuuuguucuuucaguuacucauucaacagcgagugcuagguguugggaauguagcugagaacaaaaucaucuccugaaacagggaaucucugugcuaugauucuaugauugaguguguauacccaugugcaggacuauugugccucacaacauugguuuucuuuaggagucagcccuagcaccugagcuacccauccagccucugcucugggaaugugugugauguccguccuguuuccccuugcucaggaugcccuccaugccaacagugcccuuaagcaugcaacacgcauacccucccagggccccccagcuaggagguggggaugggaccucugaaacaaagcccucacuaagaagaugucacaguccaaggccccaccuuaagauagcagugccugagcugugccucuuaccagggggaagucaucagggucaauccagaugaugcuaagaucuggguuuucaguguuaucuugggccacagccuugagagucucuaagaacucgaaaccaucuuggagggaacacaaguacaagguaugagguguguagagaggaaagggacccaggugaaacaggagugcagagcuaccucccugcuccccaagcuucacaugucuagcccuaggcuguuugcaaacucccaggaaagccuccuagugaggcccaugcuccaauaaacacacccaccucccccugccuucccuccaguccaacccgguauuccucccucaccaggaucagcuuccucugcgaaggccacaauguggauuccauccauaucauccuccugucaggggguaagaaggagaacaggguuuuggagaagaccuuacuauacucccugaaguugaggagcccagaacagauccuagauguucauugaaccucaauuuuguggaaauccagcuucaggaccagauauauucuuucguuuuuugggguuuguuuuuuuuuguuuuugagacagaguuucacucugucccccaggguagagugcaauggcgcgaucucggcucacugcaaccuccgccucccggguucaagcgauucuccugccucagccuccugaguagcugggauuacagccaugcgccaccacaccuggcuaauuuuguauuuuuaguacaacauuguuucaccuuguugaucgggcuggucucaaacuccugaccucagaugaucugccugccucagccucccaaagugcugggauuacaggcgugagccacugcgccuggccauauauauucuugugauggugaccuuuuuccaagugacacuccuuucagcuccaaggccccacacuuccucugauaaucccuuuauccccaggcuugaggcucuucccuugucaucuucaauuaugucugucucccauuuccucacacauucuucaguguagaaaucuuucaguugcugcuagugcacuguuuuuucuuuuuucuuuuuuuuugagacggagucucacucugucccccaggcuggugugcaguggcggaucacugcaagcuccgccuccuggguucaagccauucuccugccucagccucccaaguagcugggacuacaggcgcccgccaccacacccugcuauuuuuuuuguauuuucaguagagaugggguuucacuguguuagccaggauggucucgaucuccugaccucgugauccacccaccuuggccucccaaagugcugggauuacaggcaugagccaccacacccagcuggucagugcacuguuuuuucuaaaaaugggccugaggagcaguagggugggguuuuucuaggacuugagucuucuggcacccaugcuucccugagggcuugacccuggccaggggcacucacccaggucucauacauacucuccggcuucaguuuccucaggguugaucuagaagagacagacagagugucauuacucaguggguuagaaggaugcccccuccagaggguccuguagcaaaggcugccucuaggucaggcccagggcacagacagcuuguagccuacaacaaagccaucuggcaaggccucaacucugggcaccaggcccggcucauugcaugguuaaagcggugggagaggggagggugggcaaagggacuggaagagagacugggggagaaaggcaagaacuggacaucaggauauucauuaauuuauucauucauucacucacucacuaugauugagugcccgauauguucuaagcacuaugcuaggugcuggguacauacaguugaaccaggcaagcauguuccugccuugaugaagggagccaguaguaugggagaguaaguacuguauauacugcaagggagcuugcagugauccaccacugcacgcuagccugggggacagagugauuggauauuuccagcuguggacuacuaugaaggaagggaauuaugugugagugcccggcaggauuauucaaccucagcacuauugccauuuggagccagauaauucuuuguaguagggggcuguccugcgcacuguagaauguuuagcaguaucccugggcucuagccacuaaauacuaguagcacucugcacaaccaaaaaugugucuagacauugccaaacauccuuuggagggcaaaaaccuaugcccaccucgccacgccuucccaccuuguagagaaccauugguguacgauauuguauuagaaagaacauggggccaggcgcaguggcucaugccuguaaucccagcacuuugggagaccgaggcaggcgcaucacuugaggucaggaguuugagaccagccaggccaacguggugaaaccccaucucuacuaaaaauacaaaaauuagccaggugugguggcgugccuguaauuccagcuaccugggaggcugaggaaggagaaucgcuugaaccugggaggcggaggcugcagugagccaagauggcgccacugugcuccagccuaggggauagaguaagacucggucucggaagaaaaaaaaaaaaagaagaagaagaaaaaaagaacaaacaugggacacaucaggguuaaaaucaggguuaaaagcucugacacuuauuaccuguagaaacuuucacugagguuaaaaggacuuaauauaaucauagagauggaaaguaccuugcaguuccugccccaccacaggcagucaacacucauuuguugacagagauuauuuaagucucaaucaaccucacacugaauuauacacacuuaugaaggacccucucgguguagggcucagggcuaaguagugggguauaaaauauugugcaaaauugucaguguaucagagagcacuggugcccaaaguguauucaucuccaggcaagauuggcuucccgguuggcuaagcuuuccccagcccaucucacacaguguguucuagcccaaggaggagccgaccccgcugagaggguugcccuugguccccaccuccugugcuccuccacgaaguugacaaucuccucuucgcuauugggcuugucugggauggucacaggcucuuccaugaaggccucguagaaaucaaucucauucagcuucagggucagcuucuuugccaccuuugggagaggggguaggaggggaguggagcaggagacacagggucaugucgagaagcaguauaaugggggaacaaauauuaggaagggagucagaaagccgggauccuugucacugccacugugacaccugacaagugucuuaacuugccugggguuggguuuaacaugagagggguguuagaucaucuaaagccccucuucagcucuaaaucuauggagugggaggagccgggggggggggcagguagggagugccagcacguaggaagggaccaggucagccaucgauucugggagaggaaacuggaggacagcuucaggacaugaggcagaaccaauacagcugcggggaggagaaccuugcugucgaagguggcgaagaaggggauguagggaugaaacuccucagcugcauccucgaaggcuuuguaaucugggggguggaaugcagagucagucucuggggaaaccagggucugcccgggaaucaucccccacuaucguccccaauucuuugcaggcaggguucauuuugagacccaccccuucuaguucuucgagagugaggggaagguggaauacuggaggugcuugucugggaacccccagaguacagggaggucagagcuguugauggugcugaccacggcuggaggaagaggugggaagugcagagguagaggcugagacacugggugauguggggaggugggaggacaggugagauggggauccagagaggggcacaguggagucugaggguuacccacgcucugagucuuugcucuugaaguagccaaugaguuugaucucauccucaauauucucaaacgccugcagcucucguucaccuucaaucaauuccacaggguccucuaggaccugaaagaggaggacauugcaggaagagaguuucuauccucaaguagaaccagaaagggaccuagggaaaagaaggcuggggaacuggaggagggggcuagauguugacagugugugggugugugugugggggauugcaugugcguguguguguauagugugugaugugugcaguguguggugugcauguguggugugugugugcaugugauauauauguauggugggugugugguauguauaugaugugugugugauguguguggaugguaugaguguggugugcauguggugcauauguguaguguucgguauguaggugauguguggccuacuguguacauguguggcaugugugugaugugugugaaugugugguguguguacguguggagugugcauguggugugugcauguguguagugugugcauguguggugugcagguauguaugugcauguggugugugugugcgcauguacggugugugugcaugugauauaucugguggguguguggcauguauauguugugugugguguguauggaugggugugugugguguguguuguguguguggugugcauguggugcauaugcauagugugugguaucuaggugauguguggccuauugugugcauguguggcauaugugugaugugugugcauguguguaguguguguguacauguguggcguguguggugugugcauuugcguggcauggauguggugugugugcaugugugguguguguuuguuguguaugugcauguggugugugauguguguggaguguguggugugcauguggugugugugugcaugugauaugugugugaugggugugugguauguauaugaugugugugugguguguguaguguguguggugugcauguggugccuauguguagugugugguguguaggugauuugugaacuauugugugcaugugcaugcauaugugugguguguaugcaggugguguguguguguauguauggugugugugcgugugguguauguauggugugugugcgugugguguauguguguguguguggugugugugugcagugucagguugggguugguagggacuagggggcaggcaguggaguuuucaagcaaggccgucagguccaggggaguccuuacaucaagcagaaacuccacgauggugucagcagaaaacucgccaucguacucaaugacuucaucucccuugaauacauacaugcuguccacuucaguuaggccuagggagugagccgggcgcaggggugggguagugagccaugaucccaggcuucccacagauucaagguccaaauccucggccacagcccguuugauaaucaccggggccccacaugcuccaccucaugggcccguugccccacccaccuccucugacccagaggccgacaggccugaggucucugccccuggauuaagccuagggggcuagcguggccccagagcuuucuagggaguagcugggggaucagguagggugaggggagggaauagagagguguagauucuagcaguauuucuccccuucucugaccgcaacgacuagagaugaguauucaugccacccccucugagcacucuaguagcugguucccagucaagcucuuuaauugcuauuacugaccagaugacuucauuauuacugaccaccccucccccaugcauguccagaaucccgucucaagccugugcugcccccuaguggcugacugcucuaacaaccauggcucuggaugggagggguuggaagcggaguuugcagaggucuggccagccccgccuguauuccccgacuccccuucccuccagcaccuagccauguuuuaagguaaguauaaagaaggccucccccaccucuuucugggauuugagcauggaacuucauaaggaauagagaggcagagucuccgagccauaacccucccaaccucauauuuucucacccccucuuuuagaauagacauaaaucugagagauucccaagccccucggaucccaaggacugccugacagguccuccgcccuaagccuccccuugucucaaugccaccuuccccuccccugcccuccccucucuuaccuaguuucuuggccacagcugcauccuucucagagucuaccagcccgaagccaacacccuugucuucuaggacuugggcugcuaacuggagggaaggauuaugauuaaaauuagccccuggaauuuuuauuauccccuauucucccucucaugcuuucaaguugggucaguugaggugcgggagauauaagaguugaccuugacccuuugcuaagauccagaauaucccccaaauucccuacagccacacaguucuguuuuuggcucaacuuaguucaugaauauugauugcucauuugcaaugugcuuauuauguuggacuugaagacacugcacucaauacuucccagugccuaagagguacugaggagucuggcuucagagugacugagggccccuucccuccuucaggguugaguccugcauuccauccugcucaagucacaccuggaggucccugucccuggucaagggccaagcucagugugggguugaucuuggaagucccugagauucuucagagugacucccaaugggaagaauuuuggagggugggaggguaguggugggucuggucauguuguugaggaguuggggaaggccagagagcugagauaagaggucaccauuuguuaccccccagagggagagagacugacagcgaccggacaguucuccccaucagggcccaacuuuccccuuucgcacucuacuucagccuguccuuaggcuguggacagucacaccuggaggucccugcccccauaagccuuccagcuuagcguucaacccugauuuucucugcugugggcacagcuugcagcucuacccccacucagcacagacucagguacugugauucucagagggguggggaagggaggcgguuggcagguggauggccagggauacugagcacucaggauaaaaauacucggcucauuaaucagauggcagguucuagcacccagcaggggugcacaaaaugagagccugugguucuggugucucacccugaaaugcuccaagcucuggacaagcugaggccagagaaggggccacaggagcuuggacaagaaaacucacaucccauuuccuaaagguguguguguaugaacacauucccaaacauagguuuuuuuucuuuucuuaugauaacuucuuucuccuuugggccugaagucauuuuggaggugaggagacuuuucccacaaaaagaagauuggggaagacauucugacaccuccugcaaccauaagaauuuuccagugagggcauccagcuuauccaauggagacaaauggggaauuagggagggggaaggaagagagaggggacugggaguccaaugggaggcaugaucucuaggagauauuuaaacauggcaugcaaguaucauaacauuuacauuuacacucaguuuggaucucuuuggggugcagccccugaaguauguggagaggacguguucuggcuaagcagaugggugggguaggggagugcaauauacacugcuguucuccccuggcccuccaaguaccucccuuuuucacccucaguguccuagccaaaccuaagucaaauacuaccagccuccuauagcagggaggggagcucuuccugcagcaccccugcuaaagguuuccugacgcugauaguacuuuuggguuccugagacucuguuucucauuugacuaaagccacaugccacuugcauccuguuggucaggacaggguuccuaccacacugccccucacccccagaucccauccucaaagagcuacauggguguaggauaggggauuccggagaggggcuagacaugcucugcaggccugcagugcccccaacucaccuccaggaucagcuccuccaucucaaauugucuuugugaggccuugucauccucgggggguucaugguagaggagugccagcaccucauacuucuugaacacauucuuguaguucuuugcauugacauugaucacacgguccacaccaucguacucagggaaguccagcccuuccugccccuguaccccugacuugggugucccuagcaccagcagcaacagcagugccagccgcagacccggcacagcucugggccccauccugucuguagcacucauggagguagugggaucuggguuggcucuccugguccagaagagguuagcugggguagggaggggccccugggucccagauucugaguuaggggcucaagugggaggggggauuggggaauggcccagagcaguggacagagggcacugcuggguccuggagaaacugccgacagagccaagggaaaaagggucagguggaggaau

SEQ ID NO: 12973 - RNA, 636 nt, Homo sapiens
acuauuagagcuaucauacaaaggagugggcccuuuaugaaguggugagcuaucaauccugggagguaaucaaguauaagcuagaugcccauuguuagaaaugcuccuuuggggagcccuguauggagugagaaguuggacuagaggaucccuaagguuaguuucaagguuaagcuuuuuuugguuggcaucaccaaaugacaggaggggaaaaaagagcuggacauuaagaggaguuggggcaaauggagaagacacgagggagcuggguaagaacaggagcuagggagggggggaaauggacuggaccaaagggaggugggagcccuuaggaaggaauagaagggagggugcugggaguaggguuguggaaugagaagaggagagggaagccuggagcugagauucccccugaccggugccccuccucccaggaaugacaugccaagcucggagcuccuaccugguagacgaggugcuguggggccaccgcuucacgucagugcugacucuggaggacggcuucuacgaaguggacuaugccagcuuucacgagacuuuugaggugcccacaccuucgugcagugcucgagagcuggcagaggcugccgcccgccuugaugcccaucucuacug

SEQ ID NO: 12974 - RNA, 3492 nt, Homo sapiens
auuagaauuugugaucaacauuuuauuggcaagucagccacauaaugauuaagauauucuaggucagacagacuggguuuugaguucuagcacugucacuaguuagcuaugugacuugggaaaauuacuuaaucuccauaagccuugguuuucuucauuuguaaaggugggaauaucuaccuuacaugaaaaguacuuagcauaaugccugguacauugcaaaugaguccucaacaaauccagcuauuauaaauaauaguaaucaucaucaucauaaucaucauuauaugaguggugaugugcugccacuauauauauggcuaauauacugcaaaaaaaugguuagaauuaucaaucuaaggcauguaaugauaccaaggcauauaaaaggacauagagcuaucacaauaugaauauggaauauauaagauuaacacaguucaucuccaagggauaaauugaaguguaggauggaugagcagcagguaguucugggagcugcauguucagacugcaugaagucaccuccuuuuccuuauucuagucuagaagacuuccccuaggaagcaggcuuauucuauaaaauccaauuagucaguauuuacuaagcauuuaccaugugccuaagacuacaauaaauuacacauaauugaaaaaaauuaaggauaagauauaauuucuacccccaagaacccuauaaucucuugugagggcuaugaauacaaucuaaaauaaaguaucaaauucuacaaugcggacuauguaagugcacuaaguaaccacggaaagggaagagcuaauggguuacaguccuuggcaagaaauucauggaaguaggguuggagugggguggggggagcaggggaccuugacauacauaaaggauauuuaaaagggaaaauaacugggaguugggagcaauccaaagaugccacucuagaaauauucugguaggaggaaccucuaaaaucaauucaacuuuacugaauggcuacuaguacuguguuagauguugagguagagaaaagaacaagauaaucucugauaccgaagaauugaaaguguccugauggaaaacuaggagagcaaaacaaacaaaaacaguuauuacaaagcagugugacaaaugcuguaacaaaggaaugaccagggaguucuggagcacugggagaacuuuuaguagcauggcagggucuucugugugagugauuuucuggaacuuagaucccguccgccccagucuaccuauccucggacaggggaggggacuggcaucuaagucauucauucugcgugaugaggaagugagugggagcugggagcuaacacuugcacugaugccugaaggguugaguagguauuugccagagugauuggagagcggauggcaacuuugacagaagaaauagcaaauacagagauacugaggcauaaggggcugacaaguuaaggaauuuugugacgcuuuccugucuucuuucccaucaccuucaccuaggguugccggauaaaauacaagcugcccacuuaaaucugaaucucugauuaccaacuaguaauuuaaaaauauaaguaugccuccaauauugcauggaacauacacacucagcccccuucaacucauccuguccuguccggggcccacaaauccccggugaauaccggcgagcuaguggaguaaagcaugagaaggcuuaucuuccuuucacuccuacauuuuucacucucggaucuccagcccaggacugaaggauguagcgcgcagcccgcagcucgcugcucgucggaggguuuuccucugaggacuggaaauggggcgcgggaagagggcggggggcggcgggcugucacuuacaaagaaaucucacuccacuccauaaaauccucaagccagugccggauuucccggcaagcggacgucuccccucccacggaccggaaaucccgccuccgcuggaagaagaagcggaagcgagaccguccauccagaggaaggcaaguuuuuggcucgggcggcugagaagaccgcgcggggcuggagacagguagcaguacgggggcggggcuucaugccggaugugauagucugcagucguuucgguuggcagccuggcgggugggagaugcggcggccaccugcugcaaagaaccgaagggaagguuagaaguacgaaggcaguuuggagcuggggcuaagcagcugucgcacggucagaucaugggcuccaccaagcacuggggcgaauggcuccugaacuugaagguggcuccagccggcgucuuugguguggccuuucuagccagagucgcccugguuuucuauggcgucuuccaggaccggacccugcacgugagguauacggacaucgacuaccaggucuucaccgacgccgcgcgcuucgucacggaggggcgcucgccuuaccugagagccacguaccguuacaccccgcugcuggguuggcuccucacucccaacaucuaccucagcgagcucuuuggaaaguuucucuucaucagcugcgaccuccucaccgcuuuccucuuauaccgccugcugcugcugaaggggcuggggcgccgccaggcuuguggcuacugugucuuuuggcuucuuaacccccugccuauggcaguauccagccgcgguaaugcggacucuauugucgccucccugguccugaugguccucuacuugauaaagaaaagacucgucgcgugugcagcuguauucuaugguuucgcggugcauaugaagauauauccagugacuuacauccuucccauaacccuccaccugcuuccagaucgcgacaaugacaaaagccuccgucaauuccgguacacuuuccaggcuuguuuguacgagcuccugaaaaggcuguguaaucgggcugugcugcuguuuguagcaguugcuggacucacguuuuuugcccugagcuuugguuuuuacuaugaguacggcugggaauuuuuggaacacaccuacuuuuaucaccugacuaggcgggauauccgucacaacuuuucuccguacuucuacaugcuguauuugacugcagagagcaaguggaguuuuucccugggaauugcugcauuccugccacagcucaucuugcuuucagcugugucuuucgccuauuacagagaccucguuuuuuguuguuuucuucauacguccauuuuugugacuuuuaacaaagucugcaccucccaguacuuucuuugguaccucugcuuacugccucuugugaugccacuagucagaaugccuuggaaaagagcuguaguucuccuaauguuaugguuuauagggcaggccauguggcuggcuccugccuauguucuagaguuucaaggaaagaacaccuuucuguuuauuugguuagcugguuuguucuuucuucuuaucaauuguuccauccugauucaaauuauuucccauuacaaagaagaaccccugacagagagaaucaaauaugacuagug

SEQ ID NO: 12975 - RNA, 7864 nt, Homo sapiens
ugcccaggcuugaaguaagaggugagcaagaucacgugggggugcugucccggccugcaagucccaguccugucacacacuagucaguuggggucgggggaaggccuuccugugccuccuuuuaccuugccagccucuaaacuaggaggcuucuuccuacauaaacacgcccacaguguuuagcuaacuuucuaggcagaaaguuuccuacuggggcacaagucuacgggcucucgguggaggcugagguacucacggguggagaccacugcagccgccuuuguagauucagacuccccgaaccuuuaacccuugcucuggucuacugucccucugucucaagcaguccucccuccuucugcgcugcggcgccuuuaaaccuucuuggcccuugccccgccccggguccgccccgucugaggcgggacccuccugaaaauccccggcugggcagggcgcaccacuugcagcugcagcccuugccuugagucagugcgccgcucuccagcccgcuugaacggugagcaggucggggguacgggggucggggacaugugcgugcuguguagaaagcaagaagccagcgcuuugaacuugcuccagcgagcucggggaucaagggcugguaccaggcaaggguccggugacuacuuuaccccgccccgugcugucagguccuguccccaagcccugacccgacauuguuggacgaugaggucaggcgagguuagcccaugcauagacagggcguccgucuggagcagggacucagggacugagccccacccgcgggcuccaucgcugaguccucacuggggcgaggggaaaaaagggcgucggacuuuagcuggcuggccccgagugaccccgggucguggcgccggcccugggccagcucgugcuccugggcuuucccgcgcgacccuucacuuccugguuccaggagcacgugugagcacugcgugcccucugaguccccgaggccgcccuuuucauuccuguuccugcuagcuugcuauucuggggacuugaggucacgggcuggggcuagggggcucugcaugggucgcacggugaccuucugugaagcuccagucaucucuaugacgguccccugaccucgggggucugggugcugcagcccugacugcgccccggggugcccugugugagguuguggggguggugguggcugcuuuuacccugcccgagcgccgcugcccccaccgggugcccccugcugcugggaaagccggugguggccgcgggcggacgggcgggcugcccagaccacugcgucaccccagcggcgggagggcggugggugacucaucuguuguaacggcccaggguguggucguggggguggggggcggcggcugggaggccggaccugcaggaccggagguggacugccgccuccccccgcgcccugugccuccuggggcuaccugaagccgguguccugggagaucugugagcaguugguaucuguggggcagagagaaacggggugagaguggggauggagugugggauucgauguagaagaccugcggcugggacggggcucccccaguguucucauugacuucaaagcaccagacagcaauggcucucuaucucuagcccccucccaguuucuccuccccacuacaaggggcagaccuacaacugcagaggaggccaaggcagggcgggcccaguagggcccuaccauuccagaaccaacaaauagguuuuguccaaccgcaacucccucccucaccccaaggccucugccccugucccccaccccgggauuggccccuaauccuuucuucauuccaucccuucucccuccagaauuuucagcuguggguucucuagcucagaacacuuucccuucccaggggauuucuucuccugaacaacuacuuccugaguccucuucuucaccccaacacgggucauuuccuaucuucccccacacgcuguccauccccacuauagcugucuccuggaauaaucucuugcaccuggcuacacccgagcacugcugagacgaucccacuucugcucccgugcucacagccugcucaccacaacgucuguguugacaggguguuucugcccggagcccccacccagccuccaacacuguuugguacacagaagccauggcaacggcccccaccucauccccuccucccacgcaagcuuuggagcuuccuguuuguguagccucagcuuucucuucugcuccugacucucgguggugaggggcugcccuacggugguucccuuaauugugggccgccccccauccuugcugcuggcuguggcaccucgcucugugggcuggugcccucacugugcugcucuuugagaacacucccugucccaaaucugaguugggaaguucuccuguguuccaucugcacgguggauggagagucccuuugucuucccaauuaaacacccuagccaagaacccugaaguccucccugcccccacccauguccgccuuuucuuuggcuuuggcuuuggugagguaagcuuccagcccagggucuggguggggccgagugccuugcguggccccuccccguuucccgccuauuguaacuccagggugagggugaggguuguucucacagcugcaguagcgcuaggguuuagguugcucccugccaguccaucccccagguuguucagcugucaccuuccuuugggguccccagcucugggggucccccacaccugucuuccagcugggcauaucucuucucacccugguaggcaacuugcuuacuguuuucuuuauguuugagggaaggcaggggcagguccccugggugucccuagggugggccuucccagcuccagcagccgcagcccaucagcuucugccugcccguggggguggggaagagaaacagcugcugaccaggccuggccugguuggaacugccccuucucaggaccccgcccuauggcucuggcaccucagagcuugagggcaauggccccagaguggagcagauacacugcagcuggaggccgugacccugccagcuguguccaggccccagcguugggcgguggaggggguuccucagcauccacuuuccacccaguggugggucugggaggccaaguuuguccugccuugggggguuggggggcacuggaagugucuggcuucaggccuuucucucugcucuuaaccccagugucuagguuaaucauucuccugcccuuucuuuaccugugccauggugauccccgagccucaggccacuuggucccuggaaacagcccugagcacagccacucccaggagagaggucuggaacugggcugcggaaagggggcuuacuggugguaguagcucuuagccccuuccucuuccuaccugucuuccagccauuccccugugcaucagagguuagagguuucuaugguggaguggccucugggaagggcagggaugcuucucuugguuucuccucagaacucagccaccccaccccgccugccuuccccaagcugauggugugugugccuggcgcugugggucggggcccagacugacauuuaucuggcccagcuuucgggcugggggaaguggagggggcggguugcucuuaaugagguuuaaaaauaacugauuuaggggaggaucugccggaaaugugcagcuugauaagcugggguaaaaaggagcagccauguuggagucgggacgggagggacuggcccaagacacagccucugcggccgagagguguugaggguuugaggcaggcugguccccuuguauuucgcagagccccaagguccauugagagggggugacgggauuguuuaaccugggugugugggagagggggagcuggagugacuucaucccugaaggccaaccuggccuggagccagaugugguuagaagggguggcucucuuucuuccccuugaacgcagaugccuguccuggggguccccuuucgugagcagccugacagcuagcucuguuuuggagaagagagaaaagccaaaccaggguggggaugggacagaaaauggggacuguggcccauucuugguucuuggcuccccuuggcauccauaccaugcccgggucuugcucagccccugagugucagacccagguggugaguguggugggaacacacugccacagugagguccgccaacucaggccauuggucgggaaaccacccaguucuugcuaaucaagcuccuccaacgaaguuaaagaaacccuccuguguauuuccccgucuugccuucucuucuccagguuuccccaaaaauaucacccagggcuccuguauuaguuuccuauuucugcuguaacaaauugcuacaagcuuagugauuuaaagcaacacaaauacagcaucuuacaguucuacagacucaacaggggucucacuggcuaaaauacagguguuggcagagcuguguuccuucugggguuuuugggugaaucuauuuccuucccuuuucuggcuucuggaggccaccugcauugcuugguucauggcccugugugacucugacuucuacuuccauuuuguuguuguuguuguuacuucucccacucugacucaccuaucucccacuuucaguuaguaaggcccuugugauuacacugggcucauuuagaugaugcaggauaaucuccccauuucgagaucuuaaucacaucuacgaagucccuuuuugucauauaagauaacaauauccacagguucugggaauuaggacauggacaccuuuugcgggggcaugauucugccugucauagcuccuagaggggaaaguagaauuuguuuuuauugccugguuuuucauaggaaauucgauuuguuugcugaaaucccucaaggaccuauucaagccuaccucuuccagaaagccuucccaggcugcuucugcccgucugcuucuuuuaacuccuacaacaugugaucugaacugugcacuuuaguauucuuugugugcaauccuuaccuguucauauguacucacuuugucucccugauggcacugugggcacuugaggaccaaggacuucuacuaucucuuucacaaucccuagcacagauaguaggugcucaauuaaaauccagugguuugcaccaaccuagaugguuaaaaaaaaagcaaagaaaacccagagguugagggaggguagauccaaccaguuuccuaagcuguuccacauuccuccuccucuccccaaaucauucucuuucccagggcuauaaagagcaggguugcauuugguaacaguucugguccucauccuuggggcucaccgugggggaaaugguguauaucccugcaggcagaauuccugaauuccccacuccccaggcugcaagguguugaccaaaagcccggguguguccucucccuagcuccccgcagccaccgccacccauuggaauggccaacaggggaccugcauauggccugagccgggaggugcagcagaagauugagaaacaauaugaugcagaucuggagcagauccugauccaguggaucaccacccagugccgaaaggaugugggccggccccagccuggacgcgagaacuuccagaacuggcucaaggauggcacggugagagccgggccccacuggcuuggaagugcagggagagcaggacuggguccaguggacuggggauuguuuaaccugaagaggagaagacugaaggcacacaugucccagccucuuccucagcuugaaggccuuugucaaggaugugagagggcccaugcuuuccucccuucccguggaguggaggguaagggugaaugugccucccaggcaguggaagacugaggugacacugaggaagaaugucucuaaggaaagaacugugggaggguauauuagcaaggaaagacuaaacacuggcuuuucacucugggcucggaggaaggaggcuggcaagaaggacugugaggcuuacucuagugaaagaguccaagcugucuucaggcaagacaggagccucucugguucauugucucugguucugaggguggugcacgcugagcugcgauagguaggcauauucucaccuuuccaccccugcuguccucauccaggugcuaugugagcucauuaaugcacuguaccccgaggggcaggccccaguaaagaagauccaggccuccaccauggccuucaagcagauggagcagaucucucaguuccugcaagcagcugagcgcuauggcauuaacaccacugacaucuuccaaacuguggaccucugggaaggugggacagggcgaggggcuggguccugucauccaggaggccagagauugggcugggcccucuugaccaggcagaaggggcuguuuucuggcucccugcagagaaagagggguguguuuguguuccauggagcacuuggucauauuggaggcuggaauggagaaggguauggaaaugaacaguagaaauaauuaggaagccaggccugcugacuuagcgauagaggcggaacccugguaucuaggacacugcggaggcugacacauucccauucuccuucccaggaaagaacauggccugugugcagcggacgcugaugaaucugggugggcuggcaguagcccgagaugaugggcucuucucuggggaucccaacugguucccuaaguaaguauugcugggacagccgcaggguccagcaggugcauuguuucugcccaauccugucccuaggaaauaacuuaucucaguagcagcuggcccuuuacaaagcacuuucagaaaauuccucaucucacuuaauccucacaacacccucugggauggcaaaugacugucccuuuggacagaugaggagguggcuucagagagcuuauggcucucgagggcagagcuggcaccagcccuugagccaacagcaaagccugugcucuguccaaggaagggauuuacuagggcagccugugaucuccucuaaccaccacucccuugucacccaggaaauccaaggagaauccucggaacuucucggauaaccagcugcaagagggcaagaacgugaucggguuacagaugggcaccaaccgcggggcgucucaggcaggcaugacuggcuacgggaugccacgccagauccucugaucccaccccaggccuugccccugcccucccacgaaugguuaauauauauguagauauauauuuuagcagugacauucccagagagccccagagcucucaagcuccuuucugucagggugggggguucagccuguccugucaccucugaggugccugcuggcauccucucccccaugcuuacuaauacauucccuuccccauagccaucaaaacuggaccaacuggccucuuccuuuccccugggaccaaaauuuaggggccucagucccucaccgccaugcccuggccuauucugucucuccuucuucccccuggccuguucugucucugagcucuguguccuccguucauuccauggcugggagucacugaugcugccucugccuucugaugcuggacuggccuugcuucuacaaguaugcuucucccacagcuguggcugcaggaacuuaauuuauagggaggagccuguggcagcugcugccccagccacagcugcacugacugugcucaccacacaucuggggcagccuucccuggcaggggcccucguggcuucucauuuuccauucccuucacuguggcuaagggguggggugaggggauggagagggagggcugccuaccauggucuggggcuugaggaagaugaguuuguugauuuaaauaaagaauuugucauuuuugaauggac

SEQ ID NO: 12976 - RNA, 1933 nt, Homo sapiens
uaauggagaguaccugagauccagccccuggauccuacaacuugagguuuccauccccaagucucccugaucucucuggacccuccucagacagccaacauuuaucuccagcaauaaaagcuaucacaacucucaggacgauacccgagaguugcauuuucaaggcauuagcauaucuguuaauuccagagaggcuugucgccucuugguagggcuuuaguaguuuuauacccuuuagagagaagagaagagcuaagccuagagacuguaagugauuugcccagggucccaguguucuugggaguagaaagcaugccuuauguaucuuuguguggcucacaagucucagaacagacagugucaggcccagaaggagcucaguccaaguucauuguauugaauugguucuguaugcacuagauucugggucucuggacuccuggucacucacuugauguugaaaauacccaaagucaaguguaccccuagagaugaguuuggcuguagacuacaguggacacaggguggugggauaccccagcuccuaucguauguuuucuccuaacccugcuacaaggaaucucaacuucuuaaaacuuguucuguucucugagugacguccucagacugacagcauuggacucuccuggcuugcugguuagaaaugcagauuccaugauguggucuugucauagagacacaaggcccaguggucacugagggaugugcucucugcaugggcaagacugugacuaucuuaauacccugcugggccuccccaugcugccugguagaguaggcuuuccacaaauaaauguguuaaaugaauggaaaaagaaaaaaaaaaaaagaaaugcagauuccaguuagaccuaugagaccuauggacugagaaucuguggcagagguaguggaggugguaucuugaauuugcauuuaaacagacuucccccauaauccuuaggcagcagugaccuaggauauucgggggagaagucucuccagccagcaagaaaauugaggucugagaggcccuggccuugaggccuugaacaagaguuggcccuacccccuacccugcacuguuuggugacuguggcuagguugccaggggaaccaggcuguguaacuuccuggcuuuggugguuucccccuccuuggccuuaucucagcauccgccacccaguccagggccugugcuggucacguaggaggggaagcuggugccaggcgugcagaggcgugucuaggauaccagggcaaggcuggcccaaggaccuggggcgggcaagaugguggagaugugguuuucaagaaggcagggaggcugcagauuuguuaaugucuuucucuuuggucuaggagauaucgcacuaugggaauguggggaaggggguuggucagagccuggggcucugucugucauuacucuggcauuucaacuccucauucauggccuaauucccccucccugggaguaggggcaccaauaauacuguggccuggccuguguccccuuuucuccuccuuccucccucugcucucuagacuuagggccucuagccgcaagcaccccucaguacuccucacuaccacccucacccuaacaucucugccccagcuuuauucaccccuacucauucuccuugguuccaaauuuuuuccuguucuucagacucucuccccucucugugccgcaugcacgggucucucagaagguagcaggaagcccugacagucuucaagaauggaaaacagaaaaaguuuugaagaaagagggaaggcaggaaauaguugaauaaaauaauuaaugcauuuaaguauuuguuuauguucuaagccauacuuugaagcaguuuugagaauucaaguguuccaggaaggagaauaaugaaaauagugaaauagccucucaggccucuaugcaacuugg

SEQ ID NO: 12977 - RNA, 8344 nt, Homo sapiens
cucacgucucaauguuucuuuauugugcuaacacugcugccucagagcucagaccucacacacagaacaauucguccagacagacccccacccacccggcccccggggcccucugcuuaggcuggggacaccaggccuccggccucagccgcucuaggacacucagccuccuccucccucccucucccccaagccuucggucccgggggugcggagaaggcucaggaucgccuuccuccgcccucgcccgccccuucccacuuuuggggaggaggcucugccucccuacgcauuuccuuagggaaaugccuucacccccagccgccuggcagccuggggcgagcgaggucguccccagccccgacguguccccagcugcagacagagagccccgcgcccuccuccuggcuggggcgcagcccggcccggcgcgcgcgcucacaccaagaggccguucuugcacugcaccggccccucggcgcagucagccggcuccgcgcucuugaccuugacguagaccggggaggggcccgcuucgcaggcggcggcggcggugcagggcgccagggccacguccucggggccgccgcaggggggaggcgcguacuugcggcgcagggagcggcugacguucugcgucggguaccccaggaggugggugacgcggcugccgcgcccgcuggccuugcacccgggcgccacggcguccucucuguggaaaacaacaggcgggcgggugagcgggcugcuccgcagcggggcgugggcacggccugggcagagccgggggcucuuggcaaccucuugucucccgcgccucccuccaccugcccucgucucucucccucggccucgaccuacuguccuuugugacccuuccugggucggcgacccugcagcggucccggagccagcauccccauccuccagacagggcuuguccacgcguaucuggagagcccugcaggcagcccccuccaggccccugcaaucccuuucugauguuucgcaggcccagaagaaggugcuuuuccucuucuucuuuccuuagcuaauccugaccuugcucgagcaaucucucucuuucucaccuccugccccucagucuucuccaucuuucccuccauccccgaggcauugcaaucauuagcacuacuagacuuguucuauuuuuauuucuaguuugcuucuaauauaaguuauuagcacuauucuuauuauuagcucuucuuaaauaauaaugucagaguucuuaccggcgcaguacaggggaaacgugaaaaaacauaggcccugcccuccaggagcuuacagucuagacaagacagacaggugcguaggcaggagggaaauggaaggcagggagcagaggugaagacugggguggcagggggaggggaaagccaugaguuggguggcaggucgacaugccgcagucccagcacuccguggcgauggcgggcaggguugggguggggggcccagccggccgguggcaggcaggagugaggugggcagggcgccgguucccugccgcacagcagcaugcagcaugcaucagguuuuaccugaucucacuagccaagucgccgcaggccccuccgccgaccccgccgccguugccguagccgaaggcaccgcgggcgccgccagccccggagcccccgcagcagcagcagacgagcccccagaugccuacggccaggcagcccagcgcgagcagagagcccaggacgaugccgaugaucacgccuauacgccgggagucuguggagagaaguggaggcaggucaggcuuucucacagccuggcaggugccugagggaacagcaccaggaggugccaggucagggguuaaugggaaagagggagagggacccagggggucucuuagcccuggaacacccaguggggaagauauggggagaugcaaguuaaccccucgugucagcaugcuucucccagggcuuccagcugcucugggcucuagagcucagaguggaagcugugcugggcgagcuugacccagcucaauagggucaagaucguacccacugaucuuggcccacuuguaggaaaggggcugggagcccccacuggcaaauggauggcaguggaaaggcagaagcagcugaggcuccaaaccagagcccagccuccuccaguucaacccucccaaccacccagcccucaagacugcugcaccuaccugagaccuucaccuccaccacacaaacacuguagcccacguuguuggccacugugcacugauacagcccaucaucugcucuggagauauccuucaacaccagguccccauuguucaggccugaaagugaaguggagagaggccuggucucugagagcucccaccccaaccucagucccuguggggugggggaugggacacccacucuagaagaagggaaggcuuaugcauguguguacacccacacccacacacacacacacacacuccacucuccaggugagucaccuucccccugcugugaaagagaugcaagaaaggaccucucucccagcagcaagacagggacaccauuaauucacucugaccuuagggaaauauguacgcucucugagccuuggucuccuccuuuguacagugaggacaggagaagccaggggaagaggaacucuaaggucccuccuagcucuauuauucuuuguuugacugaauauuuucagcuucucuauguacuaggagcuuuacacaccucccccauuuaauccuugcaugcccaugaaagguauauguuaguauucccuuuccauauaugaagaaauuaaggcacagggaggguaagccacuugccuuaaacuuggagccagucagugucccagccaggauucaagcccagcucugucugagaccaggcucccuccaaauucgccauaguacuuuugacugacucuccacauuugccuuaucaucugcucucaauagcagcugcugggccaggcacgguggcucacgccuguaauccuagcgcuuugggaggccaaggcgggcggaucgccugaggucaggaguuugagaccagccuggcuaacaugguaaaaccccguuucuacuaaaaauacaaaaaauuagccaggugcgguggugcaugccuguaaucccagcuacucgggaggcagaggcaggagaaucgcuugaacccgggaggcagagguugcagugagccgagaucaugccauugcccuccagcuugggcaacaagagcgaaacucugucucaaaaaaaaaaaaaaaaauagcagcugcuggggcaggcccagagggagggucucccacagggauuccagguuugauuugauggcacugauaacccaaggaaaccccaacaggucccagagucccugaucuuccacucacccccgacugcccucauccagggcccucucaccuugguuuauggagcuguggaaggacuccugguaggacagcucugagugguagcugugcugggagguguaagacccagcucgauagggguaauggugcccacugaucuuggcccacuuguaggagaggggcugggagcccccacuggcauagcacuucagcaccacaucguugccauaugucauguggcccucuguccagcacaugggcacugcaggucgugcugcaaggaggcagacaauuguaagccagggcccagccaagagacagagccaggcucaaaguggccaagcugcccuuggcucuuaagccagggggagaggagcuuagaggagucuggccauaccuuggacagugacaaugaccuuccggguggccaugguggucuucuucacccggcacucauaaguggcuguaucagauaccugcagguucaugagguugauggaggcaucguacuggcuugggucugaggcugcaaagcggacccucugcugcagauggggaaggcugccaugguugauccucuuguccugguaacuaaggaacugugaagaggagaggaaaacagguggugaaacaggcagagccaagaagggccauguggauuggcugcuuugggcaauucacugaacuucucugagacucuuuucucagcugaaaaaaugagaauaaugaugccugagccacugaccucuuacagaacuggugagaucaggugagaucaagcacuuggaaagauauauggucagacugggaacuuuuugaaggcaaagacuacaacuuaucuuccuuuuagaaugggaugggaggagguagacugacuggcuagcuuaauucacaauugcagagcucucauccccauugccucauucccugaaaggccuugggggagguucaaggucagucuucucccuuugggauguuggcuguccaacagguagacaucaugaagccuagaggaaggagaccccugugcccagcacucaccacguucucucgguggugggcggggucugaguugaccugcauccacucgauguccagcccauugggaccauaguccucaggguccaggacguaggggcagcccagccucacauuaucaccuucugccagguacaggaccuccuguccauccccguugauccgcacagcagacagcagugcuagggggagggcagagaagauggggugguaggagcagaagcagggcuucaggaggagucagugucagcccuucccuucauauucucuguccacggcacccagaggucagcagugcuuucauaaaaaggagggcugcucguaguggguguguaugugugugugcaugaauugucacaggcauauaacagcuauacauauagcuguuauauauguagcuguuauguaugcuuguauguauauaugauuauguguaugcauguaugaauauguacacguauguacauuguaugcuuaugaguauuuguggcugcuuauguguacugugaggauauucauguacaugaccacguagcgugucugcuuauauauuuauaugauaguguggauguguuugugugugugaaggcaugugguacacacagaguuguuaaaugcucugauagaagagccuggcugauuaaaugucaccuaugugggcucugucugggcugagugaaguccuccuguccagaggcagcggggugguuacaauggcuucugggacuccucuccagccugagaagccaaagacuaagugugucuaugugugucuguguaugacagugugagucuguggcuguaugccucugugugguuuuguauagugaugugugaccaugugagcuauguaagugcuuaaaagugacagugugugcuugugcaugacaguggacagcugugaccaggagccuggcuguguucgugugugauagugagugauggugugugccugggacuauggccacagguaucuguaggacauugugagucuuucuugacuacacagcauugcguacugugugugcuuccucuuaugugauuguguggcucgcaugcagcugcccccacaagcuggcuuccagugaggccccuccugccacugagucaguggcaggcaauccugggugaggagccaggaucccaggacccaggagcucaggacugagcucuugucccucccuacccugaagccccaggcaggccuauccccaaccgguuggaccuagagagggauaagaccgggggguguagccagggccccacccuggacacucugcccuccaccucccagucuccagcaacccugccucugcaggccccucaccaggccucacacacucuccgucugcguucuuuuuugagucaacaugucuucuggagucacagccccaggucucagcaaucauucuguucuaucauguggcucaggaccauguuuacacauagagaucucacacaugcacacacacaauuacaccaucacaggcaaacaaaucggcacguggcccacucuuacaaggcuucaaaaugcagauacauaccuauauggccccaccuuccuacaaacacagacacuauauagauucauucagacacagacacaaucugcacacaaacacagaacauauuaauucaaaagacacacccaccguguguucauauagucccuguauguguucauucaagaccagacauaucuauggaagcccugccaggaaggcuuagccuggcuccagagaggccagcaagggcccuuucaacacccucaacagcucagggaucccugaacauccccccuaggaacacuggcugggccaucagcucugucauaacccagcuagacuccaaggugacccagagcaggcaggcugacugcuggggcucuaacgggaccuagugaugccucuuccagcuccaggccaagagaacaacagcucauuccugagauaaggauccugcugccaucugccagauccugaggcugcucaaggcaagccagggaugagccagaacucggcugagagcagaggcuccacccuggagaagcaccgcuggaagcacccacacaggaaggacucucuccaugccauaggagccugccaggcaggaugguaagcauucagggagaggggcuugggaaggagcgacaggcugcaagaaaagcaccuccacccugcaccaggcugagagauucuucaauugucccagaccagggagccucacccagcuuuucuaucuccuuagaagucuucucaaccuccucccaaggguuccagccuuuccgcaccccucccucuccuugggaaguugcuccuaaugucucaccuugauuccucuugcuguagcacuaaggaaguacuacagggaaugugagaggagaggcuggagagagggaagaaaggcaaaguggaagagagagcuggaugggagacuugaggagagacaggaauggaggaaucacaugggcucuccaaggaagaggacaguggugauucuuugccccccaaaagcaccagaaacuggccaugcuuuacggggugucaucucaauaguggugccuacucucugcuugcaaauucuuucugaaucuucaaggugcuuccagaacuccugaucuucccucuggagguaagggaggggagaaaaggcggcuccagcugaggguauugaugcguuaaugcagccagugcugaguuguccucacacacccauugacacaccacacagggggaaguccggguccccacagcacagcuggagccucccgaguggacucugccagcccugcucucaucagacagagaagggcugcagcuauccugccggaaaugucaucauucccaugcaggugcacgcacccacacacucacauacacauucacgcucacacaaaggcugaaaaugucaccccgccuucccaaauuccuccuucaugccccuucaucccaaauccagacugcaagagggacucggagcccuuuccagugauguuggcauagaaugccccuugguggaacuugccccaaccugggcaggaagccacaauguccaaacuugagcccugcccuguggaccuguccugguggggugagaagucucuggaguugccauccccaccacccucaggccucauccuagaguggggcacugcccugucauagcacagggggcccaaggcugaggucucaggccugagcugucacuggccaugauggaagaaaccacucagacuuacaccagacuuagucucuugcccuuucaaggcaagugacuucccugccccuuggcccuggccuugggagagaaggaguagcguugggaauagcacacagucugaugaaaauugauccuucccaagcuccuccugagcccucacccaaugcccgugcuuaccccucuccuaccccaccuccagcuccugcagagcaaucaaucccucuccuccuagucacggcaugagcuugcagggcaccugcacacaugugugagcccgacaggggacauauaaagauccacucaaagaccucugcacuacagacacacacccugaacaucaggcacagggucuccuggggaaagguccccugguaauacccacacccggcugcagcagggcaagggugggcagcacccugccaggcaacucaggcagccccaggcuccacugugagcccuugcugccccuuuccuucccaccuagccucaugcuggcuacccugcccccugcccagccccguaccugggcucaggcacacgaguagaagguggaaugcuccuccaacucucaugucucuaggcucgguguuuccuccgucugggcuggguaucccguggggucguaguggugggugugaggggguagguggagggagggggagcugagggcccagacacugccugggguggcaggaaggugcaaugagug

SEQ ID NO: 12978 - RNA, 2085 nt, Homo sapiens
acgaucucuucggucggggacaaugcauucgauucgcacgguggagauuaaaguccccgagauagaggaaacguuuuucgcgcccagguucagcgaggagccgcgcgggggcagagggggcggcggcggcgggcggggagccaggcccgagcugcguucugcgcagccauuggugggcgccgcgcucugcacugagcauguucgcgccccgccggccccuagccgcagccgcagccgcagcgacggcagccacgggagccgccgcgcauuaugcaaagcggcggcagaugcgagcggggccagccgggcgcgcgucggccuccccucccagcggcuccccccgccgccgccugacucucccgggagacucccuaggcccggaccuggggccgaggagggccgggauggccugagugcccgcggcgcggcggcgcagcagcgggauugcaccauggggaaccaggaugggaagcugaagaggagcgcaggugaugcuuugcacgaaggcggcgguggcgccgaggaugcgcuggggcccagggauguggaagccacaaagaaggggagcgggggcaagaaggcgcuaggcaagcacggcaaggggggagggggcggcggcggcggcggggagucgggcaagaagaagagcaaguccgacuccagagccucgguguuuuccaaccugcggaucaggaagaaucuguccaaggggaaaggcgccggcggcucccgcgaagauguacuggauucccaggcccugcagaccggggagcuggacagcgcucacucccugcucaccaagacuccagaccucagccucucggcggacgaggccggccugucggauaccgagugugcggacccuuuugaggugaccgguccaggggguccugggccugccgaggcuagggucgggggccggccgaucgccgaggauguggaaacugcagcaggggcgcaggauggacaaaggaccagcucgggcucggacacggacaucuauagcuuccauucggcuacggagcaagaggauuugcuuucagacauccagcaggcgauccgccugcagcagcagcagcagcagcagcuccagcuccagcuccagcaacagcagcagcagcagcagcuccagggcgccgaggagccugcagcgccccccacugccgucuccccucagcccggggccuuccugggccuggaccgguuccugcuggggccgagcggcggggcuggggaggccccgggcaguccggacaccgagcaggcgcuguccgcgcucuccgaccugcccgagagccuggccgccgagccccgggagccccagcaaccgccgucccccggcggccucccggucuccgaggcgcccagucucccggcagcgcaacccgcggccaaagacucgcccuccuccacggcuuucccauuucccgaggccgggccgggggaggaagcggccggagcccccgugcgaggggcuggggacacggaugaggagggugaggaggaugcuuuugaggaugcgccccggggcucuccgggggaggagugggccccggaggugggagaggacgccccgcagaggcugggggaagagccggaggaggaggcgcaaggaccugacgcccccgcggccgcuucccugcccggcagccccgcgccuagccagcgcuguuucaagcccuacccgcucaucacccccugcuacaucaagaccaccacccggcagcucagcucgcccaaucacuccccgucucaguccccuaaucagagccccaggaucaagaggcggccggaacccucccugagccgaggguccagaacugcccuggccuccguagccgccccggccaagaagcaccgggccgacggcggccuugcggccggccugagccgcucggcugacuggacggaggagcuaggcgcccgcacgccccgggugggaggcuccgcgcaccugcuggagcgcgggguggcgagugacagcggcggugggguguccccagcacuggccgccaaggcgucuggggcccccgcggcugcggauggcuuccagaacguguucacaggugagcgcgcccugcugcu

SEQ ID NO: 12979 - RNA, 122224 nt, Homo sapiens
ugcaguuugauuguggauuuuauuuuuuauugauuacggaguuuucuuaaauggcagauuaagucaauuaauagaaaaauggagaugcuauaaacuaagaaauauuuaaauuaagaaauguuggaacucaugaggaguaaaugugaaaaugaacaaaacucagaacaagugugucccuggugcuaacggagagacuaacaguggacuuccauugcugcaguuucucaagguuuccuuguuuaguguuucuccuucagccagcacagugagaauacucugucuucagcuggcaggggauguggaagaggcuuggaagcuuccaaagaccaggauugagggccaccuccaucacuucugcuccuuggaugccugauucuauuucucuuagaagauuccagaccccaaaggagaucaugugacauaagcuagagguugaacucaccaugguugaacaaaaacucucugaacgcauagugcugcuucacagcucacugcaacaagucaaaaauuccacuuuuauggcacgucacaccgggaucacauauaauccuagauuaucuuuauuuguucuauaauuuaauaguauaccuauaaaauaauuacauuauacuuauagcuuuucuucauuuauaaacaaaacaaaaaaauuaaauacaauuugagccauuauaagguaaacuuuguacauacgauaaccccagaaggagcuucacacugcagcauaucauauugcuuucauugcuacacccacaauuggguucgaagagagugugcucguguuugcauucuguaaguucuuagcuuaaucccuccccuaucuguguggguuccauguuaauaaaaugauagggguuggcucugcagcuggucagagacucuccuccacucaccucccaauccaccccuagccuccauuacaaucacguaaauuuccuuccuucacagcuuuucugcugcauguucugccacugagucugacuugagguuuuccaccaaaugcaaaaaucacuccugaccuugaacacccuucucuccauuuucgcucuauccucagguuccagcccucaaggauuucuuuugauuucugccuccugaguucaggcuguauauacccauuuaugaaaccaagacccccucugccacagcacauucuugcucaggucucaugguguugcagaaaugacagaaaugcaccuugcagugcaguggccugagauagauucaccaacccaccccaccccaauccuugcucuucaagugaaugucucuagauccaccaucacuaccuaguaucaggaagcuaaguccccacagcggcuugcagagggucucucucacauacuagggaaguggccccucacaggagcacuuaccagggaaucaucagugaaagguuuucaaaguuuacugauucccaccaauggcagcucauucacauuugucagauuccauaagcauuacucacagggaagccuuccuggggcaacugagcaaaggagcccagaagaaguauauaauuucgcuggaaaauaaguuacgucuacuuccguauaucaagagaccacagcauggaaacgucaacaauucauuauaaacacaaaaggugaccuaauguuuguucgucccuuuugaagucuauucuuugaaaaggaagcauguuuugugcagaacaguucaacuagauuacuauucuauaucuuuuauuccuuacucccuucuauaccacaaagcgacucaacuccuuauauuuuucaauaucccucucuuuuucucuuucuuuuaacaggaaauauuuuuugccuagugucauggcagugaaaguaguauacgguuucaccccacauaugcauauuccacauuauaggggcuuucuaguuuccggucaucaauuucccaacgaaugcccuucccuauaccuauccaucccaagccaauuucuacauugugcugcaaugcuuaguaacgucagugaaauaguauucaaaguaaaaaucacgacuccucccaucucccugcccaaucuaaaaauaggugcaugacagugaauugcugaccaggcauuuuuuuuucugaguaagacaccuucugggccugcugucauccuuacuccgaauggugcugcaagccagagucaaaacaugugaaauaauacaugaauaggucuauaauacuuuuuaacagcucuuuacaauauacggucacuuauaaaaccagcguuaauauagagaccuuugugugugauaauauucuaauugcagcaauaauagcaugcacaccagaguucaucuuuaguccacaaauagggggcggggacagugaggaagaagaggcgguggggacuugaggaugggggauuguguagccugcucugcucgagguuucccgggaagcccacuucgggauccaaguggcucaaguugucuucuugguaucagguuuauuaggagacgccccguccaccgacauauuuauggagguugcacauauccucaucacagcagcgaccgagggcagccugccagucacaagaaugagcgcucccagccagagguccagggaccagcaggagaggucugaggggccgcucagaaaagugacgcauccuucacuucgcgcgggaaaggggcgagcuggagugcagggcggggccagggaaauccuugcuuuuccacaugguggaaacaucaaugccggauuuacagugcaucaccucgaaagguccucucugacugcuggguggcgguggugguuuuccagcauuuuccuucgggccugauccaccgccugguuuagggggcacaggugggacccggggucggucaggaacacaucagcaaaagcuccacuugcgauccacgucugugacaaggacaccgucagcccuaagagaagugcuugcugcugagggggaacaccaggcagcgugacagugggcucggagggcagggacagaggcggcggcggcgccacccagcggccgggcgcgcgcggggcugagcugcguccggcccggcgcucacugcuuguccgagucgcucagguucacggacaugcaccggcacugcuucaccuucuggauuuucuugagucggaaggguggguccaggccggggcacucgagcuccacgaggacggaggugacgcgcuggggcuugcagaaggcgcaggacuggaaggacuccuccuccuucuucacgugccgcgggauguagaaggaguugcacuggccguagcagaagcgguugaggauggugcggcuccggcagcccuccucgcucaccgucugccgcagcggcugcgucuugcaccagucacucuugagguacuugcgcucggugaccaccagggccuccuggcuggaggccagcaccuccuugaucuggugcugccaucucuccgaguuguugcugcugccguccuuguaaggcgaggggauggcgcccgccggccgguucuuccgggcuuccgccaccuucaccagcaccgccaccaggaacaaggacagggaaagcuuccagaacauccugcaaacgagaaaagagaggggcuggcugugaagggccguagaguacgggaucaaucuuacuuauuuuuuuuuuuauuuuagacauggucuggcucuguugcccaggcuggagugcaggggcacguagcuugcugcaggcucaaacucugggauccuccugccucagccuccuguguggcuagaacuacaggcuugcaccaccacgcccaucuacuuucuuuuuauuuuuuuuuguagagacgggaucucaccauguuacccaggcuggucuggaacuccuggccucaagcgcuccucugccucagccucccaaagcccugggaucauaggcgugagccaccacgucuuuuuaaugcuguacgguuuuacuagcagugacagucagguggggcauggcagacugauggcugcccaggggcagcuggaggugaaaagggauuaaaugguacaaguguaggcaguuaggacugcaccccaaauaaugccuggaaggcaaggaggcggacaaaauggccaguaacuuaugcaguaaaugcaguuagaaaacacgcguguugaacaguuacagaaguacaaagcaaaugcugggaagagagaccucaagccaguuugcagaaguaccaauaauaguuaauacucaauauuuacaguguuuuacuuugugccaagugcuguccuaagaguacaucucauuuacauguauaucucauuucauccuaaaaauagccuucaguuggaggugguauuaugaccccuuuacagugaaggggucacuuuacagugaaggaaacugaggcuggggcccacagaaguugagucauuuaccugaggucacacaaccacuaaacaauggcccaggauuugaagccagccagacaucuaccuccagagccaucaauguuaaccagcagacauggaugugauuacaaaaauuaguaaguacaaaguagagagaagaugggugucguucacaaguuucuuuaaaaaugaguauuaaagauagaacuggacauaggcuagaaaaauuacuaguugcaucuguauuauuacauaugaauaauaacauuagcauuuaacaucugcacacagauguucaaaucauucaaaugagucauaaauuagagucuccuaguagaaacuaauucccaggugugaauuaagaaauuucccuagcugacuuugggaggccgaggcaggcggaucacgaggucaggagaucgagaccauccuggcuaacacggugaaacccugucucuacuaaaaauacaaaaaauuagccaggcgugguggcgggcgccuguagucccagcuacuugggaggcugaggcaggagaauggcgugaacccgggaggcggagcuugcaaugagccgagauggcgucacuguauuccagccugugcgacagagugagacuccggcucagaaaaaaaaauaagaauaaaaaaauagaaauuucccuagcuguauuaaaacugucugaugacaaugcaaagugucaucucauuuguauuaggagacuaugacacaaauucaauaggaaugagaauuggacagaaauuauucucaugcuaucuaaaacguggcuugcagggcacaagccaaagucugacuaaagugaaagauagacuucaaaguguaauucacauuuuaaauuuuuguauuuuuaguaguagccccaaggaacacuaauacccagcaauauugaggacucugaucucuuuuuacaacgguagcuaccaauguagcuguuaccaacaucaucaucaucuuuauguuuacucauuuucuguuuuaccuucucuaggacuccaugaauucccauucuuuuaacauguauacccuaaaauggacauguaacaauuauauauacaucauauguaucauauaguaauauaguauauaucaguuguuauauuuaucaaucaugaguauauagaaauaacuaaaauugaauauuaaauauguuaaauguuugaauuuuuuacgucuuaaauauauccaugcuaaugguaauagcaaauauuuauugauucucaaaguacaucaaacacuuacaguuuacuuucauguauagacguauuuaaugaucugaguucuaugaaguagguacuauuauuuucuucauuuuauggaugaggacacuaaggcauugacaggcugccaagauucuauagccaguaugugaaauauuugaauccaggcaucccggcuccagaaucugagcucugggugaguauagcugccucuuuguuaaaaauauuuacguuaaaauaucuaugcuaaaauuauuucucugagucuuagucuaagucuaaaccacaagaggccuuugcaugccaccuuggagaugauuccuuuauucaucaaguauccauggaacguuuauucuggaguaagcacugucauaggcuuugugaauuccaguaucuuagagaauaaggcaaagguuuuuuuuguuuuuguuuuuguuuuuuuuuugauggagucucacucugucaccaggcuggaaugcaguggcacgaucucagcucacugcaaccucugccucccaaguucaagcaauucuccugccucagccucccaaguagcugagauuacaggcgcgcgccaccaggcccagcuaauuuuuguauuuuuaguagagacaggguuucacuauguuggccaggcuggucucgaacuccugaccucaagugaucugccggucucggccucccaaagugcugggauuacaggccacugggccaggcuaaggcaaaguucucacagggucggacgagccuuuacaagaucuccccacuccccugcaucucaccagccuccuccguccucucucccacuugcucacucugcuccagccauacuggaaauagccuaucuguuucuagaaugagcuuggcauucuugugcucuagagccuuaccuugucuuucucccaaaugucuacuuggccuucuuccucacagucuucaacucuuugcucgguuaccaccucuguagcgaaggcuuagaguuaccuucaccaccaucguggacgucaccgucuccuccuucccugcuuuaucuuccuccagggaacuuaucaucuaacgagauaguauuucauaaucacacuugucuuucuugucugacuuuucuccugggaauguaagguccaagagagaagaccugccuguuuuguucauugccaugucuccugcucucagaacagugccugguguacaguaggcacucaauaaauguguuaaggccaggcucagcggcucaugccuguaaucccagcacuuugggaggccaaggugggcggauccccugaugucaggaguuugagaccagccuggccaaaauggugaaaccccgucucuacuaaaaauacaaaaaaauuagcugggcgugguggcacacaccuguagucccaguagucccagcuacucaggagggugaggcaggagaaucgcuugaacccgggaggcagagguugcagugagccaagaucaugccauugcacuccagccugggcaacaagagugaaacuccaucucaaaaaaaaaaaauguugaacgaaauauggauacuauacaggucauugccuucaacaagucuguaauuaagaagccagagaaaggcaugcacgugacugcgugacaaagguauuuaggaagaauggccuggguccuugugguagugauccugugaccaacgacaucugaaucaccugugguacuuuacagugcacauuccugggcucaagaagcauucuuuuuaaaaaaaguuuuaauuaaauuucuuuuuaauuuuuaauguuuguggguacauaauagguauauauauuuauggaguacaugagaucuuuugauacaggccccaaagcauucugggucaguaguguuggggugggguuucagaucuguauuucuaaaaauugccucacccaauucuggugggauccaauggccacaaaguauagugagggcgaaagggaaaagcaucgguucuaccuggagaaggagcaggaggagcuuaggaagucacaaguaagugggucccuugaaaucugaacaggauuccucagggcgaugauaugggcaaaagcaaaggguuugguacugucgaugacgcugggcaaagggaguaaaaaaaaaaaauugaaagcagaaaggagaaaaaaaaaguuuuuuuuuuuuugcaaaaacauuuuguccagcacaauuauuaaaauuuuaacgccucauuuuuaaaggguuuuucucaugccuccuuaguugcacacaugaaaugucauaugaaaauggccacgcuuccagcuggcucaggccaagugucaaguauuggacucgcucagcuuacauagcuuauuauauuuguggaaugauuugugaucucaauagccucuuaaaaagaaaguauuuugguuccauuuuaauaauuuccgaaauuauuaacauucugaguaaacauaaccaagaguuugcaagucccagccaggaaagauugacagagucagucugguccucaauuccuaguuccaguaacagcuucacaugcauggcugauagacucaaaaaugcacgcuuuccuucaacagguccuagaucuuaucagagagaacagagcuaagacagagcugacagagcuaaaucagaucaauuugaggcaaaaccucuuagggccaauaguauuagauguggugcugggcauucuuugaacucauuaacauguuuucaaaacaucuggcaaucauccuuagaaguuaggucucacgggaagcuaagcaaaaaugcaaaccuucaacuuucaggaagggggaaaagugguugaggaaaucucgaugacuggggcgaagucagucucuucucuuuuuccuuuccuacaucucauuucuuuucuccuucacacauagcaauaguaagauggccaaggaucuggcaucucacugucagacagguaaguaggcaagagguguucggccauggugacccacagugacugugaggcuguauccuccuacuucagagcauucaggcaguugagccagcaacugcuaacggcaccuacacugcuggcccuuggcugugcagaguucaccaggggagagaacguccguucucuugcuugccucuguccguucgcucaucaucccugcacaagcaugucagcggccccgccaggagcugaauuuagcacuuuauagaaagucccacucuguccugaaccacuuugcuaaucagaaaaaugguuggcacacaauuaaccuuucaggaauguugccaccccugccgguaacgacagcacgaggauacuucauuuuauucucacaucuuguauuuggcuuguaucagaagaaacucauaaauaaauccuguugguuuuauuaaccaucuuucuggccugaccauguucucaauuuacaaggggugccaggacuguaaaugcugauggucuaagcagacuggguuggccaaaguugguugugcaaagagagagguaguggaagugcuuuccuuuuaagugaacgcccucaggccuggccucuguagauaccagaauaaggacugcacaggccaaagcaagcuaguauuuaggcagcuaaggaauccaucacaggccccuucuaucagccguuccuaaaaguggcaagaccugaacagggguucuacaacaggagcuugaacaauaaaacuuccugauuucuaggaaagaauacaguagugcugagucauccuuccugacaggcaaaugcaagugaccaauggcaaaggguacagcuaagcugaugaacucacuccaagaguggccuucuugaguuuuagaagucaaaucaaguuagcccugggcugugcaggaauggugaauggcguggggcugaaacuuuuucuacaaccugaggauuuuauggcauucuuggaaaguugaagggaaguccccagggcugaauagcugaauacugauaggcacaucugggauaaacuugcucccauuacccaagugaaaaccauggcagaaccaaacaaaacucccaacaagauuacacuucagaggucauuuuuaugagguuuaguacugccacagccucagcuacuaaaggcacuucaucgaugacuuggauucuuaggcugggagggugguggucuggcucuucaguuaaaccuuuagagacagaggucgauguuucuuggcccugggaucagggaucauccucgcagccaaagauugcuugcuugcugaaaccacuuacccccagcuucuauaaacuaaggcaaacuauggcccacaggccaaacccaaccugagaucuguuuuguaaauaaaguuauguuggaacacagccacagccacucauuuagucuauggcugcugcuuuggugcuauaagggcagagugagugguggagaccugaauauaaugcccauggucuaaaauauuuacuuucugggcuuuuacagaaacacuuugcuaaguccugcuccaaacauuuucuauccaauucaaucuuugccuucucuuuaguguugaacucuuuugccagaaaaguagcuuucaauuuuaaaauuucuaacuaugaaacauuucaaacagagagcaaaacagaaaauauaacaauagguacucaccagaaagaugaaaacaauacugacauuucccauuuuuauuuugcaaucuuucaguuuugaaaauguuaauauaaguaaagcuaaaaugcucuccuaucuccucaucccucacugagaugaccagcaucccaaaguugguauucgucguuccuguugaugcuuuugcugcucauguucuguguaucagaguauguuuguguguguggauaaucuuuuuuuuuuuuuccagacagagucuugcucuguugcccaggcuggagugcaguggcgcgaucuuggcucacugcaagcuccgccucccagguucacgccauucuccugccucagccucccgaguaacugggacuacaggcacccaccaccacaccuggcuaauuuuuuuuuuuguauuuuuaauagagacaagguuucaccguguuggccaggcuggucucgaacuucuagccucaagugauccauucgccuuggccucccaaagugcugggauuacaagcgugagcugccgugcccagccgauaaucuuuacauaaauuauaucacacucuuuugcaacuuuuuccccaagagauauguguuugggauuuuaugcacauggauauuuguagaaggagccuguuuauccccaccacugaauauuaaagcacaguuuauucauucagcuuauggaggaacaguuuuuuugcuuccaguuuuucacuauugccaauagugcugaacugaacauuuuggcauguguuuauuuaugcccaucuguuagaguuuuucuagaggaggcaccgggcgguggaaaugcugggucacaggauauguacaacuugagcuugacuaaguugugccgaguugcuuuccaaaugccaguaccaguauccuuuccccuggguaauaugugaguuccugcuggugcacauauuugcuaauucuugguguuaccagauucaucgccuuuugccuaucugaaacauuugagauggcaucuuaugaugauuuuaauuugcaucucucugauuguacagcaagcucaaaugccauggcugugugacugaaaauaaaugauuacaacuuacccgaagugagagaaauuaaaauaugaggaaaggaaaaauaagaauuuccaacuauaaaucuucugaacugucauggaaauaauaggaagugacuugcaacuucaaagcagaaagaucagggcaucccacaugacucagaaguuugaaauccaaauggauucauuuacuuuuccaagugacauugccugaguggaacacugacuaucauuuuguuccaggagaagcuuaauuucaucuggaaaaauuauauuauguuuucuuaaaaagguuuucaacagagaagaaaugauacuaucauuacuuacuuugacuucuggacagcaaaugcaucauuagggaauuuguaaucaacguucuaaaucuuugaagaaauuguugggauaaauucaggauaggaaauggaaugcugaagcaagauggcagcaaagcauuaaauuaaauaaggagaugaaugaggaagcgcuuggaaagcugugcguuuauacacaagugggcugcuucucucuaggguacauccaugugcggaugggagggagaacaugguuucugggcccugagcugcccauguugugaccccgugugacucacucccaggcuucucuggguucuccccuguaaaaugguguuaaugacacuugccacccucuggaccuuguugcugucagaagaaugugacacugaaaucacaucaaaacccaagaacccuccgagcaaaaaggaccaugaguuuuauuugaaaggaaggaagaaaucagaagcuauccauuagaauuuuacagccagugacauuguucucugcagccauuaggcaguaccuaaauauuuuuuuuuucagauaaagauuuuagacugcugcccgaaacaccaaucaugcucucgugauuccacagcccaaagacccccucuucgaccuuccuaggacagcauucuguguccagugagagcuaaaauagcagacguccacuucccucggagcagaguauagcuuuucugucucuguauacauaaaaauucaagaggccugucuaaaaugcuuugaacaaaaucaaaaauauccuguccaugcaacccaccaacuuuuccuguucacucuuacuucaagcuacuucauuauacuugcuguauguuaguuuggaggaauggugacagagcacauagcaaagccugaugaaacuaucacuguaaccccuuuuuccucugaaacucuugagaaaauauuuuucaauuauuuugcuucacucuuccaguaucuuuucgugauuuuucuuucugugcucuccucuuaaagguugguguuccccaagaauuuuuuccauaacccugucuucucauuccucacauuucuacuaagaauuucauucaugccuacgacuucaacuagcucucugcucaugacucauagacccucuacucaacugccuaucaaacauuccccaaauguccuguaggcaccucaaauucuauauguuccaaaucuuuucauaucuucccacucaucauuccucugauagaugcuaucccaaugaacagaacagcaccgauccuuucaccucaaccagaaaguugaauuugaacagacucuguucacuuacuuccuaagagucaagaucuccauucuuccuuacuaacagaaccauaauuuguucagguauugaauuucaaguucuucauagaccuuucuacacaccguggaguugaaaggugguugguccaagccaauugguuauuccacuguccuugcaagcgacugauuuaagcaugggcaauaagguaacugugaggcaaggugcagccuccuuggaaaaguuuuuauucccugaugaaaagagacaugccaggagaaacuaccauucaggucuuuauugugguuaggcaaggaugugaugacugaggcuuuagcagcuuccaugaggggcaagcacaggaugcaaaucaaaucuuugcaguauagagcacaaaauggaaagcaacuggauucuugauuauguuauuaagccacuguacucagcagcccuggaacugcuuaccucuggacuucguguucgugaguuaaauucuuuaguauuuaaaucacuuuugcacagcuacuggagaguaucccaguuuaucuucccguauauuaaguccaucaacaagaccucaucuucuuucauuccucacuucuuaaucccacuguuaccacuuugguuuagauccucaucaucugaacauuguguuagucucuucgcuggccucccuucucccuucagauucacacucucagauccaucuucucagcuccuaucagaguggacauuuuaaccugcaaaucugucuguguuauuccuucacauuaaacccuuuaaagauuucucgucacuuacaaacaaguucaaagucuuuggcacaaugcauaggccuucugcaaucuuugucuucuuccugucccaucagauaguaucccuuuaccuuacaccuuaugcuugaaaugcacaaaacuauguguucuaucuaccacaugcaaggcugcuuuccacucccauauagcuauugcuuuagccugagauauuauuucucuggccacuguuagucacuuaggcuucaauaaaaugcuguuuccuuugugaaaccauacauguuuccugugcucuuuauuuucgccauggucaugacagacugccuucauauagccaauagaugugguguagcuauugucugcacauuuucucccccacuggagucuaaguaauuggaagagagggguauuuaaucuuuguuuccacagucacuuacagugggucuagagcauaguuuuaaauguuuauuaauuuaugaaugaaugaaggacuggaugauugaccagguuuuaccuacacuaguauagaugugacauuuuuucuauuuuuaaaaacuauaaagaagaacuugaaacuggcuuaacuucucaauaggagugacacuuucuacauaagccuuuaaucacaauaauuuaaugccuaucuagcuaucaaaaucagaagugaacauaauuauuaaaaauggaauauuugaaaaaauggaaaaaaacuguucaguacuaauaauuuuugcagguccucaucuuccuuuuauuucaaaguguguuccaccccucuuugcuccuucaaucacugaucuaauauucuuuguuauuucucaucuuaacuacuacagcaauucuggguaacuggucuucaaaucagcauaugucuaacccucgggggcuacccguaggcuuuccaagagguaugaguacaaggguaguuuuaggggaaucaauauacaaauccucaacuuccauuuuuucuuuucuuccacgagaucuguugaggaagugccuacaauagaauggacagauuauccuuuccugccucucuucuugcacuugacagaagaaagugauagcucccauccaacccacucuuauugugguauaucgccuaaaguacaaaaaaaggcucuagggcaccaagcaaagggacaauucuaaauauuguuacccucacuaaaaaguaaaugacuaaucaguuccuuuugcaagucaggcuguuucccauaauuuucuuuaaaccaaaauuaaaggagaaucuaauuacauuaacagcuaauauaucaccaaaaauaauuuuugauaaugauugcuguuagauuuuuuucacgucuaaguuugaaggauuuuaagaaaucaagacauugcuguuaagaaaauacauuguauuauauucuauuuaugugaacacauuuccuuaguauauguuauauauauaauagaugauauaguuuggaucuauguccccgccccaaucuuaugucaaauuauaauccccaauguuggagguggggccugguggaaggugauuggaucaugggggcaguuuccaaugguuuaacaccauuccccuagugcugugcucaugauagagaugucacaagaucuaguuguuuaaaaggguguggcaccuccccuaucucucucuuccuccugcucuggccaugugagaagugcuggcucccacuucaacuuccgccaugacuguaaguuuccugaggccuccccagaagcugagcagaugaccaacaucaugcguccugugcagccugcagaacugugacccaauuaaaucucuuuucuuuauacauuacccauucucagauauuucuuuauagccgacuaauacaguauguauugcauauaugauuauacuauauaaucauacacacgcacaguagggaaugucugcugagcccugucuucuuucuaggaaaaaguaguauucauauaugaaaacaaaaacaacaauaaaaaaacuccauucauggggcaucuauuuaagagaugaaaauaauugaaauuuaccuuuuuguauuuaauaauuacuuacuaaauuuauaaaauauuuaugcuauuuugcccucuuuuuucaguguuacuggguauauuuaugccuuuuuuuaucaaauacuguucuucacucuaauguguaaucaauccaaagagccaaaaaaauuaauccccaaaauuuaaauacuuuaaugugaccacauuauuaaaaucaaaaucuacaugcauucuuuuugucauagaaaagaaugauaggaaaaaaaaaagaaugauauggugaaaagccuuuuauauauaaaaccuauuaugaaauaguucuauggguagaacuacaaugaaauaugaauuaaggagaaaaaaauguaaaauuuccuuuagggaguauuucuacauguauuuuucuuaaaaaguguauaauaguggguauaaaauagcaaugguauuuauauuccucuggagacauuuuaaaacgugguauaaccauuuuuuuaaaaaaaagauccaguuugcaauacucuuuacauaauaucuacugcaaauuuuagaugucaauuaaaaagugugagaggucauagauuuagaacuaaaaauguuuggagaacaguacacugaaguauauuaaagcauauuauuauauuauuauuugcaagcaugagaauaucauuaaugauucugggcaagaagaauaagucauucuugaacucuuugauauguaaaaauuuuauguccacaugaaaauguuauaaagaaagaccucaggcuucauuccucuccuagucacucacucaagucucuugaauucugcagccucucuuuccugacaguuuuucagaacagucuauuagcuaauggguccauagaggacuggaaagucucauauuaaguaauuuaauugaaacaagaagucugguuucgucgguguuaagucuuacgcacccugccuuuuucaaguuagcuuuauugacaacugaugcugaauucagacaaauuagagugcaaauucaaggcucucgaccaaggaaaacaaacauaaucagaaacaaucaaucaggagacuuaaaacaugccaguggauaugggaguuacgggaaaagugaagaaaaaaaguguugaaaacggauuaaaaaugaacaccaauaccaaaagcauucuccauuuaugaggcuaugcuaggcagcacuuuuguuaaaguugugcacauuaauuuauucauucauucauuuuccauguuccaugcaccuuccuaagguuugagauacaaagaagaauaagacauugacuuccucccuggaauaagacaaagaaaccgaaagggacaauaaaccuggacauuggaggcuagggaauuggcuguuugaguaagccaugaaagacaaugugagccugagcuaaguggugauggggcuaggggugaaggaaacauuucagaugcuugggcuuuagcguguugaagggauugagugacacaacaaugaagaagggggacaucuagguagcugcuucaggcaacuggaugauggggcuggagccggggcugguauucaccaugauagagaauaucggaggaagagcugguuuugggcagggcagggaguuucuauggcacaaggaauaaaagaugucugguagaacacgggccucagaaaauugcucuccagcgaugcccagcucuguguggguaauaagauuacugagcgguagaguaagaagaaaagugggcugagagugaaacucaggggaacaccagcuuuuuccuucccuccauuccuuccugccugccuuccugccuuccucccucccucccucccuuccuuccuuccuccuucccucccucccuccuuuaccucucucuuucuuucuuucucuagcucuuuuuacccgggcuggagugcaguggugcaaucuuggcucacugcaaccuccgccuccuggguucaagcgauucuccugccucagccucccaaaaguagcugggauuacaggcaugugccaccaugcccggcuaauuuuuguauuuuuaguagagacaggguuucaccauguuggccaagguggucucaaauuccugaccucaagugauacgcccaccuuggccucccaaaaugcugagauuauaggcauaagccacugugccuggcuagaauaccagcuuuucaaggaaguaaggaaaucuacaaaggaagacaaggaaaagcaggaauagcaaaggcuauaagaaggcagaugagggaaaggcugaaaagucuucacuggauggagagaggucaccuugguggaagaauuucagagaaggagggugggggugggagggaaacaagauugcagagaggaagaagugaagacgauguguacagaauccuauugacuaugcuuuaaaauguugcugauaaaccauaauuugucugcccuuccaaauauuuaaggaucuacucuaagugaaguaaaugaaauaacuagagaggauggaaaguguuuucugacccacagcauugggaacccaagauacaucauccugaaaagcuaaacaaugagguacgugccgagcuggugccugggcuugaaauucccucuauuuuucugaaauuuugcuuguuucucaaauaauuaaccuucuccuccaaauaccuaacuuacuagcucucuacaauggaaaacuucaucaggguagagacuaagucuguuuuguucaccacuguaucucuggauuuuagcacagguccuggacacauaguagaugaccaauacauauuuauugaaugaaagaacacacaucuaauguuucagagaaacuguagauguuguauuugcucauauucaaacagccagaauauaacugauauuugagaaggggaacgucugggagguuaggagaaucaguucuuggccuuuuuauuuuggaaauaaagcaaauguaaguguaccauucaugcagcaaauauuuacugagugcacaugugcucgugcuguuucguguccauucugccuuuuauaacuguuuagaucuuuccuaggaucagccuaauuauaaauaauguaaauaaaaaggacuucuacugaacuuuugaaguauuuguagagaauguuucuuguuaacaucaaacagaaccaguuauaccuuaagccaagcuuaucaaguauuuuuuaauacauuguuuccaaacacaaguauuggcacauuuuuccauagagcaaguucuauuaacaaucuauuacuuguaugcaacacaaauucaauaaacgacuuucuuuuucuuuuauaaguggaucucaaacuucauuaugaacacaacacaccugggaaugcagauuccagguccacguacuuccagaauucccugacucaagaucugagcuggaaccugagaauugauauuuuuaauaagcaccccauacucugaaaaacaaagcccaaauuauuugucuaaaauguaauuauuugggcucugguccauugccuggggcaaacuucauuaauuauauccucauuaauaaggaccagagacuaaugcagugauacguagcaaucaguguuagaguuaauugaaauuuagaucuaacaucucuucuuucuuugagcaauuuccccauguuuagaguagaggacuucuuuaaugauuugugacaggaagaugugagggagaggauuugaaaguaauugugacauguguuuccaauuaggaugccuuucuucuccagccugugggcugugccuucugcagcucuauggagggucauguugagagaggccccugcaccgggcccaguggacagggugugaaccagggaccuggcucacuccaacucagguguagugaaggucagcaugcauguccaagcagaggcuugcccaggagccagcucauuugauuuuuuuuuuuuuuuuuuuuuuuuugagacagaguuucacucuuguugcccaggcuggagugcaauggcacgaucuuggcucacugcaaccucugccuccuggguucaagcgauucuccugccucagccucccgaguagcugugauuacaggcaugcaccaacaagcccagcuaauguuguauuuuuaguagagacgggguuucuccauguuggucaggcuggucucgaacucucaaccucaggugauccgcccgccucagccucccagugugcugggauuacaggcaugagccacugcacccggugcucauuugacucuuaugaccucccugccccuuucucuccccagcuucccaugaaguucgaaucucuuucaggcaacacacauugaaugggaacuuaagaagcggaagagaaucuguaggcaggcaucuguuaugguagaaggggccauagaaggaauucugcauauucaauaugaagaagaucaucuguauuugguggaaguaaguacuggagaggguagugauggggugucaagaacucaugaucccugagagcugcucucaaauauuugaagggcugucauguggaagcuacgguuaagccuuccugggcuacuguagagcaaagcugagaccaaugagcagagagacugggagaaauauucuuacucaauacauccauuuauaaaaauaauuaucgcucuuuaaaaagcaaaugguaggccgggugcgguggcucacgccuguaaucccagcacuuugggaggccgaggcgggcggaucacgaggucaggagauugggaccauccuggcuaacacggugaaaccccgucuccacuaaaaauacaaagaaaugagccgggcgugguggcgggcgccuguagucccagcuagucgggaggcugaggcaggagaauggcgugaaccggggaggcggagcuugcacugagcagagaucgcgccacugcacuccagccugggcgacagagcgagacuccgucgcaaaaaaaaaaaaaaaaaaaaaaaaaaaaaaucaaaugguauccggaauaugucaauccacagggacagacugcagacugcugguugccaggggcuggggguggaggggaaaggacagcuccuuaaugaguacgggguuucuugugggggcaauaaaaauguuuuggaacuagauagagcuggugguugcaaaacuuugcaacacuuuucaguacuaaaggccacugaauuguacaccuaagauuguuaauguuacguuacgugaguuucaccucaauuaaaagaaaugaauuagcagagacauuaauuaaaguggugauuuaaaaguuuucgaugaacaaauucagucugugguuaacauuuaaauuaauaaaaaaucaaauauuguucucuuuuucucuaagaaaauacguaagugaagguuuugugauuaugcuuccaggagacaaaaaagagacgucugcauuaaguagaaaguggcauuagguaugaaccaagguaaccagcuuuucuuuuuaaaaaacguaauccuuuugucuuuaaauuaauuuuauuuugguuacaaaaauuauuugcuauuuguagaaauuuuggagaauuuagaaaacauuaaugacaacuacaaguaacuuucaaugacuaucuaaucuaacacguauauguguucaaaguaguuaauuauucuucuauuuagguuguuuccaguuuucaguuuuacaaguaauacuguuuugaacacuaguguacauauuaauuuuggauuauuauuauaaguuagguaucuagaaguagcauuaguuucucacuaacagaucuugaacucuaacauuugauaaguuugaguauagucagcacuccauauccauagguuccacaucugccuaucaaaaauauucaggaaaaaacccaaacaaugaaaaauaacacaacaauaaaaaauaauacaaauaaaaauacaguauaacaacuauuuacauagcauuuuuguugaauuagcuauuauaaguaaucuagagaugauuuagaguacacgagagaauauccauaggccauguuuaccaugggagaauauccauaggccuuuuauaaaagggacuugaggccaggccuguuggcucacgccuguaaucccagcacuuugggaagccgaggcgggcggauaaccugagguuaggaguuggagaccagccuggccaacacggugaaaccccgucacuacuaaaaauacaaagaaauuagccgggugugguggugggcgccuauaaucccagcuacuugggaggcugaggcaggagaauugcuugaaccugagagguggaguuugcgguaagccgagauugugacacugcacuccagccugcagccugggcgacaagagcgagacuccaucucaaagaaaaaagggacuugagcguccguggauuucaguauacuuggaggauucuggaaccaaucccuuuuagauaccuaagaaugacuguaucuguuuaggaaaucaagugucugugguccagggaaagaugaaugagacagcugcugcacccccucauaccccaauaagaauaaguguggaaacugacacuucaaaacuccagaccaggccaaggagcuggcagaccaggcagaaguuaagcagaagcagggaaaagaacaugugcuuuccaucucucuguacacuugucaaaccauuuuaauuguaauuuuuguuugcuugggcaaaugguuuuuaagcauaauagauuuauguugaagauccaguuaccauuucaaugcaagggaauagugaaggacaaaggaaaauuauuugagggagauuuuuuucucaagaaaaauacaagagaagaauuuacuggugaagaauaaagaauauaugugacuagagcaucaguaugaaaacuucuaauaguguguuaaauaaauaucuauuaauaagagaaaagucucagcuucaaaugggacaauauccuucaauauuaauagaaaauauacauuuuaaaaauaaaaagugacuugucuggauaacucagcaccgggcuaguagaaucauuccagaaguuauaauuaaaauuccaccuauuuuccuacuacuaaggcucuuuccuucuuuucacaaugaauuacuuauucaucuugaucucacacaugagcuuucugucgcagaacuuauaagcagaggacuuuauugaaaauaauuuuaaccacugaaugcaguuugcucuacuuuuugcuaauuguaauacauucuuacuucccugacgcauugauuuaaagaaaaaaacgauaaaagcaauaugacauuugagaucuuacuuguuugaaaugcuguauuuuaaaaaguuuccagaaucauuccauauaagguuucauguaaaauacucacauucauauuucaguuuguugacagaauuuguuauacauuuaaguuauuaaaguuauggcccugauaguaguagaaauuuaauauccucuauaaucccaauuccuguuccugaacucuccauuagacaacacuacuuuggcacuuucaaggagauguaaauuaaucauucucaacacauacuuauugugagccuacuaugugccaggugcagugguggguacuaggaauacagcagauaugauccugucuuuccuagaauuuacauucuagagaggauauacagauaauacacuaguaaauguuauaaaauauuuucagauagcaggaaguucuaugaaggacauaaaaagagaugaugguaguagagagaauggugugggguaggacauaauuagguugaaugguuagggggcuucccuauggcaugcaacgugagaccugaauaacaagcaaggaugauacccagaugugugaggagagagaagagcuagcaugagaaugaacugggaugaggacaaacucuucagguucuuagaagagaaaggugaccgggcgcaguggcucacgccuguaaucccagcacuuugggagaccgaggcgggcggaucgcgaggucaagagaucgagaucaaccuggccaacaaggugaaaccccaucucuacuaaaaauauacaaauuagcugggcgugguggcaugcgacuguagucccagcuacucgggaggcugaggcaagagaaucgcuuuaaccugggagacagagguugcagugagccgagaucacaccauugcacuccagccugggugacagagugagacuccaucuacaaaaaaaaaaaaaaaaaagaagaagaagagaagagaaaggccaggaugguuggaacuuacagugcgagggggccaguauccagagauggggauacggcagauggggaccagaucaugcauggucuuauggaccgugauaaauguuuggauucuguguuuggugagaagccacaacaggguuuagaguagcaaagugacaucaucuaauuuuaugacuuggaaacuuaacucauacugcuuuauagagaaagguauauuggugagaauguaaguggaagaccauuuaagaauuacuggaauaaucuacaaaugaaaaauaauggcaguuugcacuagggugguaguggagaaaaagagacagaaauggcuuuaagaggguuucagaaauaguccggugcgguggcucaugcauguaaucccagcacuuugggcggcugaggcggguggaucaccugacgucaggacuucaagaccagccuggccaaaauggugaaacuaugccucuacaaaaaaauacaaaaauuagccaggcgugguggcaugcaucuguaaccccaguuacucgggaggcugaggcaggggaaucgcuugaacccaggagguggagguuucagugagcugagauugcgucauuauacuccagccugggcaacaauagcgagauuccaucucaaaaaaaaaaaaaaaaaaaaaagcguuucagaaauaaaaacaacgugucacauauuccauuagaggugagacuggagcaaaguuuuugaaguaagcaagacuagaggaagaagagucucaggcagaacucaaggguucuauuuuggccauguuaaguuugagaugucuauuagauuuacauuugaaaaacucagguuuucuaaaguuuacaugaaaggugagagugaaauguacacacuggaguaagaacaaugcuuaaaguuagggauacggaugaacauauuuaaacagaaacuagagaagaacaagagauaagaaacagcucugugguccuccagccuuaaaaaguacuaucaacuuuaacaagaaggccaggagcaauagcucacaccuguaaucccagcacuucaagacgccaaggcaggaggauugcaugaggccagcagcccgagaccagcuugggcaacauggugaaacaccaucucuacaaaaaaauuuaaaaauuagcugggcuuggaggugcacagcuguauucccagcuacucaggaggccgaggcagaaggauaguuugaacccaagagaucgaggcugcaaugagcucaaucuccucugcacuccagccucugugccccugcacuccagccucugugccucugcacuccagccugggcuacagagcaagccucuaucucaaacaacaaacaaacaaacaaacacaaaaaaaaaacugaacaaaacaaaacauacuuuaacgggaacacuuucaguggaaauguuuugaaaaugaagccacauuagauaggaaagaggugaggauguagaaaccauaccuauaagcaagacuuucuggagauuuuacaaacacauaggacagaaauagcagcgggaauggggaggaggacugaugagguuaaggaaggguugugggugauuucaguccaagugaugugcaauugugccauuaagcuugcucuucaauaaaacaacuacaaaugauuccaacaaauccuguaaauccucaauacauacacuuuuacaagucuaauuaauuggguacuaauuuccuccauucauaguuuugauuauuuacuaaaugauuuuuguuaaauggaccuacgaguccaacuucuuuuugccucacuuucacacuccauaguuaaaauaauguguuacuuucucccccuuuaaugagaucaaaguacaucagaauuagauaauaucucagaagugcuuuaagucucuuggaaguauucuauuaucagggagacuuuuauuauuuuuccucauuuacucauuuccuuucucucucugggagggcacuuuugagauuacaugagguuggaauuuaugaguaaaacaacacaaauacuuaacccaaguacuagcacuuaaagaaaaagggauaggggucauugcaaaauauuguaaauuugaggacuaacaauuugguuucguggguuuucuuccugaggcuguguuccagagagggcaauaaaggguaaaacucauuagugcaucauuaucuuuugucugagggaaacaaugugugguuucugggcagcccacuugguguuugcauugguccuggaaguauuucaaaccaacuauauuguuugaacaauucccccucuugaacauaaaaaggaccaccacuaaaccacagaguuaaugcuaaauuacuaggugaugauuccucuggcuccuaaagguuucuagaucucagucauugaaaucauggaucuuucuucuaaugagaaagagcuaagccuuuaugguagaccucccauacagucccccgccccaugccccaaguauacuccauggacuucugagaaguuugguuuggaaucaaggucauugaguucucuccaacccugacuuuuuuuuuuuuuuuaagagauggggucuuguuauguugcccaggcuggccucaaacuccugggcucaagcaauuaucccaccucaguauccccaguagguaagucuagaggcaugcgccacagcaccaaguucaacccugacucuuagugguaauucuuuaggaagcgcaaaaugaucuuaggucagaccugcacauucacaguuaugaguaacuguguaacugauuaauagauuugauguugaaaauccagucuguuuucucuuuaucaaaaugaggcauuaaauggauacuggugauuuuauuuguauucuauuguucccuaaacuuauuuagcugccuuggggauuucauuagacuuuucauuuugaaugauauuauuagaagagcauuuaugaggauaucuuaaaaacacauuugggggcaucugggaagaaaacuccuuucauagggacuuccaguauguauaauacuauauacugugucucuccaaaagaauguuauuugauuugcuguuucucagguuguaaucucuugucuagauuuaaacaacaacaacaaaaaucaccuaccuccugauuuguauuauuucccaauuaugagaaaauuucaggguuuuagagaccuagaaaauuguaagugccagcaagugagccuuaauucugagccagaauuguggguuuuaauuuuuguuacuacuguuaucaugcccagugugauccagugauguaacacguauuggaagaugggggucggccaggcugauuucagucugggcccuggagcuagaccgucuaggcuccagcucugucucuaguacuugucacuagugaacacuuggugaacacuuuaggaagucuucaaaucgcuuugugccagaguuuccucaucuauaaacuggggaaaacaauacaaccugcucauaauguuauagugaggauuaaauaagguaauacauaucaggcuuucacaauaaauauuuguccaaaaaaacaaaacaaaaccaugaagucccauuuuccacaugagaaaacugagcugccacuauuuuuaagaaccagaauucaaacuuaugauuuuaaaaguuccuugcuuuucccaaauauaucacaauuaccucccuuuaccuaucgauaguuuaacaguguuccuuuccaacuguaucauuuuaaguaucuaaagaaaaccacuaaauuacauuuaagaauuguagcaacccuuuguuggaucaucuuaaaauucuuaguaaauuuugugcaaggagucucacauuuuuguuuuccacugggucuuauauauuauggagcugguccuuuaugcaguacuauuuauuuggaaguaucucacaaauacaaggagaacugaacuucucagcccucugaaugggaauuauaguugugaugcuaugauaaaccauaguauguauucuuacuccuuagugggcuaagagcuucauagcauaauauuuuaagaaaaugaacaaucaaauuaucuuaaaucuauuaaccagccaaccuuacuuaacaguuuauguuucaagccaugguucacaauuuuuugugugucauggcaugcauguacaagcacacagauacaaacacacacaucaaauagcuccuggggauaaauauaugagucugaucacacguagaggcuuggcuauuccagaacucuccuggucauccugaauaucugagauuauuucaaaccagcuauguuguuuaccaacuauauuaucaggaaguuuaucaucuagucaagagaaauuccuugcuuuuuuauaauaaugaauuuguuaaaaauaauacaaauuucaaaaaauggcauuauagcuaggaacacacauaaugccagcagaaaauaggaguccuccuacauagacccacugccuaaucccccagcuuucaacagcccgaauccuacauagcgucaaucaaaggcauuucagagaugcugagauagugaaggcaacaucguacgaagcagcagguuuugucauugaugucacuuuuauucauuuccacaguaagagcaaaauuucauaauuccugccaaucaugucugcuaaacuccuuuuacaucagccaaaaaguuguuuuucacuuuccuaaaagacaccaauuucucccaauuaauuuaggcuguacuugacccauuuaugcucugugaagggcuauauauucuuggaauagagagaugcuuggcagaagcaaaaauugccguuuugaaauauuaucauccaucaaucuuuaucaucaguuggagagauagaccuaauuaagucauucauauguaaaaggcaaaaucaacaacuuuucuugauaaauguacuugcuuuuucuuuaaaggauggacacaaauuuuaaacagaaaauacauccuuaguuuuuggguuuuuuuaaacauuuuaucugcuaauucuucucaugucugaaagucaagaguuaacaacugacaucuaagaguuucuggauuuguugucuagaucaauuaauaagaacagauaauucuauuugaaaaucauguucucaucaaagaauuacaucucauucagaaacauccaccucaccaaaauaaacacccguuuucauggcaacgaauuucacucugcuccuacuucaaaaguuaugccauuggucaaaagaggcuuuggaugaaaaucugcaugcguggcuuggugcuaccaaacaucacuaaugggaaaacaaaggcucucaaaguacauauugucuuuacaagugacagcauguuuauguugcuugaugaauuuauuucuugacagacuucaguuauuucuaaagacuaguguucuugugggucuucaggguguaauaaauaaagagacaauacucaauggaaaccaaauuucaggaacugauucauuacacacacacauacauacauauuaggcuaaaaguuuauaacuaugugaaagaauuuuacaauagauucucucaaaaagcaaauauuuuuggaaggugaagaaacacuccucaaguuuucuaaguguucaauucacauauuaguuuaaggaaaaaacaaaaggcagugauguguaugggaccauguguccgcacaacaaaugcucuuagacuggauauaaaauuauaauuggaaguuuugucucacccugcccaugaugauauagguagcuccuugcuaaugucacuguuugaauugauucuacuaucacaacuuucuccuaacuucucuaguuuuuuuuuuuuccuuuauuuccuuucuuuuugccaccuuuauuuuuucaugcuucaucucuauccugguaacaggacuuagccuuuauaaccaccguuuuccaaaaauaaaauucccauauucccaccgauaaaccaaucaguaauacuaaguuucaaaaauuauuuuuggacucuuggucaaguuagauaucaacauauacgguauucacguaacauuuuuuuaaaucugaaagcauauuuguuuugauagagauuaaauauucuuucuuccuccauccuuuuauuucucaaguuuucugaaaccaauccuuauuguuugucuacucuguacuggggauaaaaagauacauuuuuuuuuucuugagggcaucaucaacuuauuucuaucuuccacaaaagauauauaaagcaaaauaaaaaggacuuagcaauggaguaugaaaagcucaccaaguccaggagcgguggcucacgccuguaaucccagcacuuugggaggccgagguggauggaucgccugaggucgggaguuugagaccagccugaccaacauggagaaaucccgucucuacuaaaaauacaaaauuagcugggcgugguggcgcaugccuguaaucccagcuacucaggaggcugaggcaugagaaccgcuugaacccgagagacggagguugcggugagccaggauugugccauugcacuccagccugggcaacaagagcaaaacuccaucccaaaaaauaaaauaaaauaaaauaaaauaaaauaaaauagucaucaaaacuauaauccggaauugcucucccacuuauaaaggccagcucaaacuuacuucuucaguaugcaauuuuuguguguaugaguaugccaagcacauggucaauuacccuaauuugcucuuaaagccuuugagccuaggagucauguguuagaguugggaugagcucugguggucaacuaguccauucucuuucaaacacaggauuccaagcagcagaaugcagggggacaaauaaccaccucaaccuuuacugucucuuuucacaaaauggucauggcugaaugaggcuuugggacagugugaguggacucugcucauagauaaguuaccuugaggaacaagacugaaauagauguuucauaaaagugucuuuuuuuccuuuuuccucauucagauuauaaauucauuaagugcagaaacuuuuucuuuuuuuuugagacagagucuuacucauugcccaggcuggaguacagugguacaaucucggcucacuacuaccucugccuccuggguucaagcaauucuccugccucagccucccaaguagcugggacuacaggcacgugcuaccaugcccagcuaauuuuuguauuuuuaguagagacgagauuucaccauguugcccaggcuggucuugaacuccagaccucaagugauccucuugccucggcuucccaaagugcuggaauuguagaugugagccacugugccaguccaggaauuaauguuuuuacauauguuuaucuuuuuaagguuuuuuugguaugauauuuugucuucaugggcaaaaaaaaaaaaaaaagcauuuuaguuuuuguuuguuuguuuuugcuaaauuuagcuuagaaccaacaaucugguucaguaucccauccucugguuauuuuuuggaaaagcaggacaacauaaaguaccaaaauacacucuucauauaacugugguuuaggugaaaucugauuuugaugccauuaaauuccaucugggagucccuugcucuguuccauucccuaugcugucaguuaugaaggcuuuauauuuuccugguucugucuugugagugauggaagcagcuuauagauguccacacacaaagaccuuaauauguucucucuuuccccugcuuucucacuguucuauaucuuaaaaaaaugaaacgggaggggugggcgcgguggcucacgccuguaaucccagcacuuuagcaggccgaagugggcggaucacgaggucaggagaucgagaccauccuggcuaacacggugaaaccccgucucuacuaaaaauacaaaaaacaauuagccgggcauggugaggggcgacuguagucccagcuacucgagaggcugaggcaggagaauggcgugaacccgggaggcggagcuuacagugagccgagauggcaccacugcacuccagccugggcgacagugugagacuccgucucaaaaaaaaacaaaaaaacaaagaaacaggaaauggcaguuagcauaccaaaggaagcgcaaauggggaaauggcaggugaaaaugacaucuguuagaauauuuucuauucacacuagagaacuugccuggggucgcccauauugugcuuaaaauggccaacucuuucuaccuguaaggccaccaacauuucauacacauugguggucacauaugugauguauuuuuuuucuguguuuuuaaaauauaauuuuaaauguaggccagggucaguggcucaugccuaucaucccagcacucuggaaggccgaggugggcagauuacuugagccauggauuuugagaccagccugaacaacauggugaaaccccaucucuaccaaaaaaaaaauuuuuuuuuaauuagcucggcaugguggcacacaccuguagucccagcuacucgggaggcugauguaggaggauugcuugagcccaggagguugagguuucagugagccaugaucacaccaccacaccccagccuggaugacagagcaaaacccugucuccaaaaaaaaaaaaaaacaaaaacaaacaaacaaaaaaaacuaagacaauaauugcaauuucaaagaaaauccugaaacaaagagaaagagacgaaaaaagggauuauacugaaaugaaagagcaaauauagagcacagacuuuugaaacgugaaugccagggaaagccgugaauaacacucugggcaaaguccuccccugacaacaauguaucuggcuucuggcacauucaaguccccauugaaugcuuuaccuuggcaaagcaauuuuggaacagugguaauuaagacagagaagagauuuaaugguaaauacaauuuuaccaccaacaucuagugguaaaauggagcuggacccauuaauaaugaaaauuuacaguagauuuauaaaaugauuccagagaaaucuuuaaaggucccuagagaacgucauuguugucaggaguaaaaggcaccucuauguuaucaguuccuuuuauaugaauguuugcccuugccccugagaaaacauugacuuacacauuuguuaacuuuuaguaauuuaggugacaauuuucucugguguuugcuaagacuaaagccuguuuggugagauacaauacauugcaacuucgugcuccugugucacucuauuguuuggaguuccuuuccaggaaagaacacuucaucuaucucgaaacaaccaauguagauguccuugagcuuuauuuacaaagaacaagaggccacgaaggaagaaaaaucacagguaaaucacaagcaaaaucaaagaguuuucuucccaucuccauaaaacaccuucuuaaaaaaagauucaacaaugacuuuaaccaugaaaaaagaagacagugcuauuuauauauuuuugaauggauaauacauguacauacagguacauaauucaacaauuacaaaauggaaggcaaugaacacuuucaacccaucccugacccuuagcucaauagguauggaauauaaucaguuucuuuuuuuugagacagaguuuucacucuugcccagguuggggugcauuggcacgaucucagcucacugcaaccucugccucccauauucaagcaauucucccgccucagccucccgaguagcugggauuacaggcaugugucaccaggccuggcuaguaauauaaucaguuucugaucaucacucuggagcaggguuucucagcuucagcacaauugauauuuugggcuggaucauucugugcuguaaggggcugucaaguacauuguugaauguuuaguagcauuccuggcuuccacccauuagacaccaguagcaguuucucccucccucuccagaugugacaccaaaaauguuccccagacauccccaaauguccuuuggggagacauuuaacaauauaacuaaagaaaacuccauaccaauacacaaggaguguucucacuguuuuuuuuuguuguuguuguuuuggagcugcauagucauucauuaaauguauuguaagaauuuauuuaaccaguaacuuauugaugauccuuuaguuuuuuuguuuuguuuuguuuuguuuuuucauguguguguguuauuugccacuacgugcaggauugcaaugaaaaaucuuacacauggguuacuuaaauauaugaaauuuuaccuuuaauauaaacuccuagaagaaaaauggcuaugucaaaggcugcauguagcugcaauuuugauaggcauuuccaaacagucuuccuuagaggccauggcaguuuguaugcucagcaaccacauauuuuugccaauguuguguguuacuaacauuuaguuuucauuuccacauuaaaagguuaaguaacuuuugauuuauuuaacaucuauuuauauauugucuguuuaaauccuuuacucaucuuuuaaucauuuugauugacuuuuuuuuaagagacagaaucuugcucugucacccagguuggagugcagugauguaauaaucauagcucacugcaaccucaaacuugugagcucaagcaauccuuccgccucagcaucccaaguagcugaagcuauaggcacaugccaccucgcccagcuaauuuuuuauuuuuuguaaagacaaaaaauaaaauguugccagguugguaugaacuccuugccucaagugauccucccaucuuggccuuccaaaguguuggaauuagaggcaugggccaccacacccagcucaauggauuuuuuagagguaauuuacauauuauacucuuugucuaugacauguauuguaauuuuuuuaaaucuaguucauugucuuuugauuugccuaugagauagaauagggaguucagaaaaaaaacauagauacauuugggaauuuaagaagugauuuaugguggcauuuugaauaagugcagaauuauagauuuuacaauaaaugguguugggacaacugacaaguaaucuguauaguauaagguuggguuaauugcucacaguacaccaguacaaauuccccagggaccugagauauaacugaaacagaaaagcauuagaagaagccauagaagaaugauuuuuuaagauaaucuacuuguggugaaggccuucccaagugugacauaaaacaacaaaagccauacuagaaugaaauguguuuauuuuuugaugaccuuucuuuugcacacuuuuuuccuaccaugguuuucugaacuacuuccaagacaaaaauagacauaucagcagggccucagccccuuuagcacgagcccaaagugaccucaugauaaugauguugaagcaaugggauuuaacagcuaggccagucguggaaagcccaggggcuuuggggucaggcaggccuaguucucaccuccugucccagcuacugagacaccgugaccuugggcaguucacacauugacugugagccuuaguuuucucuacuuccucgggaaccucagcuacaauuccaugugaauguaaagcaccuagugggugcaggcccuaaaugacugguacucacuuccuuucucucccuucucccuuuaacacuggauucugugcaagcuucugaccauuucccaaugacacacuuacugcgcaagaaauguccuaauuucuuuccuuaagauuucugagcuguguccagugcugugucuccauguagggguugugccgcagguaggucuacugcuccuugcuuaccuucucucuggagagauaggcagcaggcccaaaggauggaucuuaaggcucuccuggcucucagccuggagccaugaggggcuuuucuggaaugaagggaaauggggagggcucuacuugugcaaccuguaauccuccuggauuuguuuucuauggcagccguagcaaagggccacaaauuuaguggcuuaagacuccacaaauguuaauuucuuuuuuuuuuuaaacagagugcuggaguacaguggcaaccaaucuugucucacugcaaccuccgccucccggguucaagcgacuuuggugccucagccucccgaguaguugggauuccaggugugcaccaccacaccuggcuaauuuuuguauuuucaguagagaugggguuucaccauguuggccagguucaucuugaacuugugacuucaagugauccacccuccucggccucccaaaauguugcgauuacaggcgugagccaccgcgcccaguucuaaucuuacuaucuuagaguucugucgguuagaaaucugacaugggucucacugggcuggaaucaagaugucaacagggauguguuucuuucuggaaguucuaggagagaaucauuuccuugccuuuuccugcuucuaggaguuguguacauugauuggcucccgguauuauuucccuaucuucaaagccagcaacguugcauuucucuggccauucuuuugcagucacaucuccuucugaccacagccaagaaacguacuccugcuuuaaggacucacguguuuauauugagccugccuggauuacccgggauaaucucuccaucugagguccuuaacugaaucauaucuacaaagucccuuuggccaggugaggugacauauuuacagguuccagggauuaggacgugggcaucuuuggaggggggcauuguuucgucugccacgccucucuaacgugauucagauacccaggugguggacaauucauccugagacauuaggagucuauuuuauaaucauaucaugacaauaauugcaacggauggguaguuugggggugauuauuuugucaaaauuaaggcauuucuuacaaacagcacacaagcuuaacaugcugguuucugcagaaaucaaagcagcucagucuucacugugccuucaacacuaauccggcaagcauuuaaagcuguguucccucuggcuugcucagccauccaguagagcccuggugcagcugcuagccucggugccacggccuagaucagguuacuccugccuucuucucuaacuugccucucucccaagaaguacuuugauuuaaauauucuauuacugaucucccaggcacucucugacccccaucugucuuugaggcaauuccaaaucuccgugcuuacguggacgugucuucaagagcaucucauagacagacgcacauuguucuuuugcuguuccaaauuacaauguuccaaauuacgaaaaaaaaaucugugcuuuagugaaaguccuucaauauuuacacgcagcaaaaaauggaauuuggaugucgccagguuaaaaauugcauuucuaagugacuuuucugagcauaugaagagauggcuuaagggcacuggcuggagagaaacuugaaccucuaggauggggucaguuaucuuguuaccuuuuaacccuauuagcugauguucuaccagcuaagcaauacuuaccaacagcaaucuucaaagcccagacuagugagauggcugagaaguaaaggaagagaaacagaaagagcucaugagcaggaaaaaagaauuaaguccauuuccagcacaggguacguugucaaugucaguaauuuguaucccugacauguugauuaauccuuuucuagaucuggugguauguuuucuacuuaucucagcagcccagauauaaaaugccauuaauucuuauuaaagaaaggaaauuuaaucuugauagauuuuacaagaugcacaguuguugaucaucauguaucacucuguauuuguaacuugaaacuauuuauaggacucacugggagucuuuaaaauaauacugcauaaagauaauuagggcaauuuucuaucauuaaaguagauuaguauuaauuuuagugucuuugcuuuugaaccaacuucuuaguguguacucagauuuuacaaaaauaccuuguuuaaggacaaucaaagaggacaggaagaaaauaaaaacauuuuauaaucugcuucucugcugacaggagaaaacauuuugaauguauguguuaguguguuuauaagaggucugaggaaggagagggacaagggagguacguaggugagacagaaaaggaagaaggaagaaagaauuuagcugaaacaaauucucauuuauucaauguguauuacacagcuaaacuauaauguucaugaucucuaaucucuaccacaguacacaaaugugguacuguuaucccuacuucguauauaagcacacaaagucucuaauuacuugucuaaggucaaacagccauggugaauacaaaacucaaauccaagugucguauuucuaucuuuguuuauuccaccacgcaguauguaaaauuacaaaacaaacaaauaaaaaauguaauggccucaugguuguguccugguuuuuuaacaccagaggaaaaugaaauuauagaaagaaaauaaaaaaggauuaaauagaaaauccagauaauaauuuucagagauacagaaaauuuggguuaaaaaacacaauacuuauaauagauaauccucaaagcuaagcuaugugcccggcacugugcugacaucuugacacacauucucucauuuaacucucacaauaaagaauaguaaacuucuuauuccucuguuauauuugaaaagacagagggucacagaaguuugagcuccauuuaaauaucuauuugaguaucaaauuuuacucugagagauacaguugccuuuuaaauaaugaaauuucuuaugggacuuugacuuuucguuuuuuacuaugccucagagacaaguucaagggacuuugacauuucuggguuuggauuuuacuaugugaauuucaugaagcagaggcucaauaauguuuauuacauuaguccauuugaaaccccaaauggccgugauucucaccagccagucacucauuauucaccugucuccaaacccuaauauuuuagaaacauuauuggccacaaggagaaaguuguaucuggguugaaaaaaauguauauguauuuuaggaaugguagguacuguuuucuguggauaaacccauaagccacaaaacaacugcaaucgaauuauguaauuaccuaaguaauuaguaccaugcccauucucacugugcucggugaguggcugagacgaaucugcacuugaaaauguuucucaccggccccuccagugcagguccaagcacucuggcuucucaguugcagccguaccaaggccuugccagggaaaugaugaacagccugccugcugggguuuuaugacuuucuagccuuagaacaguccuuuauauccgaguagagcuucagauuuagcauccagcuuugccaaagccacaucaaggagacucgcuuaaccugagugguuuuccaucucugucuccuacauccccgagaaagggcucucagggcuuucuugaaaggagcacuugaugagucccuguguucagcagccagagucgcccuaagguggaacacgaucaaaacuguuuggauuguauuugcuuuauuaucugaccauuucugaugcucacacgaaccuucuagccuucauucaguaggucuauaaagggcuugggaaggaauuuuccugcaggauuuccuggugaggcugggaagacacauggaugagcucucaggaaguuuggacccaaugaugucauuaaaauccaucuugugccuucuugauugacucauuugaaccaguggauaggcuuuuuuuuuuuuuuuuuuagcugccuaugauuauguuuuuuuuuucuuauaaaguuuguuaaacuggugauuguauauuugcaucaaagaauuuaggaaaugacaacagggaauggaaaguuggaaccauuugaaugaacauagaggauaacagcucauuuaacaaaaucucggucuucccauguugucauucucaugaccccagcuaaagaaccaucuuauugugaaaugacuucccagaagaauaaccuaugugggcaucuaccuuccagcaagcuaauauaaauacauaucugacguaucuguuauacaauaugacaaguaaagagauaugucagaugaauaaaaaaaaagaacagaaacaacuuaaguuugcucagaacccucuuaaucaugaaauuccaagauuaucagaaaguccuauaaauacauuuuuaaugauuuuuuuuaaaaaaaugguaauggggugagcauauuagugcuauaaguugcccuaaauuuucugagagaagaugcuuugcuauuacacucccaagcaaugucugcguauccuuaaucccuuuagauucccagguuuauuucauauagucuaggacauugacauuuaucauugcugcuugaauaagaaugacuuauuuaauaagcaaacacagaggcagcccuuacuuucaccacuugaggacuuugaaaagauauucuugggacaccgguuauccugaaauucugguuaacauuucagcucuauguaggaaauauuggacuugaagucagaagacuaggguucuagucucagauacucauugaccauuugacaaccucauugggcacccgguuuuucaagaaaagguaguaccucaacauucccuaaaacaucagucucuaaaugcuaguuucguggaacaauaaggaguucuauaaccauaugaauuaagucaaccaggguuaaaaagagccacagaagccccuuuucuggaagacuuaaaugugacuaaugugauaugugagucucuaaaagagaguuauaaugugcagauuuccugaauucucagacaauggaaacuguggagaaguaucucacuggacuagcauuacaagcaagggacauauuuuggaaccugccagacaagcugauuucuaaaagccuuuacugcuuuaaauucucucaucauuucugguucgcacacaaaaaaccaagcuauucuccagauacuuucuacacaccuagcucucaacauuccucucuaaaauauaugacucuguuuacuaguguaaggaucaaaaggaucacauguggcuuccaugaaaagaaagguaucuuaaaauuguugugcauaaaauauacaauucaaaggaauuacauagaguuauaaauaauaguuaucaucacuaaccacucuaaacuaggaccaucgcaaaugaaaccauucuuuuagaaaauaaaaagaucaaugguccauaaggcgaugcaaugauaaaccaccaaaaaguccugagauucuuucuaugcuagccacguaugaagaacuccaagccaaacgcuauuccuucgguuguauuuuuccuugaaucuaaaggacaaaaauagggccucacaguuugagagaaucauucacuuugucuagcaaucaaaugcuugugaaagauaguaaaaaacgaaggaaaugaauggaaaaucacaaugcuuucuugagcuaacuuuugcaguuuuaaagaaauuacagagcaggaguaaaccauccuaugaaauuucaaaugaugacagacauuuagaagccuguguuauuaaaggcuuucuuuuauucuguuaaaucuucaaucagauuuggucacaaauaauugggauaauugaacuuauugccaaaauacucauggaauuagaaaacucccuuaaccaaggaagacucauauagaagaucccacuuggauucccauaagaggaagaaauagucucagccauauagcuuuuuccccacuuucuggcacagacugauacuuuuauuucaugcucucuccauuguguucaucucuauuuauauggauuuucuuucuaacccgcuggaguaccucaaacaaauuggugauauuauuacaacuuuaaauuuuucuggaagauuacuuaauagaggaaaagcagcacaguacaagcuagacagaaacguugaaauuaaacaugaucagagcugcaugucagccugggaaaugcguccgucucaaguuaagguuuacaguugcugcaauuuuaaucagauuuguauguaauaguauuucagaauuuuccacugagugcuucuucuuuucauuggaaaagaaaagcuucccaaacaaaggaaauuagggaacagaauaguggaguuggugugugguuauguggcgaggccacugcucugcccauuaccugcaaggcgucugccugcucccugacguggacucagcucugagugcucucauuuuucuuuucuuuucuuuuucuucuucuuuuuuuuuuuuugagacaguuuugcucuuguugcccagacuggagagcaauggcgugaucucggcucacugcaaccuccgccuccuguguucaagcgauucuccugccucagccuccugaguagcugggauuacaggcgcccgccaccgugcccagcuagcucucauuucucuugaaauauaauugucaugugaguuucuucaauccaaacaauuggaaacgauagccauugguagacacuuuguuuccuguccaagacaagaaacaauuagccucuaacaagcucuuugaccuagaacuuaaucuuuuaagaccaugauuucccuauauaaaaagugaggauuuggaacuaaauuauuauuauuauuauuauuauuuuagacagagucucgcucuugucucccaggcugcaggcuagagugcaguggcacgaucucggcucacugcaaccuccgccucccagguucaagugauucuccugccucagucucccgaauagcugggauuauaggugcacgccaccaugcccagcuaauuuuuguauuuuuaguagagacaggguuucaccauguucgccaggcuggucuugaacuccugaccucagaugauccaccugccucggccucccaaagugcugggauuacaggugugagccagagugcccggccuugaacuaaauuaucuuaauugucccuuccaucucuauaaaucuaugagucucuaacuugaugacaauuucccaaaguuaaccaaaguuaugcaauugguuuucacucuugcaaucauuucuaacuaaaagacuaaucaauauaaaaaguacaauuuaaagcaaucugccagauuuaaggaagaaauagaagugacauuuacugagggccaaucuuaugucaaguacuggaauaaccacuuuauauaagagauauauauagauagauagauagauagauagauagauagauagauagauagauauauggcaagaaccaccucagguaagaaucaucaucaucaucaccaucaccauuucauagagaagaaauacuuagagaaguuaagucucuaucuaaauauaguuaauuaguaaauagccaagauaggagucaaacccaguuuauuucccaaagucaugcacagaaccugggcacuuuacuggcuauagcauucugcuuugaaguguacacuguuuugcuucacacucuucauacucuucaagucauuuaaguuuucugagcuuuauuuauauucauuauucauucaacccguaacaagcaaguccucauguacagcagguacuguaauugauauugcgauacagaggggacuaugauacagaaacuacccacaaagaacucagcauuuuguagaggaguuggacaggaaaaggaacacaauguagucagcauuaugagauguaugagacagguaugccugaggugugaagaagggggaucugggaguagagacugggaaaaugaaaaucacuuccuaugagaauaaugaaaaguggaggaauaucugaauuggcccuuaaagaacuaauagaaaugagcuagcugugaaaagguugggaaaaggaaaggcauucuagccaaagagaacagaucaguuuagcggucugugagggcauugcauguucugagaauugaaaguaggucucuguagcuaaagcacacaaggcaugauaaauacuuggagcugaaucuggaaaacucuacaguugagaagcccuugguaucucaugcuaauguuauagaacucuauccugaagaaacgagggaguccuuugagaauuuuaagcauaauauauuuauguaauaagaaagucccaucagaagcacugaggaggcacaacugggacaaggggaguagguggcucuguguagaaguaggacaaagugauuggcaucuagcaguacacacagccucccacaaagucaaagaaagaaucaacaauugggauagaggagcaguuggaucugagagauauuuggaggaugggugggcaagacagaaaggauuuuggugguugaacagauauugagauaccauuggcugugccuccaggguuucugauuuggcugauagaauggauggugacugcuuccauuauugggaaacuagucuacagaaagaggggacgauugugacgagagccucaauuccaucaggagcaugucauuuuugaguugccugugacguuuaguucacauggaaaaauguuacuacuauuaaauauguaagguaagaccuggugcuacuuuugguugauauguauuuguuggaaaggcagaguugcaaacagauaacuugaaucaaacguggaaaaugcaccaaaauaguuaugaaugggcuaguccugaaauugaaauuagcuuaaccuuaugguguugaauaaggaagcagggacaaaccugagaaagaucuugaagaaagugcagaugauggacaauucaggaagagaggugugaggcaucucagggaggaggacagcaugagcaaaaaaauagagcauacaaaaugugagaaaaacaaucaguuuucacugaaacauaaaagggaaggcagggacaaggucauggagaaaucuacauaugugcuacucaauagauuggauuuuaugucaauuaugaggaacccugaaaggguucugcucuaagagagacaucacaucugcaguuaagagagugcaaaaggccgggugcaguggcucacgccuguaaucccagcacuuugggaggcugaggcgggcagaucacgaggucaggagauugagaccauccuggcuaacacggugaaacccugucucuacuaaaaauacaaaaaaaaauuagcugggcaugguggcgggcgccuguagucccagcuacuccgggaggcugaggcaggagaaucacuugaacccaggaaguggagcuugcagugagcugagaucuugccacugcacuccagccugggcgacagagcgagacuccaucucaaaaaaaaaaaaaaaaaaaaaaugcaauacuauggaagaugaacugaaaugaggaaaagcuaaaaugcaggagacuaguuaggaggcuacugcaaucacccugguaggaaaaagugagggccugaacaaggcauugguguaugggcgggaagaagggacagaaacauguugaggaagcuagaaccuuuggguuucgaaaauuuggugacgccagauacuuagcuaccaacugagggaagaaacacagcaggacgagugggucuggagaggaagggagagaugaucugucuguuucuguauguugaucauugagguauaucugaguagagacaucuaguaguuauuauauaaaucugaacuccaagagaggacucuguguaagaugauagauuugagucuauaacauagagcuauuaguuaaauauaauuauaaagacaauaauaauaaaauuauaguugugagcacuuaguauaggcauugaguaauacuuuacauuacuguguauguuauauccauuauacccacgauaacaaucugaguugauaugaacacuucccuuuacagaggugauaacuaauacuuaaagagauuaugcaacuuauccauaguuguguuguuaguaaaagugaguggagagcugagcuuuguucagguucucaaaaccaguuuuguguuuguuuuuguuuuuuaacuacaacauuucuuugaguuuguaaagaagaaagauaguacaaaggagagauugugaaaaaaaauuuuaaaaagccaagaaugacauccuugguaaaccaauguuuaaaggacgaaugugagaaagaaauauuggccaggcacaguggcucaugccuguaauccccacauuuugggaggccgaggcagggggaucacuugaggucaggaguuugagaccaaccuggccaacuggugaaacccugucucuacuaaaaauacaagaauuagccaggugucacggugcaugccuguaaucccaguuacucaggaggcugaggcaggagaauugcuugaaccugggagguggagguugcagugagccgagauugugccauugcacuccagccuagaugauaaagggagacuccaucgcaaaaaaaaaaaaaagaaagaaaaaagagaaagaaauauuuauaccagauacccugaguaaaaagagagaaagacaagccuagucaagucucccaugaaaaccaacagaaagacgaucccaagaaguagggaaugagccagugucagcugagucaaguggaguaagauaaagacugaagugagcccucugaguuugggaacacguaggaccugacugcaagcagguuucacuggagcaggugucacagaagccaacuugcaaggagcugaagacugguaagacaagaggaacuggaaccacaguaccuucaauuucaagaaauuugauuaagaaaaaaagcccucaauuauggcaguuagaaggaaggcagcuccaauggagauaauguauuauucauucacuuacuuauuuggaugggauauauuuaaauauauuuuuaaagcuaaggacgaacacauagcugaaagugugagguuuaaaacauaugaguaagggaauauaacaaauccugaaguaaggucugauaauuaaaugggaagaaagggucaugcagccaagcacacagggggaugcagugaccuugaauuggccaaugguuaauuugucucuaacccuaaagaaaaugugcagggauggaaggguaaauugguaugaagagggauaagcaguugcuauucauaccugggcaauuugauuuucucaguccaagagggggauugguaauuguuccucggauggggaaacaugacaugugaaaaauaugggucaggaguuuaagacaaaauggcagcgggggcuguagaucuggaagccaucuguagaguuuaagacaaaauggcagcgggggcuguagaucuggaagccaucuguagaguuuaagacaaaauggcagcgggggcuguagaucuggaagccaucuguagaguuuaagacaaaauggcagugggggcuguagaucuggaagccaucgguagcuacgugcauggggauaaggucucugaugcauaaugugagauuuaaaagaggcaaauguuggaucuugaagaaaacugcuauuugggcugaacagaagauaacaaaccuucaaagaagacagggagguuuggaaggaggaguaccacagaauccaagcaaagcaagaauacuaagcaacuaaauucugaccaaagugagaugcugacauacuaaagaagauaaacuggaaugaccaauuaauuccuaagacuuagauacauuagugaaagcacuuuuaguugugcuguaguaagauaaauuaaauacagauuuuuuuccccagaagccagaauagaccuguagccuccuugccucccuuccuuuaccuuuaaaaauuuuaaacuugaaauggaagcuauuugaauauauuuaaacacugugagcaaacaaauaacuaaauaaacaaaagcaaaauauaggggaaauguaaaaguagaggaaggaaagaaaaugcuggacaaaauuaguuaucuuucuuugagauagaaaauaaagagaaaaauauaguuaguuguggagggagaugaguuuuaaggagcaaggaauuccugccugguagccucucuguucucugaaguugucuacccagagaacacagagauggacacuuaagaaguguaguagaugcaaaaaacagcacugacaaaaaaagagggggaaaggaguugaugccuaaagaaacaacaaaaggaguucaggccgggcacgguggcuguaaucccagcacuuugggaggccgagguggguggaucaccugaggucaagagaucaagaccauccuggccaacauggugaaaccccaugucuacuaaaaauacaaaaguuagccgagcaugguggcgcgugccuguaaucccagcuacucgggaggcugaggcaggagaaucacuugaauccaggaggcggagguugcagugagccgagauggcgccacugcacuccagccuggcaauauggcaaggcucugucucaaaaacaaacaaacaaacaaacaaaaacacugaguaagcccugcaaaaagugaagguauauuacucuuuuauacaaauauaauauauuaaucauacauaccaugcaaaauauccauuauuuaaacaauaacuuucauaauguccuguagaaccuugcuucagaucuugaacccugaaaaugauuggcagaaugccaugcccauuuaaaaaacccgaguuuugcuuuauuaaaacuaaagaaacacugaagcucguuaaauuucauguuugaaacaauagaauucaaaguaaugacagucaauaaauagaggaacaagucaaaguaggauugucuagaaagcaaaauuucuugaccacgcugaucuuaaauuuaguuacucuuauuaucuauaagcuaaccuaaaacguucaggaguucagguuagaugcaccccucaaaugcuaugacugguggcuuugucuugacucacacuuuuuacccuuuuuaaacuuucuucuuagcuccuucgugauugauugcuucucuaacaaugccaacccuuucaguaaccugggaaaagguuuaaaacaccauggaaucauccagugauuucaccugccugcauuuguauuaaagacauguaaagacuuucuagaggccaggugcgauggcucacgccuguaaucccagcacuuuggcaaguggaggugggugaaucacuugagcucaggaguuugagaccagccugggcaacauagugagaccuuugucucuccaaaaaaaaauaauaauaauaauacaaaaauuaaccaggcaugguggugugugccuauagucccagcgacuugggagacugaggugggaggaucacuugaguucaggaggcggagguugcagugagccaagaucgugccacucacuacccuccagccugggcgacauagccagauacugucaaaaacaaacaaacaaacaacaaaaaacuuuuuagaaccauguuugguaaacuguauguacucgacuaauaccaauuauuuacaaaauauuaaauugagugaaauacuacgugugggugucucucccaaaaugaaucagaaacuuggcacauuggcuacaaaugcuuugaaaugucucucaaaugaacaauuucuagauauugcauuuuagaaaugaaauaacagcaucagauaauuggcagccaagucauuuucccaaguacugaugccaaguacauggcagacauccaccauggguugauguagaucaaaaagggcugagacaccaucucaugcuuauagaauuucagaauuagagacauuaggaaggggaaagucagcaucauuugccauguuaaagccaagccuugugcacugagcaacuuuuccucacuagccaggcccccaucauuccauucuuacuuaccaucccuuauggauuucuuauaaaagcccuacacaugccaaauuggucaaaacccugccucgcugcaguuauaauggcuggcuuguggucuuccugguggugacaagucucuuugcuaugaugugcccaaccagccaggauuuuauccccuacucaggauccacuccaugagcuugcaugagugacccaucuaaaauuaaacaaaagaggaaaauguguaccuacuacuuugagaugagaggggagccacacaucucuuucccuuccuggacagccccuucccagagcccuaauuuuucuucuguuauuagauuuuacuauacccucugaucauucagaacaucaggcuucuuaacaaaagagauuucugaguugaaauacaguuuuuaaaaugcauaagcauuucugggacuuugaaagccucgaaauaacguauccaggcucucuggaacucauaauccauauacacaugaagaaaugacuuggagcuaauaguagguagaaggaggaaaagggcaauugacuccucauguucaacucuggguaacacggaugaaguggagauuuuaaacugcaauguuauuguaaauuuuccaguaaucuacaucucugaauugcaaauacuggaaaccaauucugccuuccugcuucacacugacagcaacacuuugcuugcccacaucugagaccuuguggcuuuugauucauucuguuguugaugccuccucuuuuguuuucucaaaauguaaauauuuguucugucugcauucuaauugcuagucuuggugucuuauugaguaugagggcugcgguaacucagaugccucaggaucccuugcuaugugcugagauuuucugucuuaugacauuagcuuggcauagcugacagccacucuguuccuauaccccugacuaaauugcaguuaugucuuuaauugaaaccuaguauuauuuuauuccucucugcagagaggaaacccagaacuaucauucuguacacacaccaaaccacaggagccugagugaggguccguaaugacagagccuccuacacagcacauuugcuagcuuucuacuaauugcccuaauuuucuuugucuagacuaacuuauugcauugaagagcuccuucuccaaaagggggcauaaaggaacaucgugaguccuucaauugcugccaagugaagaagggagaaaaacauggcuaggaccaagaaaacaaacaaaacaggaucaggggauuuguccuugaaugggcuguuuccuagagcacauauugauuuaaaacugaacugagagauuguguucuaguaagacuggaaucacuaccauuaacagcaaagaacacaaacagcauguaagucaaaagaagaaugguacuucuuuuuuuuuuuuuugagauggagucucacucugucgccaguuuggagugcaguggcacgauguagacuuacagcaaccucugccuccuggguucaagagauucuccugccucagccuccugaguagcugggacuacaggcaugcaucaccacgcccagcuaauuuuuguauuuuuaguagagacaggguuucaccauguugaccaggguggucuugaucuacugaccucgugaucugccugccucggccucccaaagugcugggauuacaggugugagccaccacgccaggccgcauaauacuucuuaaaagaagacaguuacuaaggagagagauggcacucaucaaucaguuugucgccuuccagcauucuggaccagaagucuccuguguuuguucugcuuuuguggcaccuuccuaguuuggcuuuccagauugaaagaaucuggaauacccuguggaauacccugccuucucuuuggcucacaccaauggugaauacaaagagaaauuuaauaucuuggccauaaacccuuuugaaacuucccugggauaaaagggugggauccguaugaauaacugcagguugccuuuucaccguucuuaaaagucugagucgaaaugaagguugaugcuuccagauugcauggccucagaacuagggagaggagccccacaggguccauggauugacccaguggauugaaagaccacugggcaaggcugguccauccugggcuggagcugcccuucaguucaacaugccaaagccuugggaacaaugggacuggccaggggcccuagaaaaagggccaagaguccuuugcuugcaggacauucucuuuagccaaauucuccagugccugcugacuaacucacuucccacuucucuucuguuaacuacguuacauuuucuccuguacuugccauguucaaagacugauugauuuccuagaaugugaugauggguuucauuuuacugcugucuuuugugucaauuauguuucccuugauggaucaacuuuucuguuugguugcguuaacucucagugggccaaaaauuucauggguuuuauuucccuuggauuuuuuuuuucauguuuacacauugcacaugguaagaauuuuuuuuuugaaguaaguauacugaugaauucucaaacugguuauaaauugaagaacugaugcaauguauucuuuccagcaagacaagcaaguggcuuggauuucuguuucuaaaucugagggaaccacucaggcaaaagucauaaagggccaguuugugucacugguccuaggcugagugcagagaauccagaauggcagugcacaguuggcugcgagcaaugccaucacugucuuuaucacuccuaucuccacgucucuacucuguacuccauuucugggagaggaaaugauauauugaugacauuaaugguuuuaaacugguugugauuuugccccucaggggacauuugucaauguguggaggcauuuuuggucaucaccacuaugacggcugcuacugaaaucuagaaggucgaggccaaggaggaugccgaacauccugcaaugcacaagacaguccuccacgacaaaacaccauccugucccuugucaacagcaucaauauugagaaaccauagauuagaugugcuaccugaucacaucucuccagaccuguggaauucagagguaucucuaacaaauccacaguaauugauucagcauuuuaauuucuaaggagcugagccgggcacgguggcucacggcucacgucuaaucccaguacuuugggaggccgaggugggcagaucacuugcggccaggaguucgagaccagccuggccaacauggcgaaacccccaucucuacuaaaaaaaaaaaaaaaaaaaaaauuagcugggugugguggugcgcaccuguagucccagcuacucgggaggcugaggcaggagaaucgcuugaacccaggaggcggagguugcagugagccaagauugugccccugcacuccagccuagugacagagcgagacuccaucucaaaaauaaauaaauaaauaaauaaauaaaaauuucuaaagagcugauauauuuuucucagaaggcuugaucacacuuuggauuuuuuuuucacucaguuuugacagaauuugaauuaucugaugguuuggcauaagaagauuaugaaucaagcuuaucugcaauaaaacuuugcuaugcuucugauuugagacaaagauacuguaauguuuugugcuuggcagguuuuuaucuugcaagauauauuaaagccuccuaguacacugaagauucuuggaaaauuauugauccucucugagaaagaaagagcucucuccacucuuagaaguucuguaagaucccaccaaaaaauaucaccuucuuugugaagccucuuacuuuccuuccgacccauugucaagaucccacuaaaauaucaauuccucugggaagccucccaaaauguccuaggcugcucuccuucugagguuucaaaagcauuuccucgaucacucugucaugauuauuugacuauuauuuuacaucccccaucagauuguggaucaccuaaggcuagggccaggcuugcuucacugaagacugcucuacggccuaggacaguaaucagagaaaaugcacuguaaaauguguuagguaaucuauuagucugucgucaugcugcuaauaaaaagacauaccugaaacuguguaauuuauaaagaaaagagguuuaauuuacucacaguuccacauggcuggggaggccucacaaucaaggcagaagacaaaugaggagcaaaaucacgucuuacauggugguaagcaggagaguuuguucaggggaacucccauauauaaaaccaucagaucuggugagacuuauucacuaccaugauaacaguaggggggaaaccgcccuugugauucaauuauuuccaccuggccuugcccaugaaacauggggauuauuacaauucaaggugagauuugggaggggacacagccaaaccauaccagguaaggagucuaacaauucccacaaaaaauucuauuuaguuuuaggaacaaagcauaccuuuuaaaaaaauugauguaaacacaaaauauaucaucaagggcaacuuacuauauuaaaccuaccuugacauugaucuuuuauagaaauuacuaaguaauuauauuucaaaagggauugauauacaggccuaacgcuauuuuugacacuugauaucuuaagagaaaugcccuauauaaugugagacuauuauaauuuuaaaaguauauuauuuguuuuucaaugggaacaagcacagaacuaaagggugacccuccauaccuguggguuccacauucauggguucaaccaaccucagaucaaaaauauuaaggaaaauuccacaguuauaaaaaucaaaacuugaauuugcugugccucaaguacuaccuugaauccacacgaaugaagugauguauagacacuguacuagcuauuauaaguaaucuagagaugguuuaaaguagaagaaagacugugcauagauuauaugcaagcacuaggccuuuuuuuuuuuuuuuugagacagucucgcucugucgcccaggcuggagugcaguggcgcaaucucggcucacuguaaguuccgccuccuggguucacgccuuucuccugccucagccuccuuaguagcugggacuacaggcaccugccaccacgccuggcuaauuuuuuguauuuuuaauagacgcgggguuucaccauguuagccaggauggucucgaucuccugaccucaugaucugcccgccuuggccucccaaagugcugggauuacaggcgugagccaccgcgccuggccaguacuaggccauuuuauaugagagacuugagaaucuacugauuuugguaucauugagagaugagguccuggaaccaaccccaauggauacaaaggaacagguguauucaaaaugcuccaacugugucuucaaaaacucuuuauaucaaucaaggcuaugugauuccuauuuauaagaaaaacgauuucauuccucuguuuuuagcccuuuucaaagccguccacaccucuucacacaucucuuucacuucauuucuuuugugaucuuuggaguuucaaaauauguguuuuuaguaucuugacugcuacuacucuguucccuuucucuaucuacaaagccaauguuguuuuauguauaaucuacauauguguuucaaagaacucaacuaucaggccucucuggaucuucucauuccucuagucugugaaaaguuauauaguucucaaaguucaaaacuaaaguuuccuacaccaauucauuucacaaagagaaaaaauaagaucaaauguuauugugauauugugaaauacauauuugguccuccaccuaguuuccugaggcacagcuccuaaaaucuuugggcuccucaaaaugauaaggaucuuuuugucugcugauguugucugauggcuggaggcucccagauagcuucaggaugguggcuggucaauggaaagaccacagcaggauuagaggguugggacuuucagccccauccuccaaccacugggaaagggagagaggcugaagguuaaguugcucuccaauaaccagcgacuuaaucaaucaugcuucuguaauuaagccuccgcaaaaccccccaaaagggguucugagggcuuucggauaguuggacauguggaguuuccuggagauuggugcccagggagggcauggaagcuccacgccucuucgugcgugccuuguccuauacgucucuucauuuauguccuuuagaauaaaccaguuaaacguaaguaaaguguuucccugaguucggugugcugcucuagcaaaauuaguugacuaauuguaacuaaaauuguacaaauuguacaaauuguacaaaauuguaacuaaagggucaggagcacaggagcacagguaagacaacauaggacuuaaugcuuggcaucagaaaugggguaucgucuugugggauucugagcccuccccucacccuaugggaucugaugcuaucuccagggagacagcgucagaacugaauugaguuaaaggacacccaguuggugcucacugcagaacugauugcuugcuugguauguggggaaaagccccacacgucuggcgucagaguauaacauugagcaacugagugacagucgaagaggaagagcauauuucaguuguuuuuuuccuuugucuucggauucuauaucccuuuggugcauccggagcaccccugcuuugcauaaaaugaaacaaaaaaccuaaguuguuuaauuaaccaaguaaugcagauuaguuauuauuuuaaggaugaauaaauaauguuuaauacagaauggauuaauuaacaacgguuaauuuucuugccaauuucuccacagacucuuccaauuucucuaagcagaauuuguugcuggccaggcacgguggcgcaugccuguaaucccagcacuuugggaagcugaggcgggcggaucacuugagcuuagaaguucaagagcagccuggccaacauggugaaaccccaucucuacuaaaagacacaacaaaaauuagccaggcaugguggcacaugccuauaaucccagauccuuggaaggcugaggcaggagaaucucuuaaaccugggaggcagagguugcagugagccaagaucgcgcuacugcacuccagccugguugacagaguaagggagacucagucuaaaaaaaaaaaaaacaaagaaagaaaauuuuguugcuuauucauuugcauuaaccacuuuguguaugucuuacaacuccacucacacccagugcuacacucacacccagcacuagaggaugggaacaugggcaugucacuacaaggucaucacuccucaagggcaagacuuuaucauauuaucucugccuccgccauguuccuacauagaguuuugcacauaacaagcaaucuauacguaguuguuagauugaacuaaauucuguagagguauggacuacagagaagauugcaaaugauacuaauuguaucuguauuuuaaagauguacaucaguuucagaguuuuaaaaauauacugcaauguguuaacacuguccaugguaucuuuugggaaugagagagaaaaugaaauuuuuaucucauugaaagaguugucaaaacagccaaguguauuaaacuuuacuaaaugcuagcaucuuacaugucaguaacacgaagagguaacucguucuucaagggcuuaucacuuaguaaaaaaaaaagaauguuugcuuacauguauaaaaauacauagcaacaugggauaucacaugcaaauucccaauggaagagaauagacgauuagugcugcaggaauucagacaagagagaagacacugaagaccgagaacauuguagguggccuaauaagggauguggugccuggccuggccuuaacaggaagggagggauuuacaguaaaggcuaugcuagauggagaaggguauucuuggcaagaagggugaaggaaugcuuuggaaucuugaaugcacauagcccaguuacaaaagaaggaguagaugggagaagagucuuuugauguaaaaauaugaauggaggccaggcacggugccucaugccuguaaucccagggcuuugggaggccgaggugggcggaucacgagggcaggagaucaagaccauccuggcuaacacugcgaaacccugucucuacuaaaaauacaaaaaauuagccaggcgugguggcgggcgccuguagucccagcuacucaagaggcugaggcaggagaaucgcuugaacccgggagguggagguugcagugagccgaaaucacaccgcugcacuccagccugggcgacagagugagacuccaucucaaaaaaaaaaaaaaaauauauauauauauauauauagauagauagauagauagauagacagauagauaugaauggaaguucuaaagauggaugugaagagggaguagagguggagaagaggagauucaaacuuuuaagaaucuccaaugccagacaaagaaaccuggauuugaucuuguaaaugaaaagcuucuuagcacagcacugaugugcaugaagaggugucuuaagaauauuaauaugguaguuuagggggaaaucugggaacagaaauacccuugggagaaaacuaaaucucuccacuuaauauauguguuaaaaaccacccagaagaggaagucaggcacaagcagagaaaaugcugacuagccagcuauugaauaaguaaguaaaugcaugagagaauacuaaauauguuaucugaugggagaagaaagagaaaggaagguaggagugauaaaucaguguaaagaaagacgcggcugggcaugguggcucacaccuguaaucccaacgguuugggaggccaagguggguggaucaucugagcucaggaguucgagaccaaccuggucaacauggugaaaccccaucucaacuaaaaauuuaaaaaaaaaaaaaaaaaauuagccaggcguggugguaugugccuguaaucccagcuacucgggaggcugaggcaggagaaucacuugaacucaggaagcggagauugcagugagccaagauugugccacugcacuccagccugggcuauagagugagacucugucucagaaaaauaauauaauaauaauuaaauaaauaaauaaaaggcaaagaaauaggaucuuggcugcucaaucuuacaagacucuaaaauuuucuucuuaaacaacuccccaugucuuuuccaauucuucagauuucuuagucaaccauauuccuuagaacuuuugcacauaguccucuuaucauacuuaaguauauauuguauuacauuugugcagaaagacuuuguucaaaaucuuuagguuuggguugauggaacaaugauguuuucaauuauaucuauaaaguauaaacugguuuuggcuaaaaauauaugaguccaguuuaagauguugacagucugaaguaaccacaggacuuuuaguaagagguaucuaauugcagauaaagauaaagagugaguucgagacuaaagauuugggaaagguguucuuuagagccaugaaaagagaugaaauuccugagggagaaauaaaagggaagugagggaggcugugaauaaugaaugcucagguugaaggaaagaaugaaggagaaaaaaggaaaacgaacaaccuugguuagaaagaaaacuugacgguaaaaagagaacuagguccauguagaagccuagaaacuaaauaaagaaacggauuuuaggagaagcuacugaguaauccagaagaauaaugacugaacaaaagaucucuggguuugacauuuaagaggucauugguaaccacugaaaacagauccagucaaggaagcacccaaagucagaucagacuguuaagaaguaaagcaaggcuaggcucgguggaucaugccuguaauccagcacuuugggaggccaaggcggguggaucaccugaggucgggaguucaaaaccagcccggccaacauggagaaaccccaucucuacuaaaaauacaaaaauuagccaggugugguggcacaugccucuaaucccagcuauucgagaggccgaggcaggagaauugcuugaaccugggaggcggagguugcggugagccaagaucacaccauuacacucuagccugggcaacaagagagaaacuccaucucaaaaaaaaaaaaaagaaaagaaagaaagcaaaaagugugcagauagagaacaggaguaggguaaaaauaauacaucaacuaauugguuaaccuaaaaagagauaaaucccagcagagcuaaggaaagggacuuuuuguuuuuagauagaagguuugagcagauuuacaagguaaaacccaauacagaaucaaauauuaaagacacaacaaaaaaaccggugcaucugaaaguguagaauuuaaaagaaggugggguuccacagaacugagacaucuggaaaggccuuggucuuggagaagaggagcuacagcuucuucucugagauaacacugaagaaugagagaucccugaagcuacggugaugugcuuggagacagugagaaagauguggcucugugucacacagaguuggcaaggcagaaaggggaagguacagaucuccauguaugaaaagcaguguggccaucaggaguggaaucaccuagaacagacucuguaggcaagauaaggaaugauuaagggaugaauuagagccaugagguggggcauagacuguucagccgguuccggcaccugcuucuaccauggaugaggcaaauaggaguagaaaggauggaggaagaagucaaaagcuucuauuauuuauucgagggaaugccaugucaggggcaccgauuguuuuuauuuauuuuauuuuuuuuaagacggaguuucgcucuuguugcccagacuggagugcaauggcgggaucucugcucaccacaaucucccgccucccggguucaagcgauuccccugccauagccucccaaguagcugggauuacaagcaugggccaccaugcccggccaauuuuguauuuuuaguggagacggaguuucuccauguugguaaggcuggucucaaacuccccaccucaggugauccacccgccucggccucccaaagugcugggauuacaggugugagccaccgcgcccagccaggggcacugauuacuaggggaacuagccauuugccgaaacccccaauuaacucaggcggauuuacagauuaaugauuuguuaaaacaaacaaacaaacaaacaaacaaacuccuggcacaauguccugcuuuucuccaacaaugcucagaagacucagugaaugugagugugacccaggauggaggauagcauaacaaaagguaaaaugaucagauucugugccgggguacuuggggaguaguggggaaacugaauaggacacaauguagcaucaguuguuuugcauuaaaaaugacagguggaaauagaacucuacuaaguaucuucaguagucaauuuagacucugauuuuuugcuuuauaaugacauuuccuuuucuauauucacauuggcuacugagcuguugagacagucugaaaagauguaaauauuuuuguuacaaguugacuaauucaaaaugucuuucauugaauauugcuauuacgaaugaucaaaagcaaauauugugcugacauauccaaucaaauggacauugucaaacauccucagccuacauccuuuaaaauacacccuucguuauuuagacagauugcaauuacuguagcaaaaucaugaagaccaguuaggauggaaacuuggaauuaaaaggaauaauuuugaaaaaagaaucuuuuauggccuaaaagaacucauuuaaaguuuucuauccugggcuaaauaucucuggauguucuuaaauuugauuuauacuguuuuauucugaaauugagcugguuucucaucuuccccaugcuuucuguggagcugauccaagcacagagucuacuugaguacugaaauagccucugcacuuggaucuucuccaugaggguucaaaguaagaugaaacacugguucuugggaauggaaugacuguggaucucaaagcccugacaucugaaaacaaaaauugauuugcauggaaacugaguucagugaaaacuacgcauuuucaguauaauagguuuaccuuguguuuuuuuuuguuuuguuuuuauuuuuuugagauggagucuugcucugucacccaggcugaugugcaauggcgcaaucucggcccacugcaacuuucgccuccuggguucaagcaguucuccugccucagccuccugaguagcugggacuacaggcacaugccaccacacugggcuaauuuuuguauuuguaguagagacgggguuucacauguuggccaggcuggucucuaacuccugaccuuggccucccaaagugccgagacuucaggcaugagccaccaugccuggucuaguuuacuuuuuuuuuuuuuaguuuaccuauuuucuaaaugaacuauugaaugagguacacuuaaaauguaagcacaaauaagaaugaaaaaccucacagaaauaagaucuucuguuuauuuucuuucuuuuugccuucuuaaaugcugaggcuggcuuucagugaggauauugaggacaaaaauguguugaauuaauggagaagggaggaggaaccucagaaagucauaguuucuucaagaaagaagggauccuagagauuaugccaaccuuccuuacaaauuuuauagaaagggaguguaaauucugcaaauaagaggguguaucuaagauuacaccuaauuuuagugaauagcccaggacuaugaagccaacauucuccauugaaccacagugucucucauaaauuucucuuacucuacauacuucauauacuggaugaccuuccauagagaacacagauuuuucuuguagcaguaauauuacgauccuuggguauaagugauggugagaugauaccaaauucaguccucugccuucaguaaucagcuaaaucaaagacacucaacuaaaggaauuucuuauuguuuucuuugaaagucauauccaguuuuuagggagcuuucauuuucuaaaaaacacauuucccuauauagaaagacaguuuuggcugggcacggaggcuugugccuguaaucccagugcuuugggaggcugaggugggggggucgcuuaaggccaggaguuugagaccagccuggacaacauagagugauguggucuguacaaaaaaauuaaaaaguaaacaaguaaaaauuagccagccauggugguauaugcuacaguccuagcugcuugggaagcugagaugggaggaccgccugagcccaagaguuugagauuacagcgagcugugaucgggccacugcacuccagcagagcaagacccuaucucuaaaaucguuuuaaauugaaaggcaguuuuugcuggagcaagaaaagcuuuagggcaggugucaggagaucuggucuugcagaccugcugucuagaggcgaaugcaagacucagccuuucugaaccucagauucauuagguauaaaugcagaaugauaauguccuucuaaccgauuuuggugcggggaugcaucuuagaagaugcuguacuugaaaguuuuugaaacaugcuguaaggugauaaaacauuaaaacauucuuucuaauuauuaagcucuucuucucuuguguaguguuccauaaauauuaagaguaguugaucacaucuuaaauaucugaaggcucuuaaucucauuuuaagccuuucauccccuuucuuuuacauuacuugccugaaguaccaggaaaauaucuuuuuaagaaaggaauucagugguauuucuggcagaaacucuguauuggaaauuguauauggcaaacugaucucagcaugcuuugaucagggacaucagaauucuaucagaaaucacgaagacuuugaaagaaaacccagaauuaaaagugagacagcuggucuuuucagacaucgggugaagcuaugcaaagucaacggguuuuaucgagagcguuagcaugagcagaagaaagguauuuccagccuuaucauucuauugcuuacaaggggaagcuagucugaguguggaaagcuaagcuauucucugauucucuugcauuugagcuauguucaguuuucaagaucauagggcaaauaauacaugcaauuuuuauugccauuuccucacucccuaagagucaaguuauacaaauuucuuuugauauccucacucauggucccuacauacucaucaauugucagaugcguaaaaaucucaacucagcaugaaauauggauguugacacaauaugacaggucuccacauuuaauuaggcacaaaaucccauuaacaaucauagagaagcucacacacuuuaaacaguuaacacuucauguuuaaugcagugugaggucuuaagcuugccauggcuuauuuauauaacgaacacuucugagaccaauugaaaugaaacauacauggagaaauauaaugaaauccugugcaugcauguauaaauaauccaaagcagaauucauauuccucaauggauaacaucugaacucuuaucuuuacagacuuugguuaucuuaauucuccucauaaaguuccauggaaaauacuccacacuucuuauggagaaugagaaucugauuuagaauacacagaccaagaauaaaaaagugaaggugaaaaguaaauccuagguauguaugaaugaaaucucuagucaagagugagcaaucagcugugagugguugaggggcuuguuggcauucugugaccucagcaaagccucuagcuucugggguugcuuggaucaucaacuccggacuuggaugcuaccugcauuaggguauugccuuccacucugcaucauucuguuuuccucuuuuauuauuuauuuauuaguaaagacgaggucucuaggccaguugugguggcucacaccuguaaucccagcacuuugggaggccgaggcaggcagaucaccugagcucaggaguuagagaccagccuggccaacauggugaagccccaucucuacuaaaaauacaaaaauuagccgggugugguagcgggagccgguaaucccagcuacucgggaggcugaggcacgagaauagcuugaaccugggagguagagguugcagugagcugagaccccgccacugcacuccagccugggugacaagaaagaaacuccgucucgaaaaaaaaaaaaaaagaugaggucucacuauguugcccaaauaguccuagaaauaauauguauauacauauuuuuugguggagccuacauuauuugguuguaauaacuguagcuuccaaacccaguugaauuuauccaaguaagcaauguuuuuucauaaguagguguugacaugaacaaacacauuuucacaggcagaguaccagcaauuauuaaaucguuauuuuaaaauugugauuuuuacauugucacaaaauaaacagaacugagauuaaauuucacaauuugcacaaugguuuucauguaugcuuaacaguuuuuaucucauuccaauaauuacaacauguuuuccuucuuuggaauuucaguuggcauuucuugugccuuuuccucuacuucuccccauuaguuaugcuaauguuaagauucuauuguaauuuaagaauugugggugggugcgguggcucacgccuguaauuccagcacuuugggagguugaggcgggaggaucaccugagcuuaggaguucgagaccagccuggccaacauggugaaacccugucucuauuaaaaauaccaaaaauuagcagggcauaguggcagaugccuguaaucccagcuacucaggaggcugagacaagagaaucacuugaacccgggaggcauggguugcagugagcugagaucguaccauuggacuccagccugggcaacaagagagaaacuccaucucaaaaaaaagaaagaaagaaagaaagaaagaaaaaagaauugugaccauauucugggaggccuuauuuuguaauauugaagaaugaaggguugggggcaguuuaaguccugcuuuuauuacugacuaauuaaaugaccuugaggaaguuauucugccuccuuggcuuugguuuugacaucuguaaugcuggauugcugugaggguugaauauaguuaauaugcauaaaacauuuagcacagggccuggcacaaagcauaaggccaaaaagcauuagcuacgauuauuggcaauguggaaaugaaugaguagauuugguuucuaaaauugguguaaauaauucaaauauuuguaaaaaaguaaaaauguuuaggacaaagucagagccaaaucagauacaaugaaaguauagcaguguucggugugcccucuugcugucucugaagaucaaaaugaaaauugugcauuaacuaguacugaguguucacacuggggaaugcugguaucgugcauauuuuggauguagaugauacaguuaagagaaauuuaucagagaucaagagauaagugaaaaauguaccuucaauaauuugagaguuuaaaaaauuuguacuggaaagauauuuaaaguauguuauccauuagccacucaccccagcuauccuuggagaauagcaugauugcaaacagaugcaaaaacugcagucaauucauaauucccacagaguaggcagauuuuaauugccaggauauuuuagucaccuuugauuuaauagccuuuggcucuuauuuucccuuuugaauuuauuuuucuaagguaugacaaaaauuagcuuuccaacaccucuuuacagguuuuaagaguuucuaguagagcauauccuaauaauguguacucaauaaauacugaaaauaaugagagauugauguuagccaucauuuauuaucaaacuccauuucucucuguuauuagauuccaauacccucaaguagcuuuauaaagaauauucacuuacgccgggcacaguggaacacaggacaccaguuaaaagggaggccaugugcuaagguaauugagcaaauguucgaagagugaaauccccagacuuccuccccagcucagcccccagaacucugcagcuaggcagaggaugagccuucuuugggaaaucuauuagcaccaucagggaauaaaaaggccuaaugauacuggcuuuggagccuuccaaauaaagagccaaauuagaucacucugcagugcauuccacaaucaggaagucuacuuauuagucuugcccuucaaguaaguuuuugagugcucuaauuuugaauacaacccacaaacuaccaggcaucaaucagcaaaacaucugaggaaauccucuaagauuagagacaaagccccaagcaagcuaaccaaaaggcaaaacaacuaaaagaaaagagaaauauugaggcagaaaaaaacuucaaaaucucauaagagauaagaaaggcauuauuccuacgagaaaaaagaagacgauacuaagaaagcauuauucagagaauaagaaacagcgcuuugaaauuaaaaaauaaaacagcaaggaauaaaaaaugacagaaauuggaagauaaacuugaagaaaucuccacaaacuaaaaacaaaaugacaaaaaugcaaaacaggagaaaaaugcuuuuuuuaaaaguaagggaccacugcgaaaggucgaauaucugauuaaaagaaucaugggaugucugggcgugguggcucaggcuguaauccuagcacuuugggaggccaagguggguggauugccugagcucagaaguucgagaccagccuggauaacauggugaaaccccgucucuacuaaaacacaaaaaauuagccggguguggcggugugccccuguagucacagcuacucaggaggcugagguaggagaauugcuugaccccaggaggcagagguugcagugagccaagaucacaccacugcacuccagccugggugacaguaagacucugucuccauaaaaaaaaaacauaaaauaaauauaaaaauuaagauaaaauaaaauacauaaaaaauaaauaaaacgaaucacgggaagagagaccugagaaaccagcagggaagaaaucauuaaacaaaauaauuaaggaaaauguuuaggcgcugaagaauucaccaauauccagacaguaaacugaaauacauucccaaagcacacuaauuuucaguaguguggucaaggagaagaacccaaaauucuccugaaaaagaaaacaaccaccaaaauaguuuuuguacaaagaaccaagaaugaaaacagcauugguccucucaacagccauccugaaagcagaagacuacagagcaaggacuuuaaauuucugaaguaaaaugauuuucaaauggaaauuaucuuccaaauaaugaaucuauuuuuuuguuuauucauuuacaaucuauuaauccauauauuuuuaggcauauacauuuugggaaguuuaaucuuccauguacccuuuuuggggaagcuacuagagugugucucaucaaacuaaggaaaaaaacaaaaaagagaaggacaaggggucagcaacagagggugaguccuggugaagagauccaagauggcuaccaccgagcugccuggagagcaaccacccagacagggugacuaccucagcaagaugaaaauaagagaacagcuaaugugauuacaauaucaccagcagauuaugcagguaaagaaaaguuugaggcugaaaaaaagguaaguagaaagaaaaugaaaauuacuaaucuagagaaaacaaaacaaaugagaaagaaaaauugcuaacugugcaacaugguuuuauugugaaucaugcauacauauauaauaauguaugcaguuaaauuuuaucuaauugaaauguugguuuggggagaaugaggaaaugaggaguguuuggacaaggagagggcugguuuagggaccaggaagugaaaggagcucaauucucaucuuccacguggggagugaguagauagcaugcuaacgauuggaaaauuaagacuucauaacauaaguguguuauggaaagagauagaggaagauaaccgaagaaucagcuggaaacuuugauaguaauugccuuugggggcugaaaauuugagggugguuuggcagcugagagagauccaauuucuuugucaaguucuguagaaaauuugccucaaaacuaugcgaaaacaauuuugaugaauuuuuuuuaaauauugaaaagaaaaaagccugcaaagcauauaugacauugaaauuaauuaauuaaauuaauggaaaaaugaaauuaaauaaauagaauggaaagggaaauacaugacauaaaaauggcagacggaggaagcuuagcaaguucugaguaauagcugcacccugauaauuagugagcuucacugauuucuauuaaucagaggguaaaaggagcaccugaaaugugggaaaagccuucccuggacgcccugugauugguuagaccagcaguucucaaacuuguuggugucagaauccauuuugcccuuaaaaaauugauaagaaccucagagaacuuuaguuucuguugguuauaucuaucauauugggaaugaaaacugaaaacaauuuuaaauauuuauuuauuuauuuuaaaauaaugauaauaaacucauuaccuguuuuaugaaaagaaacuauauuucccaaaacaacaaaaauauaaguaagaagaguaguauuuuuucuuuuaccuuuuggcagaucucuuacaucuggauuccccucgcugucucuguauuuaaccuguuguguuguuauuuugguugaaguauacaaagaaaauguggccucccacauacagauuaugauugucccuuucuacguaauuauuguggguauucuuuguuaguauaccaaaauuugacauaaaaaaguuuuuuaaggguuaguuaaaaugugacauuucaaacuauauuaaugaauuucucgaacucuguuacauugaaauucauuggucuacagugcacuuggaucuuuuacuuaagcaugauuuuauaaccucauacauuggcuuaaugaauugugcagauguacaguauguugacacaucuauuguacaauacauacuuuuuaaaaaucggucauuaguaucaccgccaaucucaucaaaaagucuuuuuuuuuuuuuuuuuuuuugagacagagucuugcucugucacccaguguggaggacaauggagaaaucuuggcucauugcaacauuugccuccuggguucaagaaauucuccugccucagccucccaaguaguugggauuacaagcacccgccaucagguccggcuaauuuuuguauuuuuaguagagaugggauuucgccauguugaccaggcuggucuugaacuccugaccuuaggugauccacccaucucggccucccaaaguccugggauuacaggccuaagccacugcgccuggccaaaaagucuuuaaguauuuacaagcugacaaauuacugguggcaaauaaauauuuccaaaauucuaguguuuuccuaaaaaguuaaauuuuuuuauuugcaaauacugucaguugcguuucucaaagugauagcuucauuuuguuaaauuuugagaacauuucucccaaaugcucauauuggacuaacuguagucuggcauuuuaauuaaaauguucugugaaacaugguguucaguggugccucgauauguucaacucaaacaauggcacaggcgccuuuaucuugaaacagucacgguguuuccgugugcagcagaagugcuuuaugcagugagucacaggaaguaucaaaaagacaucugagucccuggagcacgccuguggucccagcuacuuaagaggcugaagaggugggagcaucccuugaguccaagaguucaagaccagccuaggcaacacagugagacuucaccucauuuauuauuauuauuaaaaagagacaucuacucaaagguuaaaauuuaauaugguuaagaauuuuuaccgcuguauggagaacguucuuaagugaaauuggcaauuuuuguuucugccauugccugacaaaagaauaugacaaccagugcaguugggugauacugccgccaugggugcucaggugccagcaguuguacccaccccugcuuuugugcuaucaggguuuauggcaaaaucaugaccuugaggacacccagaaaacgucucaggucucaggucagaaaaugucuucugggcuacacuguaagcuccuugagagaguggauugauucucacuuuuuguuucuuuaggacuguguuuagcacaucauagguggucaaaaaguauaugaacugaaccaaacugaaugaagaggacaguuaagugaaacaguuauuugaguggggaagacaguggguaaauuaauggaaaaacaaggcaagaggugaacccucgagaaacaaauuaaaauuucuuuauugaaucugaucuuauuggguuuacuauuuucuucuaacccucuugcuuccaauccucuuuccccuaacugacaccauaauggcuuacagaaugaaauagcauaaagcccagccuuguauucaagcuuuucucaucuagcuaaaggcagugucucuagccguaccuucuccucccugaucccaaauuaaucaucuggcuccuuauaaauaucuggugauccacucugcccacaagucacauacuuucacuauuucacagccgcucuuuuuuucuccuugccuuuaacauccaccuaaaaugcaaacauuuccaugauguaacuccuggugacccaaccccuagugauauaucccauuucuggccaacuauuuaagaaaguuuaggucacacgacuuaagaaauagauaagcaucaauugcuugcuaauugauuaaggugagauaaucuuauuuuucuggauuucaaguuccuagaguguggaaauuuuuuuucaaggugaaacuaagagguaaggagacagguucuacuugugguuugugaaccacuaaguacuauauaaucugucaucauuuauuuuucuugcauaccccauaguguuuaguauggcacagucucaguggaagucuuuaauaaauacuuguggauuaauugaaugcagaaagcuaggguuauuugggagaaagaucacccacaagggaguuaaaagacgugaaggauuuugugugguaaguuugaacagagcgaagccaaauaaacuuugccgaauuccaauuugucccauuaauuuccacuacauuuuauuugcccaaccuaacagucccaagcaaaacguggaaaucuaauagggaauucaguuaaaaagaagaagaccuuuugguuccauaaauaagcuacuucauauuacagagcucuuuuaagaauaauaaaauuaaauauucccagaaucaaucauuuuaaugccucgauaagaggcuuucauggaaagaauuauuugagaccuuugcugaaaacuuagggaauuuugucauuagucacacaaaauaauccugcauacacacacacacacacacacacacacacacacaaacugccauaggaacugugaaauggaaauaucuauugucuacuuauuauuugccagauauauggauaauauuuauuuaauccucccaacaaaucuccaccagagguauuauuucuauuuagagaaaaaguaacugauacuuagaauaagaagcuuuuccaaaauuacagaaucuucaaauugaggguucagcguugggaacuacugucaucugaaucugaaagccauacucuuuccuuuucaccuuguaaaccacuucuuguuucaacaagaugucaaauaaguaggcugaugaagaauugacuaauuaaauguauuauaauaaucacaagcuacuaugugaauauuaaauaaaauaccaugcuucuucuggcuacuucaaagauucuuuacacaaaggggaaaaaaaugaaacauuuucgggaugaagugugugcuuggggugacagugguuauuuggagggcagaugaugcaauugccugcuuguugcugacucagaaauguagagaaauggucaauauaaacagauggccccagggcuccuuuccuuuugugaacuguaugacccugauucaacaaaucuacagucguggcacuggaugcccuuuuacuaaaguccuuuuaccuugucagccuagcaaaaugacugaaauuaaaaacugacagggucacuugugaacuuuacuagcagucccgccucugagccauuuugugcucucagcgguuacgauucuuacacuaacagguggugucagaaaucaaaaccuaauccuccaggggcugccuugguguucaguuucaccuuucaccgaagguguaauccacgccauuaguuuaauauuucuuugugggaaagacaccaagaaacaccaucuuggagaauguccugggauuuccaauaucuccagaggaaauuauauuugacauaggcuuuucucuuuagcauuuacuauauagaaauguggggcacuacaggauugccguguguguguguguguguauguguguauauaugugugcacgcauauguguguauguauauguguguguaugaguguguauguguguaugugaguguguauguguguauuguguacacgugaguguguguauaugaguguguauguguguauguguauaugugaguguguauguguguaugaguguguauguguguauguaugucugugaguguauguguaugugugugagugugugaguguguaugugugugaguguguguauguguguauauguaaguguguauguguguauaugugaguguauguguguauguguguauaugaguguguauguguguauguguauagugaguguguauguguguauaugugaguguguguaugcguguauguguguauguguguauaugugaguguguauguguaugugugugugugaguguguauguguguacgugugaguguguguauguguacgugugugaguguguguaagugaguguguguuugagugugcgugagaguguguguguaugcacaggaacauauuuguuuuuaauuuagugucucuuuacaaacgcgcugcaguguucuaaaaaaaauaugaagacuugugaccagagaaugcaaugcuccucaggcuagguucaugguggauggacuucucucuguuuguuacugcguauggaagggcaagaaguaaguuagcaaaaauugcuguaugaauacauucuguaacauaauggcauagcaaauugauuuagacaagaacagaauagcugaggauggaaaaaauguuccgugcccagcuauuaauccaggcaugggauaggguugcuaccuuuugucugagauucccaggauguuuagucaacggcacccauccaugggaaccuuaggcggucucuauagcaacuguuuagguggucagugacugagucaguggauggagcuaagagguccagguagaccugggauccugggcauuuuguaaaucucugugcuagcaggaccacauaucuagaugacauuucuaguccaucuccccauuuuucacccacuuguuuccuuuaaccuuccuuuuuauguuccugguuaaauaaaaccuauagguagacauguacccaauggccuuugaacuuucucuguuuagggauguauuaaaggcaagauccccaugagugcccaauguugagguuuuuuaaaguuacuuguuuagaccuggccugguggcucacaccugugaucucaacacuuugggagaccaaaguggaaggaucacuugagcccaggaguucaaggccagccugggcaauauagugagacccuaccucuacaaaaaauuaaaaauuggcuggguaugguggugcacaccuguaguaacagcuacucuggaggcugaggcaggaggaucgcuugacccagaacgugaaggcugcaaugagcuguaacugugccacugcacuccagccugggggacauagugaaacccugucucaaaaauaaauaaauagggcugggugugguggcucacgccuguaaucccagcauuuugggacgcugaggcagguagaucacuugaagucaggaguuugagaccagccugggcaacauggcugaaaccccaucucuaccaaaaaauacaaaaauuagccaggugcagucacaugcgccuguagucccaacuacuugggaggcugaagcaggaggaucacuugagccugggagauggagguugcaaugagccaagauugugccacuguacuccagccugggugacacagcaagacccugucucaaaaaaaaaaaaaauuaaaauaaauaaauaaauaauaaaguuacuuguuugaagagagaugaugauuuuaaguugugucagucuguacuuccaugaagucuccucccuucuuuuucucauaggugggguuaggagaaagcuaaugaagcauuaccucagggaccccagggccugacaauauaugcacgaggucauaugguucuguaacaccugcaaaggcaagguauauuaacugcaauagauuaauauugaaugucuuuccauucccauuugccuuccugcacaguuuuccuugcaucagguggcacugguguggccauagacauauuuuguacuuuucgucucagggagacuugaguuggagcuacguuuucuuuggguugaguaugauguauugaugugguuuauaguugcuuuugaggguaacucagccuuccaggacuggaacccuuucaggaauacuguguugacuuccuuuuugucagaguuacauauuugaaauuugguauuguguuccuuaagggaaaccuucaaauucuauacauuuuagguuccagcaaaccuggaucuacucuuggauuuguuuugugucucugguauuuaccuauguuaauauuuuauuuuacauggauaggggauaccuuauuguugaaugugugauugugggguuuggagauuagcuuuauggcacuuucuaucauuauuacaccuuuucuuuuaggucaggacaaaguucuauucaaaaguuaugcaugguuguauacuauaaugucauaucuucacuuaugaaaugguaacaucaaauuagcaauaugaaucauuaaaauugagagcacucucaauuugccaaaauuugacuguaacauuuuaucaauguauuucauaaauugaagugaggaaggcuucagauaauaauauuuuacaaaugguuuuguaggcuauguuuuuaucaacuccaauaaguaucaucaauuaaagcaauguuuuagggaauucauaccuuuacuuuggucuguuggguacgaucauuccaaauaaguauuuaagaagugauucccaaccagcccgguggcucaugccuguaauacuagcacuuuaggaggccgaggugggcagacugccugagcucaggacgagaucagccuggguaacaugaugaaaccccaucucuaccaaaaaauacaaaaaauuagcugagugugguggugagugccuguagucccagcuacucuggaggcuaaggcaggagaauugcuugaaccugggaggcagagguuggagugagccaagaucgcaccacugcacuccagccugggugacagagugagacucugucuccaaaaaaaaaaaaaaaacaaaacaaaacaguuauucaguuauuccuauuuauuguaucuuccauaaacucaauuauuuuacaguuuaggguacagucauccuuaacuaagaaaagagaccccugcauggucauguaaaauuuuuuugcagggguuugcauuacggucacaggcaaacacuaaaucauuuaaccucugagcuuuuguguuuuucuuugaaaccaggggucuuuauuucucccaugugauauuuguaccauuaagcuuuaaauuacuguuuaaaaugcugagacauauaaauauauaaaguuuuucaaaagaaaauguagacuaguuuuaaaauagguuacaaauuaaauugaggacuucuguuucuggccaaaguggaguaaagggacuuaauuuaugcucuugccugaaacaguuaaaaccaaugccaauacccaggcuaaaccagaacaaaccagacaaaauauuugaaaccauggcuugcaagacaccaaacaccaagcaagaacaaugaucucuggaagauggaaaauaaagugaaccuuaugaucgcccccagcuuacugcuuugagagaguuucuagguugcacugcagggaggggaaacugagguggagccugacaaaccucugaguugaggagaugaaaccgacucuggggagaucgagguaacuggaguucucaggacagaauuugugagaugagagagaggugcagugaucuucagaaagccuuccucugggauucggcugaaucugaucaaagaauguaugugaggaaacuauucaaggccaggaagagaauuaaucaaauggauuagagaccuugaaagaucaaaauauuuucagguaaugucacugcuccccagaacaaaacucaagaauauuuacaggauuacaaaaauauccaguacccagcagggucaaauucacaauaucuggcauucgaucacagauuaccaggcaugcaaaacaaaaacaaacaaauaaaaacaaaacaaaacaaaaacccaggaaaguaugaaccauagugaagagacaaagcaaucaacugaaaugaaauaagaauggacacaaaugauaaaauuggcagagcacuacauugaaaagucauuauaaugauauuccauauauucagaaaguugagacauggaaaauauaaaaagucucaaacuucuaaagaugaaaacuacaauagcugagauuaaaaauacgcuggauaggauuaauaaaauuauguauugcaaaugaaaaguuuaauaaaguugaagacauagcaacagaagcuauuuaaaaagaaacacagagaaaaauaauuuuaaaaaauacaaagaucaucagugagaugugggauaacuucacguggucuaauauauguauaacugaaauccccaaagguauaggagaagaagaauaauugaaaaaacaauagccuacuauuuccaaauuugguaaaaauuauaaaccaacagauccaagaaucccaaugaaccucaaacacaagaaaacugaaacaaaucacaucaaggaacaccauaauugaauuaaucaaaaucagcaacaaaaaauaaaucaugaaaguagcaagauuaaaaaaacacauuauauacagaguaacaaagaaaaaagugcauuacucuuuggaaaaaauuacaauggaauaaugucuuuaaaguauugaaagcaaaaacccgauaaaccuagaauucaauauucaacaaaaugauuuuucuagaaauauauauucagauauacaaaaucugaaagaauucaucaauaguagacucacauaauaagaaauguuaaaggaaauccuucaagucuaaaggaaaugauauuagguaaaaaugugcaccuguacagagggauguagagcaacagaaaugguaacaagugaguaaauauagaagacuuuuuucuuaucauuugaauugcuuuaaaagauaacugacuauuuaaauaaaaauaaaagcaggccaacugcauuggcucaagccuguaaucccagcacuuugggagguugaggcaggcagaucacuugaggccaggaguuugagaccagccuggccaacaugguaaaacccugucucuacuaaaaauacaaaaauuagccagaugugguggagugugccuauaaucccagcuacuuggcaggcugaggcaugagaaccacuugaacuugggagguggagguugcagugagcugugaucacaccacugcacuccagccugggugacagagugagacccugucucaaaaaauaaaaauaaaaauaacguauuguagcauuuauaacauauauauaaauacaauauaugacaauaaucacauaaaugccagaagggaugaaaugaaaguauacuuuuuuagggcucuuacguuauguauagaguuguauacuauugcuugaagguagucuguaauaaguuuaaaauaugcacuauaaauucuaaagcaaagacuaaaacaauaacaaacaguuauagcaauaugccaacaaaggagauacauuggauucauaaaaaauuuaucaauccaaagaagacagaaaaugaaguaaaguggaacaaagaagcgacuggaaaaauaugaagcaaauuguaggauaauagacuuauaccuaacuauaucaauaaucacauuaaauuuaaauggccuaaacagcuccuuaaaagaaagaucuuucuagauuggauuaaaaaaaguauaugccaucuauaauaaguauacucugaauauaaaaacuaaaauagguuaaaaguaaacagaugaaaaacaguauaccaugcuaacacuaaucaaagaaaacuagagaggcaccuagccuuucuuucuugauugaaagaaagcuagaugaagaauuaacacauugucuguauucucaaaugaacgacauaauugucuaugcagaaaaucuaauggaauuuauaaaaagauacuagaaguaacauauaaauuuagcaagguugcaggauaaaaggucaauauauaaacauaauuguacuuucauauacuaggaacaaacauuuggaaauaaaaauuuaaaaagcagccaggcacaguagcucacaccuguaaucccagcuaauugggaggcugagguaggaggauugcuugaacccagaaguuugaggcugcagugaacuaggauugugccucuucugcacuccagccugggugacggagugaaaucucuugaauuaaaaaaacaaaaacaaacaaacaaaaaauuacuuaacaauuacaacagaaacauggaacacuuuggaagaaaacuagaaaacugacaaaagauguacaaaugcguacauuaaaaacuacagaauauugcugagagaaauuaaagaagacuuaaaucaauggagacagacauaucuuguucaugagcugaaacacucaggauuauuaagauaccaguucucgccagauggaucuacugauuugauucaauuucaguaaaaauuccagcaguuuuuuggagauauuuacaagaugauucuaaaauucauaugaaaauaaauguagaauagccaaaaacuauuuugaaaaagaauaacaaaguugaaagacuaacacugccugauuucaaaacuucuuauaaggcuacuauaaucaagaaaguguuuaauuagugucaagauauauaaauuaaucaaagaaaaagaauaguuugcccagaaguagaacuacacauacguagacaacuaauuuuugacaaagauguaaaggcaauuuguuagagaacggauauauagccaacaaauaguauuggaacagcuggcuauccauagauggggaaaaaaauaugaacuuugauccauaccuuacaccacauacaaaaauuuacucaugauggguaacagauacaaauguaaaacuuauaaaacucacauaagaaaaagaaaggaaagguuugcgacccuguguuaggagauuucuuauauaugacacccaaagcacaaacuaugaaagaaaaaauugauaaauuagacuucaucaaaauuuauagcaaugugaaaacagacuaauacacauaguuuauuguaugccaauuauacuucacuaaaauuuuuuuaauugcauuagaaacuuauguugauucuguauugggcuguuguuugccuccugcuggauuuuuggcaguuacauugauguccaaucugcuauguuuuuacaguucaguugaaaauaucuucuauucuguggaugcuuuaagugguugauauauaaacagagacacuuauucgauuuucauagacauugaaauguuuuuacuggaaagcuagguuguuggguccaugcuauugucuuuuuaaaacuaaauuaacagaugggugcaguggcucaugccuguaaucccagcacuuugggaggcugaggcgggcagaucacgagaucaagagaccaagaccauccuggccaacauggugaaacccugucuccacuaaaaauucaaaaauuagccaggcaugguggcgcgugccuguagucccagcuacucggggggcugaggcaagauaauugcuugaacccaggagguggagguugcagugagccaagaucgcaccacugcacuccugccuggugacaaagcaagacucucucaaaaacaaaaaacaaaaaaacccaccaaauuaagcagaauauggaagguuugugaacaaguuucagaaaguugaggaaacuagcaaaaaaccaguaugcccccuuuuaauaaaaagacugaaacacuuacuguccacauaugacaauguuccuauguagacaauaagagaaccaaucaaauuguguuuuacacaggcggucuuuaaagugagaagggaacucauuugguacagacaauccuguuuuacaauuucacuacuuuguucauuacccccaauaaagucauuccaaaaaugaugguaucaugcaaauaagauccaaguaucagguauuuauaggccaugucaugaauacuuuuaccaucacauacaauauuugauuccuuucucucuuuuuacauuaaugaucacuguacugagcuuagugcugcuuaccuugugggcuggaauggacagagacugacucugugacuuaggcaggaacagugcauacaggagaaaacuggcauauccagguuaaauaccuacauauugaaaucacauaauauuucaacauuuggaacacuuuaaaaugaucuuugauaggaaugauuuugaaauugaacuaguaugucuauaacauaaacaaccagacacauuuuucaucucaaauucaugcgaauaguuuuucuacuucauguaaaaaaacuuccaauuuuauuccguaauauucuaacuauauucaacuuaaaaaagaacauucccuaccacaggcagaaucaacugguagaaauaacaccagucacuaauaggaagucuauacaucuagguuuauucuaaaagacugaaugaccuugaacagguuucauuaucuguaaaacaagaaagguuugaauuggccaauuucuaagauuccucuaaaauaauucuuuuucuguagaguaguucugauugggacuacucuauagaaaaagaagcugggcacgguggcucacgccuguaaucccagcacuuugggaggccgagguggguggaucaccugaggucaggaguucgagaccagccuggccaacauggugaaaccccaucucuauuaaaaauacagaaaaauuagccgggcaugguggcaggugccuguaaucccagcuacucaggaggcugaggcaggagaaucucuuuuguacccgggaggcagagguugcagugagccaagauggcaccauugcacuccagccugggcaagaagagugaaacuccaucgcaaaaaaagaaaaagaaaaagaaaagaaaaagauuugggucaauuucuuaucuggcauguaugguaauucuugccuuaugauaaacuuuucaggggugcuuaguggaccuucaaaugccauuaccagucacuucccagcauucaaauugaggaauuugaaacugcugauuuuguuugagcaccaaggaaauaaagaagccaaacgccagagcugggcuguccaucaauucucccauuucggagacauucugacugccaggaccagccaccuacgucagcaugaccacuuggaauuggccaauuccagcagggaguuugauuacacccacagggccucaugaggauuuuggcaccuuuugauccaagacguaauugacacugaacgaaugauaaauaagcaucuucuucccuuucucuuguugucuucuccagcuucaauuacaacuagaauauuucuacagauuuauuaggucaaaggaagcccagcauuuuuuuuauauuaaaaagauguguucgugucugaauauucggacaaauccuuuacauugcccauggguugcagaaggauuuuagugauagcuaaucauggaaucaaauuuaauccacugguguguucccuucauuuuaaucaccucuaaagugauauuguaagccuguauuccuggaacaaaaaugaaaguaguugucauuacuugacagauaaaacauagaaugacuuuucuaagccuuacuuguuugcauucuaugaaauuagacaaaccacugguaacucaaauuacuuuagagaguacgaagucuuccccaucugcugacaaauuaugucccuaugucaacagagggaaaacacucccuguaacuaguccauuuuguccccugcuggacuugaagcuaaugauuauagggaguuaaaaccaaacuauuuucuuccaguugugagauacacaucucccacaauucuuguuccuuauagauaaugcucuagcuuucuuaguggauugguuguuugggaaaccaccaguucaaaaauugugauggaacugacuaaauauuucagucaagcaguugacugaaguagcuagugguugaauuuccauuggauuaagcacuuguuuuaacuacuugucaguaaggaauaugcagagagagggaugcugaaaagggaugaucacugugauaaugcagccaaaacuaacucucaacuggcuuuauagguaaaauaaaauguuuuccuuaccugaauaauaaacucuuuaauuuuaaaguagaauuauucauuggccuguggaauuaaaacuaucaaaauaaugcuaaauagagcugagacuggaaugaugcaaagugaggcaguuggcuuccacucaaauuuuaagugagagcaaaaaguacucaguaauuaagauaaauaauacuaauaaaauauuuuuaaaagaaacagcaaaucaauuugaaaaaaaaaaucacgaugaauaaaacaucaaaacugggccaggugcaguagcucaugccuguaaucccagcacucugggaggccaaagagggaggaucacucgagcucaggacuuaagaccagucugggcaacaaaugagaccucgucucuauuuuuuuuucaacuauuaaaaacauaaaauaaaaaacaucacaaucguaaauaaggacagaaucaguauuacugauuuuuuuucuuuggcucaggcuucguauauagaacucuacacagcauuauugcugccacugucuuucuuuaaaauuuugauauuuuguucaccauggauuuuuuuggcauuaauuuugauguuuuaaaccauugcauuuagauuuuauuuaucuuuacaacuuagguucugacacccucuuaaguccuacgccagaggcgcucuggucuugcccuggcguccugcgaucuugaugccuaauuugagguaugaaauuccagccuaauuugaaguauaaaauuccauagucacacaaccaauaaguggugaagucuggauucaacacccaguccucaggaggccuuccuuugaggacugugcuauuaaugcuuuccaagugacuguggaaucuaacagcucugaaagaaguugcuuuguuccuuuccagccugggaccuuccauagccugaguugcggguagaggaugguaaacccugagcuaggggucucagagcugggacuggaauccaggaaugaguuaaggguuucaaauaagauaauaagagauagguuuguuuuguuuuguuuugacgaacucucacacucucgcccuggcuggagugcaguggcuugaucuuggcucacagcaaccucugccucccagguucaggugauucuccuugccucagccucccaaguagcugggauuacaggcacccaccaccauaccuggcuaauuuuuuugaauuuuaguagagacaggguuucaccauguuggccaggcuggucucgaauuccugaccuugugaucugcccgccucggccucccaaagugaugggauuacaggagugagccacugcacccagccugagauagguuuaaaauuucuuuucuguuguauagaauucaauuuuaaaacgaucuccccacuccucagaaaagaaagaaaaacaucaauaaugcaaaaagguaucaucuaagaacuaaguucuuagaaaagaaccuacuaguaauauaaaaauaacuucucucacguggcacaugugcuuuuacaugaccucaccuauuuauuuaugugaugcaaugaaguucugagacauggguguaggucguagaagaggaaggugcuuuuacucuaagaagggacagaaggaggaggccauuaauaaaaguaaggagaaauguuugcagaaaagaagaggaauaucaggcauuugcagauggguuaaguaaacuuaaaggagcucuugguaauuagccuagaacucagcaaaguaggaccuggaauuacugguggggaggugggggugucgaggguguggaagaagagggcaaaaaugaguggaugauuuuggaacagucuuggugaucaguauggccuguagucaacaagauauggacacacacaggaguucucuaaaaugcaacaagauauauugacagacaaguccaaaauuaaaauaauauucugaucuugggccgggaguggugccucaccuguaaucccagcacuuugggaggccgaggcaggcggaucacgaggucaagagaucuagaccauccuacccaacaugaugaaaccccaucucuacuaaaaauauaaaaauuagcugggcguguuggcgugcgccuguacucccagguacucgggaggcugaggcaggagaauugguugaacgugggaggcggaggcugcagugagccaagaucgcaccacugcauuccagcuuggugacaagagugagacucugucuccaaaaaaaaaauaauaauaaaauaaaauaaaaauaaaaaaauugauccuuagcgcugcuacccagcuccacaaucuguuccuugaugugccuccuuuuuuguuuuauuuaacugugauaguauucaccccucggccuuagcuaguaguauagucucaggguaaauguugguucuaccuccucuuuuaucuuucacagcugaaagcaccaagucuugucccuuuuauuucuagaaugagaguugcaaagccaaauaguucucaagaaucaggcaaguaaagcagacuggguuggggggugggggugucacuauguaaggguaacucuuacauuuaauguguugcugcauuuauaugaccaauauguuguucauuccaaauaccacuguagcaagauucacuuuuuaauuuuaauuuuaauuuuauuuuuuuuucagacugagucucacucugucgcucaggcuggagugugguggcacgaucuuggcucacugcaaucuccgccucccggguucaagcgauucuccugacucagucuccugaauagccgggauuacaggcgcgcaccaccacgcccagcuaauuucuguauuuauaguagagacgggguuucaccauguuggccaggcuggucucaaacuccugaccucaggugaucuguccaccucagccucccaaagugcugggauuacaggcgugagccaccgugcccagcacaagauucaguuuuuaacaaagcuuacauagaaggagaaucaagaacaacaucagagcuuugguguugugugcucugcuggaaaaaaaaaaaaaaaagauggagggggagggaagaacaaaaucuuacuuguuaaauuacagaauguuaucaaugguaaaacccgagaaagaaaagaaaugugcccaaaauaagaagaaagaugaauuaaauugcuaugcguccugugaaaguaacuuuaaaaauauuuuuuccaacuuucuucuauggcaaacaaccacauaccuuguagaaaaugaauucucuggaggauacaggcaauaaagaaaaccugugagcuccgugauguacaccagcugauucguggagacagcauacaagcuuaacuaggaauuuaaauucauagauaauucaguuucaugaacuagggccagcaauagaauugucuauguuuucuuugcaccuugguuugcugcuccaccuccuuccucucaaauguagucucuuacuaaucuuguaaggggaucuuccuucccucucuugacgaagcuuccugguuucgcuuagagugugaggaaguuuuugugacagcuggucacguuacuagcaucaccaguccauauuuccuguucagauuucaaucaagccacaaacccuugagaaucauagcuuugguuugguuucguuucguuacaaaacuuuuuuuuuaagaaaccaugaaaccacacaaggaguccauaaucccaaaggcugccaaacaacccugguugaccuaguuagcacuguagugggaagugggggagggggcagucagauaacauaauucuaauuaaaauauucagaaaacuaaaaccuuuuaaacuuaacucuuuguuuggaauaaaaacaaccaaauauuggggccugacagacacuauaucagaaauuaaaacaauuuauucuuuaaauuucagauacuccaauuagaaugaaauuaaacucaaugaguuuaaacugagucgagguuuauuaagcucugccaguuccuuuugcauucguuuacuguauuuuauuuuuaaaacaaccacauaauuaauacugcagaaagcaguauaugauaagaacuuacuugggaagauuuuuuauuuuguuuccgauguguauuucuuagucaagugcuacaugguguuucuuaccauuacuuauuuaaaaagcagaucaaugagauucauacugguaacauuuacacaaauuuuccaaauuauuguuugucucuacuuacagugggugccaaaauaaaucuuggaucuuuauauuuuccuuuaccaagucaugcaaagcaaggaucuuuucuuuaacugagcuuuaaaaccauugcuggcagcgucgagaucaaaauaaauagaaguuccauuccugaaaacugacauggaauugagucggccauaaaagugauguugucgcaacuuauuucaacaaagaaaaaguccuaaaauuaaaaacauguuucuucugucaugugucauacaaggaaaaaaaaaauggaaaaaaaggaaaucuuaguguguuccuaauuuagauucuucuuuacuauaaacauaacuuucuccaacaacgacacacacaaauauguugugccacucuugagaauuaagggcuuuucuuuguucaguuuggguucucaccauuuggacauuaaaagaaugaaaguuacauaugcauguaagagugauugaugacgggaggugggccuacaauuuacaugcauguuuucugaacacaguucgggucuuaacuugaaaaccucaacuugaaaaauaucaugaaacguauuucuuugggaaauuauuacaguuugggauguuagucuuagugucaaguugaagauguuuugguuaauucacaaaugaguaaauugccuaguuuacaguauuagcgauuuuuaaaucauaacuuaugguuacuuguaugucucuucugaauaaaauauuuuacaauuuuagccuguagguuuauggaaauucacaaugaaaauaaaucaggcucagacacaucuaugugagcaaaucuauauuucuggauaauugaacuacauaaaucacucauuaaagacaaaauauccaagaguucaaaguuauccuuucuugagagcaguucauuaauccuuguagauauguagcaauaaacccaaaggucaagaagcugaaggugggucgcugggcuguuagauguggaggcaauaggauuacuguuuuuuguuguuguuguuuuuguguuguugugguuguuguuuuccaccauucuacucucugccuuuguaagaucaaauuuuuuaaaauuuuuuugagacugagucucacucuguugcccaggcuggaguacaguggugcaaucucggcucacugcaaccucugccuccuggguucaagcuauucuccugccucagccuuccgaguagcugggacuacaggcgccugccaccaugccuggcuacuuuuuguauuuuuaguagagaugggguuuuaccguguuggccaggcuggucuugaacuccugaccucaagugaucugcccacuguggccucccaaaaugcugggauuacaggugugagccacugcgccaagccacagcuuacucuuuuuuacuacacaaccuuuggcaaggcaauucucuguuaguuugcucaucuaaaacauggguauaggcugggcacgguggcucaagucuguaaucccagcacuuugugagucugagguggauggaucacuugaggucagggguucaagaccagccuggacaauguggugaaacccugucucuaccaaaaauacaaaaauuagccaaguguguuggcaggcaccuguaaucccucuacucgggaggcugaagcaggaaauucacuugaaccugggaggcggaggcugcagugagccaagaucacgccacuguacuccagccuggguaacagagugacacucagucucaaaaauaaaauaaaauaaaauaaaauaaaauaaaaauagaaaaaaaagagcaaauuucaagacucuucaguagacccuaaugaaugagaagcccuagggccgagauugggaaucugcauuuuggaacagcugcaggugggucagugaaucugauacucugccuuaugagaaagauugggauugaaaggaaaacaccuucacauucagguagggauuccugugcaauuuggcacuuucuaggucagaagaugcuuucucuuuucccuucagacucucauugucaggucauucuccuuaaaccuuuaggggaugggagaugaauuccccaggccacaucugucagauucuacauggcaguuacauuccauacccguucucccugucgccacugucuguggggaagcuggcagauuuguggagaagucuagaagguuguggagaagccauggaagguuguaacaucaacuuugcaguucaaucucugacccuccccagaauugauuaauucaucuuuuaaauuugucauuucauuuaacaaauauuugagggcagauauguacuagaagcagcacagaucuggagucaggagacccacaguggcauuacgcaaaacaccuccucagucuuacucucugcuucuucaucuauuacaaugagauaauaaucauuccuacgucacaggguagaggugaggauagagugagaguuuuagugaaggcacuuuguaaaccauaacaacagagcaagcauucuuauuuucaugugcaauacgcugugauaggagguaugggaaagcaaagguguuucguucacuucucucaggaauuugcagucucauaagggugugaacaucucucuacaugaguaacuauaauaugaaugucaugggauuggacaaaaugcucagggagugccaacgguuucugucuggggucaucaagaaagguucaucagagcuugaaggcguagcauuugggcuuugaagugugauggauuucaacugguaaagcuaaaacaacagggcauuucugggggagagaaggacaugaggaguggcagaaaaauuaaaagauggaagacaugccuggugaaagauacauaaguaacuuugcuuaugauucuguuucuaccuugggcauccccuugcauggggcagugugagggagcagauauuaaaguggaguggcuggugucagacauacauaugcguuugucaucugugauaugcacacaaaucuaaaaccagaacaccuguagaaauuuagacuccgcuucuggaugcugaaauuggagcaacucuaaaacaugauaaaaagugcaugucuggcugggugugguggcucaugucuguaaucccagcacuuugggaggucaaggcaggcagauugcuugagcccaggaguucgagaccagccuggaccacauaggaagaccucauuucuauuuaaauaagaaauuuaaauacaaauuuuuaaaggugcauguuaauccugaaguauuucacaguaguauguacacaaaauguaacaugaauaacuguuagguuucuguuaaauuucuguucuuaaccaguuuacaauaaaaaugguuugaauuuucauaagcuuuucucuucauaccaauaaucaacuaauauuuucauuugcugacaugccuuaucaagauauauguucuuguuuaaauaauugaugacuugcuuuaacaaaaaguuuauggagacacuugccuaauuuguuaauuacugcugguagacguuaccuucugugcaacauuuaguugaaacauauccaauauauccuuccuuccuuccugacagcgucucacuuugucacccagguugaacugcaguggcacaaucauagcucacuguaacuuggaacuccugggcucaagcaauccuccugccucagccucucgaguagccaagacuacaggugggccaccacacccaauuauauuuuaaauuuuuugaagagauggugucucacuauuuugcccaggcugaucuuaaacuccucaccucaagcaguccuccugccuuggacuccccaggugcugggauuacaggcaugcaucaccaugcccagccuagauauccaauauauugccuauuuaauaugaacauuuguguuuaagaauaauguaauaauggaggguguagcuuguuaguuaagagcauaaacucagccgcgccaguggcucacaccuguaaucccagcacuuugggaggcugaggcggguagaucaccugaggucaaaaguucagcaccagccuggacaacguggugaaaccgugucucuacuaaaaauacaaaaauuagccaggcguaguggugcaugccuguagucccagcuacuugggaggcugaggcaagagaaucgcucaaaugggugagguggagguugcagugagccaagauugugccacugcacuccagccugggugacaacagcaaaaauccaucucaaaaaaaaaaaaaaaagagcauaaacucaagaaacagccuaaguuugucacccagcucugccauucaaguagcugugcgauucuuagucauuaauuaaacucucugucucaguuaccaucugccaaaaucaacuacugguacucaucuuauaugguuguuaugaagguuagcagggccugauaugugguaaacgcucauagauuguagcuauuauuaaguuugaacauuuuaaguuaaaauaacaccuaucuaaauauuuagaugggguuuuauaauuuuauaacaaagucauuaaaaucaaaaugaguaacuuuuaguuaaauuaauuuauacaaaucaauaaauaauuucuaucaaaaguaauuauuuuucugaauuguguugcuuuagaauucagcaaaagaauuuuaguaugaaauguuuuaucuaagaauugaacuuucuguucacuuggaauuaagcuuuucuaugccugucaauuuauauauuuaaacagcuguuuucugaauaugaguucuaaaauaaaauuuuucauacagauauuucugccuuuuaaauuuaaagaaauguugauuacagaauacacuaauagguacacagaauuugauuuuggugguucuccaaaauaaagucauacaaguaacaguuuaguaaacucuucauugguuucuauuuagagccugcaaggcaauucuguaauacagugguucucaaacuucaugaucuccugaagccucauuaaugcacgauugcugggccccaccuucagagugucugauucaggaagucugggguggcagcugaaaggugacuuuccaacaaguguucaggugaugcugguguagccugccagggaaccacacuuugagaaccacugcuauaauucauuagaagaguuuaggauggccgggcucgauggcucaugccuguaaucccagcacuuugggaggccaaggcggguggaucacaaggucaagagaucaagaccauccuggccaacauggugaaaccccgucucuacuaaaaauacaacaauuagcugaggugguggcacaugccuguaaacccaacuauucgggaggcugaggcaggagaaucacuugaacacaggagguggagguugcagugagccaagaucgugccauugcacuccagccugggcaacaagagugaaacuccaucacacacacacacaaaaaaagaguuuaagauauugaauucuuauuuucugaccugaauaaaauuuuauuaagaaauuuguugaccuggccugguggcucacgccuauaaucucagcacuuugggaggccgagacagguggaucaccggaggucaggaguucaagaccagccuguccaacauggugaaaccccaucucuacuaaaaauaccaaaaauuagcugugcguggugacgugcaccuguaaucucagcuacuugggaggcugaggcaggaaaaucgcuucaacccaggaggcagggguugcaguaagccaagaucacacaauugcacuccagccugggcuagaagagcaaaacucugucucaaaaaaaaaaaaagagaaauuuguuguauauuuuucuccucuuugauccaaggaacaaaauuuuuuuaaaguacguagcuauuagauuccaaaagacaaacaaaguauaggaaaauuuacuucucagaaaacuauuucuggauuccauggcugauuuuacuuuuuucauuuuagauuugcuugacuaaaaccucuuguauuuucuuucuccuuuuuaccacaucuucuuauuuugaugguaaugacaaucuucuuuuauggcauuuuaggauuccguuuugccugggugaguccuaaaaaaaucauuuccuguaucugucugcacagugccuuguaaucuguaacuacaucgaaucaucaucugaaaguacaguuucuggaaugugacacuuucgaaauaauccuuacuugcagaaaauguugcuuauguggcauauauauguuaaucucauggaggaaaaaaaagggcaaaaaaaugcucagcccaaggagacaucuaaauuauccaaccacauaaacaugcagacguuauuuaggaaaaauauaaagaugugacagauagcuaaugacaaauggccaauuuacuuauauaauuaacuuugcuacuagaaaauuuccauucauggaauagcaccaaauguacacgaugucagugccuuuuuucaaggcaguguugcauucagccagcuggacuugucuucuauaauuugcucugaugaccaaauaugcucuacauaaauucuaguuucuaaaucacguucuucucuucccuuucucccacuuucucccuucaucuuacucaucucuaucuuuuuuuuuuuuuuagacggaaucucacucugucgccaggcuggagugcagugacgcuaucucagcucauugcaaccuccaccucccagguucaagccauucuccugccucagccuccugaguagcugggacuacaggcaugcgccaccaugcccagcuaacuuuuuuguauuuuuaguagagaugggguuucaccuuguuggccaggauggucucaaucucuugaccucgugaucugcccaccucggccucccaaagugcugggauuacaggcaugagccaccgcgcccagccuucaucucuauuuuauucuguguuuuaucuacuucugaaauuagccucugcuaguugaauccuuuagagagguugcuguccccuccccacacaaggaacaagaauaagugauaagaacuguaggguuuaucuuuacaguugggccuccauauccuagauuucugcaucaauggauucaaccaaacucagaucaaaaauauuuggagaaaaaaaaagaaagcaaugacuacaacaaugaaaauaauacaaaugaaaacaauaagccugggcaacacaguaagaccccaucucuacaaaaaauuuuuuaaaauggccgggcgcaguggcucaugccuguaaucccagcccuuugggaggcugaggcagguggaucaccugaggucaggaguuugagaccagccugaccaacaugauaaaacccugucuccacuaaaaacacaaaaauuagccaggcaugcuggugggugccuguaaucccagcuacaggggaggcugaggcagaagaauuguuuuaacccaggagguggagguugcagugagcugagaucaagccacuggacuccagccugggugacagagcgagacuccaucucaaaaaaaaaaaaaaaaaagaagaaugaaaauaaaaauuaaaaauuaaaaaauaaaaaaaauuagcugggcauaguggcgugcaccugugguccuagcccuagcuacuugggaggcuggagaaggaggauugcuugagcccaggaggauaaggcugcagugagccaugauuucaccauagcccucuagcuugggugacagagugauacccugucucaaaauaaagaaauaaaaagcaaugcaguauaacaacuauuuacauagcauuuacauuguauuaguauuauaaguauccuagaguuuauuuaaaguaugugagaggaagcucacagguuacaugaaaauacaacaccauuuucuauuagggaugugagcauccucugauuuugguauccacagaggaccuagaaacaaucccugacagaagcugagggaugacggugcugccauccuuucuguccauccuuugccuuuuuuguaguuucccuuccauuugagggggaaaaaaaguaguuuacuagagagaagaugacauuaaaaaugaagcucuuggucccaguccuguugcaagaccuuuaccuugaaaauucaggcuccuuaucaacugguggggagggauccuuguauucacuugauuuccuaaguuuguagugagaaucaauuuaggcaauguagguaaaagugcuuugugagcauaagcacaugucagggccaagacuagugugaaggaaggaaggaaggucccgagggugcaguuuaaaggagacacccccucuuaggaccuugccaccauagggcccugugaggacugccaccugugacuguuauggucaucugcaacucagcugugaccaaggguuaaaaucuggcauuaaauagauuaaauacccuaauuucucugacggggauguacuuaacacagacugcagucucgggauuaaagaaauaaaguucugacugggcacgguggcucaccccuguaaucuuagcacuuugggaggacaaggugggaggaucacuugaggucuggaguucgagaccagcuuggccaacacggugaaaccccaucucuacuauacacacaaaaauuagccaggcgugguggcgggcgccuguaaucccagcuacucaggaggcugaggcaggagaaucgcuugaaccugggaggcggagguuucagugagccgaggucaugccacuguauuacagccuaggugacagagagagacuccaucucaaaaaaaaaaaaaaaaaaaaaaaaaaagagaaagaaaguuccaaccagguggagggccccucaaaaggucacaguggagacaugaugguaaccuacuuggcccaggaaggccaauccuugguuuaaagaacacugaguuaagaguaugaagggaaaggaagcuugugcauuuaaaaagaacuugcaucugaugaguugcaucugaugaguucuuucucagaacaauuuucccacuugggcccucaaaauaaagaauuauuaaaagaaucuuacuauauuuaauucagaacccacgauagaaaaaaaaaaaaagacaaaacucacacacagagcagaaaagcccuuucugugacuuacucuagaaacuauuaugcuucacaagcaaauuuaagaaaaauuuuucucugccucaacauaagauuaagacaaagauuacuacauagugacaaagcuaaaucaucuccggaggauagaguuacuuucucacuaaugacugucaucugccaagaacuaguaugcuauuaauacuuguaaagcucccuggacuagaaauccauuacuagcaaaaguacaaguccauuuuuauuccagguaauuaaucuaauuugacuuucuccugaucacuacuuagcagaaauggaugcugacuccuuucucugugaagaacaaauagaucuuuagagagacuucucacugagugaccuuaaaggaauaguucucccucuuguuccugcugcuucugugcuuagugaauacuccaagugcagaagcuuguccaggacuaagcuuauuagcagagaagagaaccaguuccugaugcugguauguaaggaaggaaguggacccuggaagaagagccgaggagagacacaugaaccaggcucccaaccccaacagaaaucugcaaauaaccaaacugcauguacccaugauguuuguacacagagaauacagaauaguggucaaucaggugucacccugguaccucgguuacuuccuucaaagagaguugaaaaagaguuuaucuuaaagaaugaaguucaaaaguguugauuucaguuuuuuacccaaccucuacuuaaggugacuuuggcaaagaaacugcauguuuaaagaugccuaucagggguucuagucaguucuacuuuucuacugaaagugaauuaaacuggaaaaacgagagacugcagcagagugaggaaagaacuuaauauacgugucaccaaagcaaucaggagagaauucuuggaaauauauauaacauacauuauagacauuucuggaucaaauugacuuuacccucucgaaggcuuuauuugaucgauccugcucuugggucugauuauuuuuuccuauucugaaguuaagucuuuguaaaucauauagaucaauuagagaaaaaugagaaaauauagaucagcagaaaauuaaaaucacuaagaagccuaccacucaaagauaaccccuguuaaaacacacacugucuauauaaauauguacucccagauuuuuaggcguauuuauauagacaugcuuuuaaaaaaauauguaacuugcauuuucacuuucuuuucuuucuuuuuuucuuuuuucuuuuuuuuggggggguggggacagagucuugcucugucacccaggcuggagggcaguagugugaucucggcuuacugcaaccucacccucgcagguucaagugguucucaugccucagccucccacguagcugaggcuacaagcauaagccacugugacuggcuaauuuuuguauuuuuaguagagacagaauuuugccauguugcccaggcuggucuugaacuccugggcucaagugauccaccugccucagccucccaaagugcuaggauuauaggugugagcuaccauaccagccguuuucacuuuuaugagcauuuuuucauguaaauagcuuuaauauacuauucuuauuagcugcauuauguuacauuguguagauauaauuuaugcauugauuagguugaaauauacuauaaugaauggcacucuuagccaugcagauagacuacacaaugcuuaauucuguguuuuuauugugaaagaacacccuaccuaugcuagauucugaauccacugagguaguauuauucucuuuggccugauuuguaggccuguuagggcagauguuuucugaacucugcccuauucccuccagucccuuaccauuucugugcccuccagccuggcugucaagggccagcaccuugcucuuugauggaaaacugcugugaaacggcacauggaacccacggugccugcaggcacagggagcuggaagugccugggaguucacguccucacaggggcacuccuuaaccaaugaauggcagauguggaguacaaauaucuugguuuuuguuaccucccagaagggacgauucugagguguguguuuuguacuguuuuucaguguuuugcacuguuuuucaguguuuucccauugcacuaacagccauuugcccauugagaugacuggcuuagaaugcaccuuuuauugacuaucuucgcuucccuggucauuucuuccaacaccuacccuuguuccuggcacuucucacuacauugcuugcacuugaauccuugacucagcguuugcuucugggaauacccgaacucagacaccuguuaguuauagucaguucgacagcagagcuucggagguuguggccugugucuauugcugcagagguauuggggacuucauccagucaucauaugguggcaacucuucuuacgccuugucaccguaacauuuuagacauucacaggaaagcaggccagcuaaggucaucuuuauuuuucacauagaaaaacuguagagcuuuuuagucucuaagagcuuuuucgugcaaggucacgcagcuaauuauaaguagagccugaaccggaaccuauguuuguugaccagacaacuguaccucuacaaaaugacacuaauaugucaaaagugaaguugacuugggaugaauaugcugcuugaauuaaguuuaggaagccuaaagcuuaaaauacagucuuugaagcauuuucaaagcauaguuacuuauuuaguaaguuuguuuccggcugggcuggauggcucaaaccuacaaccccagaacuuuggguggcuaaggcaggaggaucuccugagaccaagaguucaagaccagccugggcaacauaaugagacccacaucccuauaaaaauuaaaauuaaaauuaaaaauuagcugggcuguauggcaagcaccugugguuccagcuacuugagaggcugaggugagaggauugcuugcacccuggagggcgaggccauggugaaccgugaucacaccacugcacaccagccugagcgacagagcaagacccuaucucuuuaauuuaauuuuaaaaugacauuaaauuaggccgagcaugguggcucacgccuguaaucccagcacuuugggaggccgaggcgggcagaugaccugaggucaagaguuaaagaccagccugaccaacauggagaaacccugucucuacuaaaaauacaaaauuagccgggcguggcggcucaugccuguaaucccagcuacucgggggucugagggagaagaaccgcuugaacccgggaggcagagguuguguugagcugagaucgugccauugcacuccagccugggcaacaaaagcgaaacuccaucucagaaaaaaagaaaaaaaaaagaaaaaaaagaaaagaaaaggaaagacauuaaauuaaauuuuaacaauuuucuuuccucauccuacucuucaccuuucauugccuuauguuccuuucccaguaucucuucuacuuucuuugguaccuaagggugccuuguuccuaugagaacaaugggaucuccugaucucaugggagaucccauuguucaugaucccguaggaacaaugauccuaugcgaucauaaacugaucauugccaccuagcugaacuugagcagguuguacucaggagggaaggugauguggguaauagguauaguucaaggcagagugugguaagcacuuuaagagaagugcaaaguccuuugggaggacagaggaaggaaagaaaaauucuggcagagacagaaagggaaggcuugcuggaacagguggccuuuaagcugggucuggacggauggguagaauuucaacaggcggauguuggaguggggaaggaggagaaaggaccagcaugagccuagaaaaaugcaguacguguucaaguggaggggugguuggcucccaggacacauggugggagguggaagagauguguguacagugagauggagaaggacccuuuccucagugccugggaguuuccuuuugcuuugaacaguuaucugugagcaggaaaaugucauaacuacagcuguauuuuaagaacauuuaucugaagaugcacuucuuuuauuauuagaugcuauucauuguguuguguucagccauucuuuuaauguagaauaacauucacauacacuaacaucagagcucuuuaccuuggcuguggcccuguaguaucucgauagcuugccaguuuuugcaccucaaauuguuccacugucauuugcacacuaaguucugagcacaaguguccucuagaaguuccuagaaaauaucugguccugcucuuuauggguuugaggauuuuuuuacuuuuucuuuuucuuucuuuuuuuuuuuuuuugagauagaguuucguucuuaugguccaagcuggaauguaauggggcgauccuggcucacugcaaccucugccuccuggguucaagcgauucuccugccucagccuucugaguagcugggauuacaggcaugugccaccaugcccagcuaauuuuguauuuuuaguagagacagaguuucaccauguugggcaggugaccaacuaacuccugaccucaggugauauaugcaccucggccucccaaagugcugggauuacaggugugagccacugcacccggccuuguuugagaauuuugugcuuguucuuccccaagucucaugaccuuuuuuuuuuucuuuuuucuuuucuuuuuuugaggcggagucucccucuguugcccaggcuggagugcaguggggcgaucucggcucacugcaagcuccaccuccuggguucaagugauucuccugucucagccuccugagugggauuacaggcacgcgccuccaugcccggcuaauuuuuguauuuuuaguagagaagggguuucaccagguuggccaggcuggucucaaaugccugaccucaugaucugcccuccuuggccucccgaagugcugggauuacaggcgugagccaccaugcccagccagaaaugacuucuuaacugucuucuccuuaacugacauuuauuuccucaaaggaaauuucccuguccaccccaucaaaagaagcacucgugcuguuuucugccuacaacuaacacaauuauuuauuauuuccuuguuuacuuuccacucucuaccacugucauuggcuccaugaaggcaugaaucauacaguuaugauccuccaggguagucccagagccugacagagcgacuaacacguacaagggacucaauaaacgcuuguugaaggaacauauugaaugaaguggaauuaauguuguuagaaaacugaaaagagguuacguagcuuagagauauaccuaagaaaauuauucagcauuugaugaagggggcugguguugaggaggcccauguguacagaagagcuuacgucuuugguauuccuuccucacucauguuagucgacgcucacguuuuggcggaauuuccucuugguacauuuauuccuucuugcccacaucucccaccuucaacuuuucuggccuuuauuucaacuaagugcuaggcuugguaauuuuccuaaugaucuggaaauggauugcucuuucacagaugaucacggauuggguugcccaagaccuggucauaagucacgacuugcugaaaagugagggaguuuuuugaaguggaaggggccuuuggaggucauccaggagcuuuugaaacagcuccagcagcugaguuaguaggcccaguaccuucccuggcaaucugguuuccugauuugcuacaagguauggagcuguuuaugaugcuuuugauagaaaauaaauggcucuuaauucuacuguaggaugaaguuuguauuugaaagguuugaauagguuuuucagaccacgguucuacaauugacuauaaaauuuuacagucugguuccaaggauauaaaagucugugauggagccuccucuccaggcuacaaguagaagaauucuaaaggcuguggcuacagcugagagacacuccaucuuggcauuggaaccaaaaauacauuuaacaaaagagucaauguagacaggcagguaaauuugcuugagacuacuucuaaaauuuaauuucaucuagaaggugagugaaauauuacuaauuagcacaucucaugauuuuuagagugaaaugcaaucagacuuguaagacacaauucauuuguaagauaaguuuauaugcaaagagacugacuuauaacuuuuuauugugccaguggacacaacgagauaccaucauaacaguggccuuuuggguaauuuggggaaauaaauaauaguuuuugaaaauauuugcaccaaaaaauauuuaaguguuaaaaaaaagccauuaaaaugguccuuuuuaguuaucuucagaauucacuuagauaguacuccaacauuugauauccucugacaaauaagguuugcugaagucuuucuugacagauuccuugacuggauguuuaacacagagucuacaauccugacaugugauagaaaccacuuccuagggaccaaacaacucugcacgugauuauguauuuaugugccucaagaauguugucaaguuggggcccuuuccugcucgccaucgcagagacaggcagccuucaauacacagguccaucacugccccuuacacauugguguuacagaggagaaaacugcuccccugccgcaugcacuggccugugaggcuuggacuugcccuggaaugucuccacuuugccucucugcucccugaugaaagucuagguaaucuuggccgggcacgguggcucaagcuuguaaucccagcagguugggaagccaaggcaggcggaucaccugaggacagaaguucgagaccagccugaucaacauggugaaaccccgucucuauuaaaacuacaaaaaaaaaaaaaaaauuagccggcaugguagugggcgccuguaauccuagcuacucgggaggcugaggcaggagaauugcucaaacccaggaggcagagguugcagugagccaagaucaugccauugcaauccagccugggcaacaagagugaaacuccaucucaagaaaagaaaaaaauaaaauaaaauaaaauaaagucuagguagucuuuaaggcccaucucaaaugucaucuccuuuguaaagcuuucccuucucuugugcuccccaugcaugacaggaagggggaagaggcugcuuugcaguccauugucacuuggcuccuaucucuaccaugacauuuaucuuaguguccugugcagagaagcagcaaagcauggagcuaugagcucaggccuucagauuccacacacugaguccugaauucuguuuccaccaguuaugaguugggagaccaguggaagaccaacauauaacuuaccucucugagucucaguauccagauuuuaaaacccagcacaaugagucuaccuaguuuacaagauuaggugaagauuaaaugagaucgugaacaaaagguaaucagcaacguaugugucauauggaaaguucucaauaaaaguugguuaguaccauuacuguuacucauguaagucaccuuuguguguugcaguagacucugagcuucauggcggaauccuucacagggccuagccuaguccuggugcauaguacuuuccuaguguuuguaaaugaauaggcgugauuguucucagugucuauuaaaugacaaggacuauguuaccuaaaagggcugacacgaccuuaguggccagacuucacucuuucuccuugccguuucuuugcucugcaauggccuaccuucugcuugcuaucccaguguuaaucgcacccucuuucaauuugaaaaguaguccaguuugggugauuuauuuaauggucaucuuaauuuguuuguuuguuuguuuugagacagggucucacucuguuuccuaggcuagagugcaauggcaugaucauaacucacugcagccuugaacuccugggcucaaguaauccuccugcugcggccuuucaaguagcugggaccacaggcacacaacacuacauccugcuaauuuuuugauuuuuuguagagaucgggucuugccaaguuucccaggcuggucuugaacuacugggcucaagugauccuccugccuuggccucccaaaguguugggauuagaggcguggugugagccacugcucccggccucauccugguuuugagaguuuucaucagcuugauucccauaaauuaaguuccucacuaugcaauauucaugccacacguggcaggcauuguggggagcauucagucacugcauggaauugauaaaaggguaaaaggauaaaaauugguucauucuuuauuugcucuuuucccggaaauaaaccaggaaagaauauuggguugaaccuaagaagacaggaaaacuggacugagaaacucaaccauuuggaguagugggauaaccuuacauggguagaacauuugagaauuuaguaauccaaaagaagauuuaagagaaagacccaagaaaaaccaaguugaguuuguauauguucuuuggcauagaucuucuuauaaauaguaucuucaggggauacuacagugaaauucaaagcaaaaacuaaguucagagucaaauauauauauuuauacaugaauauuuauauauauguauauauauauucagucaugugucacuuaacgacaggggacacauucuaaaaauguguuuuuagagauuucauccuuguacgagcaucauagagcauacuuacacaaaacaccuugccuauaugguauagccugcugcucagaggcuaccaaccuguucaggacguuacuguacugaauaguauaaagaaauaaacacagugauaaacauuugugugauaggaauuuuucagcuccauuauaaucuuaugggaccauaucauauaugcaguuugucuugaccaaaaugucauuauguggcacacgacuguauaauacauauaaacaaggcaaucuaauacccacugaguuagcccauauaaaaaaagugaaguauggccgggcgugguggcucaugccuguaaucccagcacuucgggaggccgaggaggguggaucuccuacaaauacaaagguuagcugggcaugguggugugcaccuguagucccagcuauuugggaggcugaggcaggagaaucacuugaacccaggagguggagguugcagugagccaagauugcgccacugcacuccagccuggccacagagugagacucagucucaaaaagaaagugaaguaugugcuuucuucauuaccucccagggcuccuuuucuuaaguucuuuugcucucuugggguuauacuucauccccuccccaugcacccuuuccugcacccccuccuccugggcagcccuuggcaacccagagcucuuugggucaaucuucaaauaucccagcaggauuuugcuuuuccaguuauauuccaaauuauggaauggaagguguuauucccuaauaagggaauuucagggggaagaaaagucacugggaaggcaauucaggaaugaggauaaugcccuggaagccaucuggaggcggcauauugaguggacagaaagccugggcuuuggagucaggccgaguugggucugaauucuggcuccuugcuuuuggcacuggagcucuggacuuucauuuguaugaaaaaggauaauaauaauaccuggcuugucuugagaauuaaaugagacuguguuuauaaaacaccuaauaauguguccaggucuuagucuagcaugaagguuaagaggaaguguuuuagaggcagacagaaaaagggccuaccuuuuccucaagggggagugacuugaugaucugguuucuggagaacgaggauaacaaugcaauugucacaggacuguuguuaaggcuuaaaugcacuggaagauuuaccugagugcuuggcauauaacaaauccuaaauaaguugugacgacuauaauaucaguuauuauaguagaauacuccaaauaaguguucugcuauuguguaggcugaaugaucgguaggcauuauuuuuguugucauuauuauuauugcaucaugaacauucuugaauuaauuugggagaugaagauccuacuugcuuaaauauaacuuagaauccuaagucuaaucaaucaucacauauaauaaguguuauguaggucuuagucaguguuuaagauauccauuauauuuucccacaggaaaaguuaaggaaaugcgaaacuauagaggaauuacucaacuuuucuguccuaaugacuauggaccaaaggucauucauugguguaugcaaucacccuauaaaacaagguggcuugccgggcacgguaguucacuccuguaaucccagcacuuugggaggcugaggcagguggaucaccugagaucaggaguuugagaccagccuaaccaacauggugaaaccccaucucuacuaaaaauacaaaaauuagccggucauagugacacacaacuguaaucccagcuacucaggaggcugaggcaggagaauugcuugaacccaggaggcagagguugcggugagcugagauugugccauugcacuccagccugggcaacaagaaaaaacucugucaaaaaaaaaaaaacacacaaggugacucaaucuauuucuaaugccaucucaggcuguugagagcaguuuagagcauuccagguaagucuuugacacaggauuucaauucagcugccguuagucacguagauguacccaaacuuacgcucugauagaaaaacaaacauuugguuaucuccuugugcauacuucgggcagagagaaaaaaaggaccugaccuuuugauagucacuuucuccguccugcauucuggccagugcacaaguaaauaaaagcuggaaacuacuggccugcucuguccuucuuucucaugaacugaaauucagccagugccagauaggaaaccagaaacggaguauuacuacucuacuguggcgcauucccuuccuaggaucauauuuuuccaaagaacuacaccugaaugugucuugcuuggauuccaagaauccauuuuaaugaccgugguuacgauccuuuagaagaaagccaggaaugagaccgcugucucgggugugcaacagagcucaggagccagggcucucagagcacagauugccaaagggcacuccugagcuacaagcaagcaaaucagcgggguauuuagaugccacaaacuguaugccuguccuuguaguuccaggagcuaggaagaaacuuucacagcagagcugcuaugcugucacgacaacaaaacuaaacugcuaagaaagugaugugagagcugggaacugcugagaauaacaagcacauaaucucuucuaguacgauacgugcuccacagucccugcugagcaaaaccaguguuucaaacgucccuuuccgccuugcucccgccucauuuuacucaaaggucaccuuuaauauugaauguggcuguuuguuuacauguuuguuucuccuagugaccugggagcugcugagaggcaaggacuaggucuuaugcuuuuuuauauucccaaugcuuggcacauuguagaaacucaauaaauguuuguugaauacacacaaaucagaacucugaugaaauaggacuaaaguucuaagcggauggcugauuuguuagcauuaucugugucuuuguuagauuuuuuaaauuaacagagccuuacuuucaaaucuccaugcccaaguugcucaucuuuucaugcacccccgaaacauuuucuaagcaacuacccucugccagcuacugagggguuuacacagauggaaaauauauuuucccuuccuucagugagauuacugagagugucauaaacuacacucuauauauucagaagccacccuaauaaauauuuuuggauuuauuugauaguuuuggcugucaucugaaacagaaaaucaguucaacaccacugcaguuaauaucgacuaaacagcuccgaaccucaauuggccaacguuuuaaucauauggagacaauuugaauuuuacugccaucaagaaacaacaggaauauuuaaugcaagaauuaggaaugcauacugguuuucacggugcagcuugguaauuaugaaagcacacuuucuuguugucguuaaagggacuuuugguagccaaacuauuguucugguguguggugagucaaaagaccccaauggccucucugccuuugaucuuuuaaaugucugaaguugugggauuuugcaugcuacacugauaaucugggaaaauguacaaucacuauaaaaggaaauuuuucuauuaguccaagaguaaucauuuauagcaaaaccaccugacagaaacauguggguacauaucacccuuaugaagaccaaagauauuuuuacaacugaggauuauuuucuucccuuuguacaaauccauauggugccuuuucagacaucagucaucagcagugcugucucauucaaccccaagaauagagcucaggaguuuugcuccaaauuuggauaaaaagaacuugguauuaggaguuaguuuuuuuuaucuucccuggccuaauuacucaaagucaguggcaugugaacugaaguggaguaggauggcaagaauaagugaguagccauggaauauggcuuuucugccuuaggcauacucugcuugaucuaugcccugcacugugcugcuuucucuucuggagucaaaugucugcuugucucuccaaagaauaauacuugccccauagugcauaguccaucuggcuacugacuuucauagugcucucaaaauaccacggagaagaguggcugcacuuuauccauucacuuacccacccauccauccauccauccauccauccacugauucauucaauaaagaguaaguggucgggugugguggcucaugccuguaaucucagcauuuugggagaccgaggcaggcagaugacucgaggucaggaguuugaggccagccuggcuaacauggcgaaacccgauaucuacuaaaaacacaaaauuagccuggugugguggugcacgccuguagucccagcuacuugggaggcugaggcaggagaauugcuugaauccaggagguggagguuccagugagccaagaucaugccacuccacuucagccggggcaacagagugagacucugucucaaaaaaaaaaaaaaaauacaacaacaguaagugagggcugugucuacuauuuauugggaagucuaucaucccagguggcugccugguucugugcaugugugguuccagacauaaaaaagggauggggugagcagaggaaguguugugccaauaugaucuggcuaaagaagaacaggauguuuuccuccagggagugacuuuccucugacaaacagaaggggaaaagcucuggauggacacacucauuucuuucccugaauccgguccagaggcugcauuuguugguugaaagucuaagcaugaccaaauaaaccaguccaaaugggguauuuggaauagaggaaacgcaaguuuggggaagggaaaaaaccuucgcagagaagacugaucuuuugguccagaaagaagagaagaagagucauagcuauuacuuugauaagucaaaauguaccacaacacuugaaaaccugggaaggguagucacuggccagagcugcugcuuuauccaucacaccagcugaaggcaucacugggcuucuagaaaugauuaggacuguuucaguggaccucggccuuggagcauccaagcuccgggauaauuuaguaccacagugagcacuagggaaaauaauccaaaugaaacaacaacaacaaacuuuguugcauuuauaugaaauccuucuauugcccccaaagcaaaaugauuucucccccagucuggcacauauccugcagcuguaccuuggaccuuuguguaaucuaucuugcaacacuucauguaccguugguuuagggucagccuaaugguggaggcucaaaagggaguaugguguaguagaaagaaggguagacugggaaugaggaaaccuggguucgagugcuaauuugacaacaagguaguuugcagucuuaaaacacacaacuuuuugggcuaucgcuuccuuauguguaaaacgagauuacguguuuuccuuuuaucuuggaaacucuugauuuggaaggcaucaaacauccaacauguaucauggaguggagaaagcagaaaaaaaaucgugaaaaguggcacaguguaaauuucccagaccuuuacaggagcacucagaucaucuuccuuugaaauaacaguucacuaauccaacacucaagguaccuauguguccaugucuuuaccaguucuauccgguuuuuaccuuguguuuuuauuguuuucuuuucuuuuuucuuuucuuuuuugagauggaguuuugcucuugucaccuaggcuggagugcaauggcacggucucggcucacuacaaccuccaccucccaggcucaagcaauucuccuaccucagccuccugaguagcugggauuacaggcgcccaccaccgcacacggcuaagauuuguauuuuuaauagagacggggcuucaccauguuggccagucuggucucgaacuccugaccucaggagauccaccugccucggccucccaaaaugcugggauuacaggcgugagccaccgugccuggcuguguuuuuauugcugacaugcaugucucuccuuccccaugaacuauuagcuccuugaaaaagugguccgucuuuugaucuccugcuauuucuagcucugguuccauaaauaauuguugaaugaaucaaugguuuuguuuagagugcuugauuagcucuuccuccaaauaauuauuauuuccauuucaaagauaaaauucaggcccaaauauuucaauuuguuuaucucaguucacaaaauuagauuugaagccucaauuccaaaguaguaauaguaauaaacuguucuuccagcaaccuucacagaaacauucugaagaccuuugcuucucagccccaauucacuaauaucaaaagccugcaaaauaauaauaguuacaguaacaauaauaauugaguuuuuaugccuguaugaaaagcauuaucucacauaauucguaagacagcgcuauacaacuucagaugaggauuacugauacaaagugauaguuccacacagauaggaacaaagccagguuuauuugacuucaaaauucaugcuccaaaccaaugguacacaucccucuguuugacuacccacccaacauaaccuacauggagucuuaugccugugucuccaguuugaagccuaagauaaugugaggacauagagccaaaguuauuaagggaaaaagcuucuuaagcccucagucugaaugcuuauuuagccucugugaagaggcuguguaaaguuaggaaauuuacugcaccucagugagcuucaguucuuuguugguaagauguggacaacagcauuuaccucaaaaagauguuacaaaagcuuauuaagauauuguguguuaggcccggcacgguggcucacaccuguaaucccagcacuuugagaggccgaggcgggcaucucuccugaggucaggaguucgagaccagccuggccaacauggcgaaaccccgucucugcuaaaaauacaaaaauuagccaggcaugguggcacaugccuguaaucccagcuacucuggaggcugaggcaggagaaucgcuugaacccgggaggcggagguugcagcgagccaaggccgagauugcaccauugcacuccagccugggcgacagagugagaauccaucucaaaaaaaaaaaaaaaaaaaggauauuguguguuaaaauaccuggaacauauaguaagugcucaauaaauccucucuugccccccugccuacuuuuccuuucagcaaaagcaauaccuuccaaaacuaguuccauaaccuuauggauaugaaggauacacuuguaggaauaucuuggcauccuuuaauacagagaaguucucagcuuagguaccaaauaaaacacuuugccucccuagaaauuuucagagcuugcccaggccccuaaaagcuauuuucugucaacacuuccacuaagcugaacaggaagagagguugcuugucuuaucauuaacagaauucuuuucugagguuuuuauuuggguacuuagugggccagaauuuaacauuaucacuccaucccaugauacuucagcugaguaaagucagaaguauucuuucuuauauguuuuuuccuuaauuuauuuuuuuuuaaauggggccauugguucuguaacaauagugaccucuacagggacauuuauucauuuauucaccaaacacuaagcauugugauucucuguaacauauaagauaaaaauaguuauaauuccuuaaagagcucacaucguagcagaagagaaaagagcaugaaaagagaauuccagccuguaaucccagcacuuugggaggccgaggcaggaggaucacgaggucaagagaucaagaccauccuggccaacauggugaaaccgcgucucuaauaaaaauaaaaaauuagccgggcauggugacagagccuguaaucccagguacuugggaggcuuaggcaggagaauugcuugaacccaggaggcagaguuugcagugaucugagaucccgccacugcacuccagccuggugacagagcgagacugaucucaaaaaaaauccagcacuuugggaggccgaggcaggcggaucacgaggucaggagaucgagaccauccuggcuaacauggugaaaccccuucucuacuaaaaauacaaaauacuagccgggugugguggcgggcgccuguagucccagcuacucgggaggcugaggcaggagaauggcgugaacccgggagguggagcuugcagugagcugagaucgcaccauugcacuccagccugggugacagagcugcgacagagcgagacucgucucaaaaaaaaauaaaauagagagaauuccaaggcggugaaugcggugcggugcggagcuaucaaugggaacucaugcagauaggcugugacuccagggcaccagccacaccugaucaucaacugcggccuugagccauucaauucacucauccaacaaguaauuacuggugcuugagaccauccaguuucaaauacaaagagaaguggcaugagguauacacucagggacucuucccucuuuauagaagccauuugacucaaacuagagcaaauucaaguaaacggaagagauacacaucuccucuucucuuucucuugagccuaaagagccucaguguuggguuuuaccaucaaggcccaacuccauaucugaggcauggcuccucucccauccaucucccauccaucucccauccaucucccauccaucucccauccaucucccccuccagcacaaacuucauuggcucacauggcuacccaucccauuuaagacagcugaagguguuagaaagguugacaucaaauuuacugcccuacugugugggauuuuuuaccuguucuuccccauggacugccuuaaagucugaugaaccuuaaugauuccuucucagaauaauguuuuuaaauucaaaaaguauauacuauuacaaggcaagcuauauauacauacauauacauacacacacacauauauguuauuguguuauuauauauguauuuuauauaugcuauuguguuauauauguauuuuauauauauauauaugcuauuguguuaguccauuugcacugcuaucauggaauauccaaggaggcuggguaauuuauaaggaaaagagguuuauuugacucacagcucugcagauguacaagaaacauggugcuggcaucuucugcuuggcuucuaaugagggccuuaacaggcuuccacucacggcgagggguuaaggggaggcaggggugucacacaguaagagagggagcaggagagaaggaagggaggugccgggcucucuuuaaagaacgagcuuucaagugaaugaaugcacugagggagaacccacucauuaccguggggagggcaccaagccauuaaugcgggaucuacccccaggaugaaaacaccucccaccaggcccuaccuccaguauugggggucacauuucaacaugugauguggaggggacaaauaucccaauuagaucagcuuuauauaacuauacguauguguguguguguguguguguguguguguauaaaauguaugauauacaauugucugguccuguuuauaagggacuaaauaaugagaucuaaaagcagguaugaucacuuccauaauuuucaaguaguuuuaaguacuagguaaguguaagugauauuuugagacucugguaucaacuguaacaugaaaguaauucugauuucuauuggugacaaagcugugauuccacugauguuacugugguuuguuacauucguaacuaaagagaaugugauauuucaguuacagguaaguggaagucaagaagcaauuuuuuuuucuaucaaaugucacagauuccccucaauucuuauagaacaccaaaguaggcugggcaugguggcucccgccuauaaucccagcacuuugugaggccaaggcaggaggcucgcuugagcccccgaguucgggaccagcuuggcaaacauggugagacccaucucuuuguaaaaaguaaaaguagagguuccucuucaaagacuuuccuccccaucuaauuaggaauaaauaguaacuucucuuagaagcaaaauuuauucagaccugugcuccuaaauauuugcccuggcaugcuuauacugguccaagcaagcauuaggucauagccuguuccucuuccuuauuuaaaaguguuuuuaccuuucucagcauuccacaaguuacuuccuccuuccuuuguucuccucuaccuuugccucuuuuaaaaaguucuaaguugcuagccaaucgggacaaauacagaaugugaggucccguuccagccaauggaaaccagacacagcaguaggauggaugcgucagguuauaaaugacccuguuuccuuuguucaguguacucucguggcaaaacugcuggcgaguguacccuuucuacggaaguaaaaauggccuuacuaaauauauuaaauuuauguucaagugcuauuucuuuauggcaccaaggaacaagcauuccaaacaucuccaaaaaaauugaaaaauuagccaggcaugguggcacaugccucuagucucagcuacuucggaggcugagguggggggaucacuugaacgugagagguugaggcugcagugagucgagaucaugccacugcaccacugcacuccagccugggcagcagaaugagaccuugucucaaaaaacaaacaaacaaacaaauaaaaaaucaccaagguaaaaaguauccuuauagagauuuuuuaaaaaucuaaccucugaaaaccacauagaacaaauuaguccccuuaaaaacucuccugcaucuccuaaauuaaaucuucuaauccaaaaaucacagcguuuccagaauuuucaguaaucuuaucauuuucuucugcuugagcaagaauuuguuaauuuccaaggggaagcaaugagcccagaaagucagcgugcauuccagguuguuaugaacaggccaucccaggggaaugacagauaaauuuacaggaacaccuuggcauucucuaauaauaaauaaauaaauuuucuucuacuuggaaaaacaaaaccuaucaaaauuguugauuuaguauuuuaaugucuaagucguaaauuuuuaaaaaauuaauugauuuuucaugacauuuuuauuuucucacugaaaugaucauuuuaaacauuuaggagucuguagcauaagggauaaauaacacaagacaaaaagaaaaaaaacaaaaaguucccaggacaaaagacuggguuugucauuuguuuagccuaugguagauguguguguuuagaauuuuuugaagacugugucuuucagcagauaagcagcagucucugauccuagcucuaaauuagcugcagcuggaucucaauagauucagaucagaaauaguuccuuaagcaucaguuuugugcugagaaauaaaaagaagaacaagaaauagccucugcccucaggggagcuugaaaguuagugaaagauguaaacauguuacaaaaauaauuauacaaggaagacuaaaaccauauuaaacuccaguggaaaaaauaucugaaaugauguaaagaaaaaauuugagcuauuacaaugaaaagacuuguguugucaaauggcuuuguuaguaaggccaaaacaaugccauagauuuucggaggauccugguuauaauacccaacaaacaccacuguaaucauuagguuauuccuggucuuuccuacuaguauugagcucuuuaagguaccuuaacugucuucuucacuauuaugcccuauaaucuugaacacugcuuuaugcacauaguaucuuuucaguacuuguaagugaaugaaggcacaacauacuagaggaaguguggaagaguuaagauugaaacaguucuuuuuuuuuuuuuuuuuugagguggaguuucgcuccuguugcccaggcuggagugcaguggcgcgaucucagcucacugcaaccuccaccucccagguucaagccauucuccugccacagccucccaaguagcugggauuacaggcgugcaccaccaugcccggcuaauuuuguauuuuuaguagagacgggauuucaccauguuggccaggcuggucucaaacuccugaccucaagugauccacccaccucggccucccaaaaugcugggauuacaggcgugagccacugagcccugccagauugaaaugauucuacagcaugcuugacugugucacuuuuugaaagcucuaagucuuaguaaugucaucuguaaaugaggauaauaacacuacuagcuaagauuuuuguaaggauuagaugauaccuauaaaauguuuagcaaauaaucauucuuuaacuaacaacugucagccauuucucagagggaagcacguagaauugauguuuacagcuggaaugaagcccagugagccacuuccgccuucucauuguaaagaguaaacucaagagagaguguagacuuuccccaaggaugugaaaaauggaaacaggugcaaacccaggucuccugaguuucuuagguuaaauuuuuuuuuucauaauuacuagauaacucucuucuaggucaaaaaaagucuuaauacuauuagacccucugacagaaagugaugcuuuuugccuguuuccuucaaaguuuacauucucugaguucauagaaaugacauuguaaguguauuuuccauaccauuggucaaguugaagucuuaaauacguauguuugaagacacauauuucugcauugcuccaaguuuucauaaggaaccaugaaagguggucucugcaggccaggggauggugccuccagacacugagcacgcucuuagcagagaaguuaaaguuuacacagaucuauguugcucucaaguagugggccugagggugaauauuuuucaucuguuuuucgucuauuagauggaugauaaacaucugaucaaauccacuccuguggaucugaaacuaaaucaaucaauauuccaucaugauugaaaucauauauguaaauucaaucauuuaaugaugggcuagugcuauagaagauguuugcuguuauuguuuuugcauaugugaauaacuggcaggaauuaaaugcaagaaugugugaaauaaacacaagaauguaugugaaauacaggaauuaaacacaagaauguaugugaaaauauaauguaaaggacuauacuaguaaaagcaaccauacuguugaugauuaauuguuauuaucuuauaauuauacaaagagacucaauagauaucuguugaaugcaugccuguaggacugacugacugaaggaauauguucucagcuaucagauguuacgguuacaagaaauucucaguaaaacuugcagaagauaaacuccugagacuguggugaagacugaauuaaauaaucugugagaugugucuacucuaaucuggcacaugguaugcauucaacaaauguuagaacaaucuuaauuuuuaaacauuaucaauaagagaaaaguaaagaucguuugaaaugcugaugagauuuaaauuccuagcaaaggcagagaaaucucauuacagagcugcuggauuuuuauuaacucuaaguacaaugucacacauccaucaacuuucccaaaacguagcuaccauaauuagaaaauacaaugcauuauccaggguucguguuauaauugcauaaaagcagagagaagcagcuaguuuuccauagaugauaagauuagcuuccucucagccuuuacagucacaccuauagagccagguugaauaauauuuuuaaugcagacaauguuuguucuagacgaagucaacuuagcauuucauaggagcuggucaaguguuccccugcuugaauaggcucaaaggguaaagcuaauuaaaagaaagggaaauugaguucacugugaaauaugcugcugcuuuucugauuuugccagguagcaccaauucuggaggccaaaauagaaacaaacccuucuggauggugugccuuuacuaagacucuagaguuggcucuccaaagggaagagggcacuucaaguuggagggagauuuuuuagccauuuggcgaccggagucuuccucauggucagggggagguaucaaaucacuuuuucagaguuugcaugcugcccucuccuggccuguauagacaggaguguuacaguacaucaaaugcauuuauuuuccccccacaccugugugggauauaccuaagaacacaagagaguuuauuuaaaauauucaggaugucucaucaaaaauguauacuugaagcuaaucaaaaaucuauaucugaagguaauuagaggaaauacauucauuuucauuuuccuuuggcuccaggauuuauacugaagcaugucaaucuuuauaucaugucacuuuauacccuugugcuuccacccgcucacguuccauccccuuaacauccauguggcucugggacucuguucuacaaaucagugcgccaacaccgucugggucccaucaaugugcuggccacuuaaagacaucuuuccaacuggaagugguggugaugggaaaucugcucaagucauuggucaguguugagucugaggaccacauuuuagccugacaugugaucaaaauuaauucuagacauuauuaggccuauuauaccuaauauuauuagaaacaaaagaacuaucaagaagcagcuaauccaagaagaagauggcaccauaggucuaauuuuuaauugaacaccuuguccuucaaaacaaugucuugugugacccauuuaagccgagugcugggcacguuuucccugguugaaauaauucuuuuuuguccguagauauuugaaggacccugauacugagaacaugccugcaaccuggcacguugcacaggggcaauugcuguagcaacacugaaguacaaaaguggcugaacuaaucuguugagugccugugccucugcagucucucagugucugcccuugacccagacaggccaauccucuccauaucaauaagaacugagagucuaauaccauuccuuugcauuagaaaaagagauguuuacuuuaaagagauuuaaaggcauguaccuuguuuaaacuuuaccaaacuuauaacucgaggguauguaaagcucuggcuggcucuacuaagauucauagagaaugaacuguugauuaccucucucggugaagaaugauagcaaaaaacaaugaauaaucacagcauuguuuauauuuaucuuugaaaagccaucagugucuccuagucuauacaaagugaauauaauccgucucacacucacaaaguugcuaccaacacacccaacauugcuuuagaguuagaaagauaagacagaaauaggucccaacuuauugcagcuauuuuauuuauaaaagauugacaaaugcucacaaucauacaaaacaacucuuuaccaauagaauguaguugggucgauuaacuuauauuuauuugcacagaucaguucuuuacaguuucuuucugauguaaaaggaaaaaaaauuuaucuauaaaguuaaaaugccuucucccaaauauaauauucacuugccaugucuauacuuugacacgauuucaaaaagcacccaguuaaaucauucagaucagucgaugggcaaaaacuaugaaguuuuccugacucuaugguagagcuaagcaugcauuuccuuuaaugacagaaagaacauguucaucugauaagaaacaaaaaacaaacaaacaaaaaaaggucgauauaaauucuccacugugauauacaacacaaauaccuuucuuauaacuuucuuaucuuccuuggucgggcacaugucuugggacaaaggcuaccuugaaagcuaagcacggcugaauggugagucgauugcgaauuaucagugaaugguuuggauaugaucgacuaagacuccacugggaagagugcuguuuagacgaaagguaagguauuugauugccccugcaccugcugcagagccauucucuggcuguacuggagucccaaucuguuccacugcagaaaaagcgcuuuucauagggauucagagccacaugaauaccagccagcccuugaagacugcaaagcaagaccaauuuuuuaacugacuucuugcaguccccucuggcuuuucccaggaaagacugaacucauuaagcaaugcuaauuuaaucacaagucaucaagggguggggaguuauauaacuaucuuuaaaauuucaaaucaaacaugauaaaaucucaggaaauagauuuuuuuaacaaaacccacaccucaaaauaaaaaaaaaaaagaaauagaaguuuaugaguuuuaggaucaaauaaaauaaaaucaaacaucaauauuuucuuacaacuaucacaucuacuagauaguuccaauucaugacuuuuuaauguaguaauaugugagauccuggaacugaacgugccuggcgugcagaauacaaaugcauuuuuaaacucguaagacaauguagaaauaagucagguacacaggaaggaucacugacaaucacguuaaaaaauaacuaccucccuucucucuucuccuucaaccacagcguagugauaauagugauauuucccucaugaggcgggugcaccuuggccauaugcuuuaaaaaaucaaaacucugccgaaguccgcugugguuccuauuccuguagggaggauauuaaccugguagguaggugggagagguucguagcccgcuuucuaacaauuggaugguguuugccucgcuauagucaugauuagaauggcggucaccaagagguauuuauuggugggaugacaacauauugguauugacguuauuuaaaagagaaagaaagagcgaucacggucaaguuugaagguccuuauguuacacccacgcauaauucaauaggugaauaaaccuuguggcccccagacacacgccaacagcuugaauuacccggggugaaaccggcgagacguccacucagggcuuucgguccugaccagccacggaacaaacaacgucaauucauucuaagugccuggugaagguagaaaucagaaaccgugucugugucacguuagucgugacaagcugcguaccugcaaugacgugauggaagccuccuccucgggucccuucucucucucucucucccucucccucugccuucucugaguucucuaguccacagcggggucuaaguuuggucucccgccgccgcuuucaguucgaccgcagccagacugcagcagacgcccauaagagaagcgcgccggcugagggugcaggagaggcgagagcgcgccccgcgccgcgcggucccaggcuggcugcuccugcagaugugaaaggagcccggagacuuagcucugaauccucucggcgcugcaug

SEQ ID NO: 12980 - RNA, 122224 nt, Homo sapiens
caugcagcgccgagaggauucagagcuaagucuccgggcuccuuucacaucugcaggagcagccagccugggaccgcgcggcgcggggcgcgcucucgccucuccugcacccucagccggcgcgcuucucuuaugggcgucugcugcagucuggcugcggucgaacugaaagcggcggcgggagaccaaacuuagaccccgcuguggacuagagaacucagagaaggcagagggagagggagagagagagagagaagggacccgaggaggaggcuuccaucacgucauugcagguacgcagcuugucacgacuaacgugacacagacacgguuucugauuucuaccuucaccaggcacuuagaaugaauugacguuguuuguuccguggcuggucaggaccgaaagcccugaguggacgucucgccgguuucaccccggguaauucaagcuguuggcgugugucugggggccacaagguuuauucaccuauugaauuaugcguggguguaacauaaggaccuucaaacuugaccgugaucgcucuuucuuucucuuuuaaauaacgucaauaccaauauguugucaucccaccaauaaauaccucuuggugaccgccauucuaaucaugacuauagcgaggcaaacaccauccaauuguuagaaagcgggcuacgaaccucucccaccuaccuaccagguuaauauccucccuacaggaauaggaaccacagcggacuucggcagaguuuugauuuuuuaaagcauauggccaaggugcacccgccucaugagggaaauaucacuauuaucacuacgcugugguugaaggagaagagagaagggagguaguuauuuuuuaacgugauugucagugauccuuccuguguaccugacuuauuucuacauugucuuacgaguuuaaaaaugcauuuguauucugcacgccaggcacguucaguuccaggaucucacauauuacuacauuaaaaagucaugaauuggaacuaucuaguagaugugauaguuguaagaaaauauugauguuugauuuuauuuuauuugauccuaaaacucauaaacuucuauuucuuuuuuuuuuuuauuuugagguguggguuuuguuaaaaaaaucuauuuccugagauuuuaucauguuugauuugaaauuuuaaagauaguuauauaacuccccaccccuugaugacuugugauuaaauuagcauugcuuaaugaguucagucuuuccugggaaaagccagaggggacugcaagaagucaguuaaaaaauuggucuugcuuugcagucuucaagggcuggcugguauucauguggcucugaaucccuaugaaaagcgcuuuuucugcaguggaacagauugggacuccaguacagccagagaauggcucugcagcaggugcaggggcaaucaaauaccuuaccuuucgucuaaacagcacucuucccaguggagucuuagucgaucauauccaaaccauucacugauaauucgcaaucgacucaccauucagccgugcuuagcuuucaagguagccuuugucccaagacaugugcccgaccaaggaagauaagaaaguuauaagaaagguauuuguguuguauaucacaguggagaauuuauaucgaccuuuuuuuguuuguuuguuuuuuguuucuuaucagaugaacauguucuuucugucauuaaaggaaaugcaugcuuagcucuaccauagagucaggaaaacuucauaguuuuugcccaucgacugaucugaaugauuuaacugggugcuuuuugaaaucgugucaaaguauagacauggcaagugaauauuauauuugggagaaggcauuuuaacuuuauagauaaauuuuuuuuccuuuuacaucagaaagaaacuguaaagaacugaucugugcaaauaaauauaaguuaaucgacccaacuacauucuauugguaaagaguuguuuuguaugauugugagcauuugucaaucuuuuauaaauaaaauagcugcaauaaguugggaccuauuucugucuuaucuuucuaacucuaaagcaauguuggguguguugguagcaacuuugugagugugagacggauuauauucacuuuguauagacuaggagacacugauggcuuuucaaagauaaauauaaacaaugcugugauuauucauuguuuuuugcuaucauucuucaccgagagagguaaucaacaguucauucucuaugaaucuuaguagagccagccagagcuuuacauacccucgaguuauaaguuugguaaaguuuaaacaagguacaugccuuuaaaucucuuuaaaguaaacaucucuuuuucuaaugcaaaggaaugguauuagacucucaguucuuauugauauggagaggauuggccugucugggucaagggcagacacugagagacugcagaggcacaggcacucaacagauuaguucagccacuuuuguacuucaguguugcuacagcaauugccccugugcaacgugccagguugcaggcauguucucaguaucaggguccuucaaauaucuacggacaaaaaagaauuauuucaaccagggaaaacgugcccagcacucggcuuaaaugggucacacaagacauuguuuugaaggacaagguguucaauuaaaaauuagaccuauggugccaucuucuucuuggauuagcugcuucuugauaguucuuuuguuucuaauaauauuagguauaauaggccuaauaaugucuagaauuaauuuugaucacaugucaggcuaaaaugugguccucagacucaacacugaccaaugacuugagcagauuucccaucaccaccacuuccaguuggaaagaugucuuuaaguggccagcacauugaugggacccagacgguguuggcgcacugauuuguagaacagagucccagagccacauggauguuaaggggauggaacgugagcggguggaagcacaaggguauaaagugacaugauauaaagauugacaugcuucaguauaaauccuggagccaaaggaaaaugaaaaugaauguauuuccucuaauuaccuucagauauagauuuuugauuagcuucaaguauacauuuuugaugagacauccugaauauuuuaaauaaacucucuuguguucuuagguauaucccacacagguguggggggaaaauaaaugcauuugauguacuguaacacuccugucuauacaggccaggagagggcagcaugcaaacucugaaaaagugauuugauaccucccccugaccaugaggaagacuccggucgccaaauggcuaaaaaaucucccuccaacuugaagugcccucuucccuuuggagagccaacucuagagucuuaguaaaggcacaccauccagaaggguuuguuucuauuuuggccuccagaauuggugcuaccuggcaaaaucagaaaagcagcagcauauuucacagugaacucaauuucccuuucuuuuaauuagcuuuacccuuugagccuauucaagcaggggaacacuugaccagcuccuaugaaaugcuaaguugacuucgucuagaacaaacauugucugcauuaaaaauauuauucaaccuggcucuauaggugugacuguaaaggcugagaggaagcuaaucuuaucaucuauggaaaacuagcugcuucucucugcuuuuaugcaauuauaacacgaacccuggauaaugcauuguauuuucuaauuaugguagcuacguuuugggaaaguugauggaugugugacauuguacuuagaguuaauaaaaauccagcagcucuguaaugagauuucucugccuuugcuaggaauuuaaaucucaucagcauuucaaacgaucuuuacuuuucucuuauugauaauguuuaaaaauuaagauuguucuaacauuuguugaaugcauaccaugugccagauuagaguagacacaucucacagauuauuuaauucagucuucaccacagucucaggaguuuaucuucugcaaguuuuacugagaauuucuuguaaccguaacaucugauagcugagaacauauuccuucagucagucaguccuacaggcaugcauucaacagauaucuauugagucucuuuguauaauuauaagauaauaacaauuaaucaucaacaguaugguugcuuuuacuaguauaguccuuuacauuauauuuucacauacauucuuguguuuaauuccuguauuucacauacauucuuguguuuauuucacacauucuugcauuuaauuccugccaguuauucacauaugcaaaaacaauaacagcaaacaucuucuauagcacuagcccaucauuaaaugauugaauuuacauauaugauuucaaucaugauggaauauugauugauuuaguuucagauccacaggaguggauuugaucagauguuuaucauccaucuaauagacgaaaaacagaugaaaaauauucacccucaggcccacuacuugagagcaacauagaucuguguaaacuuuaacuucucugcuaagagcgugcucagugucuggaggcaccauccccuggccugcagagaccaccuuucaugguuccuuaugaaaacuuggagcaaugcagaaauaugugucuucaaacauacguauuuaagacuucaacuugaccaaugguauggaaaauacacuuacaaugucauuucuaugaacucagagaauguaaacuuugaaggaaacaggcaaaaagcaucacuuucugucagagggucuaauaguauuaagacuuuuuuugaccuagaagagaguuaucuaguaauuaugaaaaaaaaaauuuaaccuaagaaacucaggagaccuggguuugcaccuguuuccauuuuucacauccuuggggaaagucuacacucucucuugaguuuacucuuuacaaugagaaggcggaaguggcucacugggcuucauuccagcuguaaacaucaauucuacgugcuucccucugagaaauggcugacaguuguuaguuaaagaaugauuauuugcuaaacauuuuauagguaucaucuaauccuuacaaaaaucuuagcuaguaguguuauuauccucauuuacagaugacauuacuaagacuuagagcuuucaaaaagugacacagucaagcaugcuguagaaucauuucaaucuggcagggcucaguggcucacgccuguaaucccagcauuuugggaggccgagguggguggaucacuugaggucaggaguuugagaccagccuggccaacauggugaaaucccgucucuacuaaaaauacaaaauuagccgggcaugguggugcacgccuguaaucccagcuacuugggaggcuguggcaggagaauggcuugaaccugggagguggagguugcagugagcugagaucgcgccacugcacuccagccugggcaacaggagcgaaacuccaccucaaaaaaaaaaaaaaaaaagaacuguuucaaucuuaacucuuccacacuuccucuaguauguugugccuucauucacuuacaaguacugaaaagauacuaugugcauaaagcaguguucaagauuauagggcauaauagugaagaagacaguuaagguaccuuaaagagcucaauacuaguaggaaagaccaggaauaaccuaaugauuacagugguguuuguuggguauuauaaccaggauccuccgaaaaucuauggcauuguuuuggccuuacuaacaaagccauuugacaacacaagucuuuucauuguaauagcucaaauuuuuucuuuacaucauuucagauauuuuuuccacuggaguuuaauaugguuuuagucuuccuuguauaauuauuuuuguaacauguuuacaucuuucacuaacuuucaagcuccccugagggcagaggcuauuucuuguucuucuuuuuauuucucagcacaaaacugaugcuuaaggaacuauuucugaucugaaucuauugagauccagcugcagcuaauuuagagcuaggaucagagacugcugcuuaucugcugaaagacacagucuucaaaaaauucuaaacacacacaucuaccauaggcuaaacaaaugacaaacccagucuuuuguccugggaacuuuuuguuuuuuuucuuuuugucuuguguuauuuaucccuuaugcuacagacuccuaaauguuuaaaaugaucauuucagugagaaaauaaaaaugucaugaaaaaucaauuaauuuuuuaaaaauuuacgacuuagacauuaaaauacuaaaucaacaauuuugauagguuuuguuuuuccaaguagaagaaaauuuauuuauuuauuauuagagaaugccaagguguuccuguaaauuuaucugucauuccccugggauggccuguucauaacaaccuggaaugcacgcugacuuucugggcucauugcuuccccuuggaaauuaacaaauucuugcucaagcagaagaaaaugauaagauuacugaaaauucuggaaacgcugugauuuuuggauuagaagauuuaauuuaggagaugcaggagaguuuuuaaggggacuaauuuguucuaugugguuuucagagguuagauuuuuaaaaaaucucuauaaggauacuuuuuaccuuggugauuuuuuauuuguuuguuuguuuguuuuuugagacaaggucucauucugcugcccaggcuggagugcaguggugcaguggcaugaucucgacucacugcagccucaaccucucacguucaagugauccccccaccucagccuccgaaguagcugagacuagaggcaugugccaccaugccuggcuaauuuuucaauuuuuuuggagauguuuggaaugcuuguuccuuggugccauaaagaaauagcacuugaacauaaauuuaauauauuuaguaaggccauuuuuacuuccguagaaaggguacacucgccagcaguuuugccacgagaguacacugaacaaaggaaacagggucauuuauaaccugacgcauccauccuacugcugugucugguuuccauuggcuggaacgggaccucacauucuguauuugucccgauuggcuagcaacuuagaacuuuuuaaaagaggcaaagguagaggagaacaaaggaaggaggaaguaacuuguggaaugcugagaaagguaaaaacacuuuuaaauaaggaagaggaacaggcuaugaccuaaugcuugcuuggaccaguauaagcaugccagggcaaauauuuaggagcacaggucugaauaaauuuugcuucuaagagaaguuacuauuuauuccuaauuagauggggaggaaagucuuugaagaggaaccucuacuuuuacuuuuuacaaagagaugggucucaccauguuugccaagcuggucccgaacucgggggcucaagcgagccuccugccuuggccucacaaagugcugggauuauaggcgggagccaccaugcccagccuacuuugguguucuauaagaauugaggggaaucugugacauuugauagaaaaaaaaauugcuucuugacuuccacuuaccuguaacugaaauaucacauucucuuuaguuacgaauguaacaaaccacaguaacaucaguggaaucacagcuuugucaccaauagaaaucagaauuacuuucauguuacaguugauaccagagucucaaaauaucacuuacacuuaccuaguacuuaaaacuacuugaaaauuauggaagugaucauaccugcuuuuagaucucauuauuuagucccuuauaaacaggaccagacaauuguauaucauacauuuuauacacacacacacacacacacacacacacauacguauaguuauauaaagcugaucuaauugggauauuuguccccuccacaucacauguugaaaugugacccccaauacuggagguagggccuggugggagguguuuucauccuggggguagaucccgcauuaauggcuuggugcccuccccacgguaaugaguggguucucccucagugcauucauucacuugaaagcucguucuuuaaagagagcccggcaccucccuuccuucucuccugcucccucucuuacugugugacaccccugccuccccuuaaccccucgccgugaguggaagccuguuaaggcccucauuagaagccaagcagaagaugccagcaccauguuucuuguacaucugcagagcugugagucaaauaaaccucuuuuccuuauaaauuacccagccuccuuggauauuccaugauagcagugcaaauggacuaacacaauagcauauauauauauauaaaauacauauauaacacaauagcauauauaaaauacauauauaauaacacaauaacauauauguguguguguauguauauguauguauauauagcuugccuuguaauaguauauacuuuuugaauuuaaaaacauuauucugagaaggaaucauuaagguucaucagacuuuaaggcaguccauggggaagaacagguaaaaaaucccacacaguagggcaguaaauuugaugucaaccuuucuaacaccuucagcugucuuaaaugggauggguagccaugugagccaaugaaguuugugcuggagggggagauggaugggagauggaugggagauggaugggagauggaugggagauggaugggagaggagccaugccucagauauggaguugggccuugaugguaaaacccaacacugaggcucuuuaggcucaagagaaagagaagaggagauguguaucucuuccguuuacuugaauuugcucuaguuugagucaaauggcuucuauaaagagggaagagucccugaguguauaccucaugccacuucucuuuguauuugaaacuggauggucucaagcaccaguaauuacuuguuggaugagugaauugaauggcucaaggccgcaguugaugaucagguguggcuggugcccuggagucacagccuaucugcaugaguucccauugauagcuccgcaccgcaccgcauucaccgccuuggaauucucucuauuuuauuuuuuuuugagacgagucucgcucugucgcagcucugucacccaggcuggagugcaauggugcgaucucagcucacugcaagcuccaccucccggguucacgccauucuccugccucagccucccgaguagcugggacuacaggcgcccgccaccacacccggcuaguauuuuguauuuuuaguagagaagggguuucaccauguuagccaggauggucucgaucuccugaccucgugauccgccugccucggccucccaaagugcuggauuuuuuuugagaucagucucgcucugucaccaggcuggagugcaguggcgggaucucagaucacugcaaacucugccuccuggguucaagcaauucuccugccuaagccucccaaguaccugggauuacaggcucugucaccaugcccggcuaauuuuuuauuuuuauuagagacgcgguuucaccauguuggccaggauggucuugaucucuugaccucgugauccuccugccucggccucccaaagugcugggauuacaggcuggaauucucuuuucaugcucuuuucucuucugcuacgaugugagcucuuuaaggaauuauaacuauuuuuaucuuauauguuacagagaaucacaaugcuuaguguuuggugaauaaaugaauaaaugucccuguagaggucacuauuguuacagaaccaauggccccauuuaaaaaaaaauaaauuaaggaaaaaacauauaagaaagaauacuucugacuuuacucagcugaaguaucaugggauggagugauaauguuaaauucuggcccacuaaguacccaaauaaaaaccucagaaaagaauucuguuaaugauaagacaagcaaccucucuuccuguucagcuuaguggaaguguugacagaaaauagcuuuuaggggccugggcaagcucugaaaauuucuagggaggcaaaguguuuuauuugguaccuaagcugagaacuucucuguauuaaaggaugccaagauauuccuacaaguguauccuucauauccauaagguuauggaacuaguuuuggaagguauugcuuuugcugaaaggaaaaguaggcaggggggcaagagaggauuuauugagcacuuacuauauguuccagguauuuuaacacacaauauccuuuuuuuuuuuuuuuuuuugagauggauucucacucugucgcccaggcuggagugcaauggugcaaucucggccuuggcucgcugcaaccuccgccucccggguucaagcgauucuccugccucagccuccagaguagcugggauuacaggcaugugccaccaugccuggcuaauuuuuguauuuuuagcagagacgggguuucgccauguuggccaggcuggucucgaacuccugaccucaggagagaugcccgccucggccucucaaagugcugggauuacaggugugagccaccgugccgggccuaacacacaauaucuuaauaagcuuuuguaacaucuuuuugagguaaaugcuguuguccacaucuuaccaacaaagaacugaagcucacugaggugcaguaaauuuccuaacuuuacacagccucuucacagaggcuaaauaagcauucagacugagggcuuaagaagcuuuuucccuuaauaacuuuggcucuauguccucacauuaucuuaggcuucaaacuggagacacaggcauaagacuccauguagguuauguuggguggguagucaaacagagggauguguaccauugguuuggagcaugaauuuugaagucaaauaaaccuggcuuuguuccuaucuguguggaacuaucacuuuguaucaguaauccucaucugaaguuguauagcgcugucuuacgaauuaugugagauaaugcuuuucauacaggcauaaaaacucaauuauuauuguuacuguaacuauuauuauuuugcaggcuuuugauauuagugaauuggggcugagaagcaaaggucuucagaauguuucugugaagguugcuggaagaacaguuuauuacuauuacuacuuuggaauugaggcuucaaaucuaauuuugugaacugagauaaacaaauugaaauauuugggccugaauuuuaucuuugaaauggaaauaauaauuauuuggaggaagagcuaaucaagcacucuaaacaaaaccauugauucauucaacaauuauuuauggaaccagagcuagaaauagcaggagaucaaaagacggaccacuuuuucaaggagcuaauaguucauggggaaggagagacaugcaugucagcaauaaaaacacagccaggcacgguggcucacgccuguaaucccagcauuuugggaggccgaggcagguggaucuccugaggucaggaguucgagaccagacuggccaacauggugaagccccgucucuauuaaaaauacaaaucuuagccgugugcgguggugggcgccuguaaucccagcuacucaggaggcugagguaggagaauugcuugagccugggagguggagguuguagugagccgagaccgugccauugcacuccagccuaggugacaagagcaaaacuccaucucaaaaaagaaaagaaaaaagaaaagaaaacaauaaaaacacaagguaaaaaccggauagaacugguaaagacauggacacauagguaccuugaguguuggauuagugaacuguuauuucaaaggaagaugaucugagugcuccuguaaaggucugggaaauuuacacugugccacuuuucacgauuuuuuuucugcuuucuccacuccaugauacauguuggauguuugaugccuuccaaaucaagaguuuccaagauaaaaggaaaacacguaaucucguuuuacacauaaggaagcgauagcccaaaaaguuguguguuuuaagacugcaaacuaccuuguugucaaauuagcacucgaacccagguuuccucauucccagucuacccuucuuucuacuacaccauacucccuuuugagccuccaccauuaggcugacccuaaaccaacgguacaugaaguguugcaagauagauuacacaaagguccaagguacagcugcaggauaugugccagacugggggagaaaucauuuugcuuugggggcaauagaaggauuucauauaaaugcaacaaaguuuguuguuguuguuucauuuggauuauuuucccuagugcucacugugguacuaaauuaucccggagcuuggaugcuccaaggccgagguccacugaaacaguccuaaucauuucuagaagcccagugaugccuucagcuggugugauggauaaagcagcagcucuggccagugacuacccuucccagguuuucaaguguugugguacauuuugacuuaucaaaguaauagcuaugacucuucuucucuucuuucuggaccaaaagaucagucuucucugcgaagguuuuuucccuuccccaaacuugcguuuccucuauuccaaauaccccauuuggacugguuuauuuggucaugcuuagacuuucaaccaacaaaugcagccucuggaccggauucagggaaagaaaugaguguguccauccagagcuuuuccccuucuguuugucagaggaaagucacucccuggaggaaaacauccuguucuucuuuagccagaucauauuggcacaacacuuccucugcucaccccaucccuuuuuuaugucuggaaccacacaugcacagaaccaggcagccaccugggaugauagacuucccaauaaauaguagacacagcccucacuuacuguuguuguauuuuuuuuuuuuuuuugagacagagucucacucuguugccccggcugaaguggaguggcaugaucuuggcucacuggaaccuccaccuccuggauucaagcaauucuccugccucagccucccaaguagcugggacuacaggcgugcaccaccacaccaggcuaauuuuguguuuuuaguagauaucggguuucgccauguuagccaggcuggccucaaacuccugaccucgagucaucugccugccucggucucccaaaaugcugagauuacaggcaugagccaccacacccgaccacuuacucuuuauugaaugaaucaguggauggauggauggauggauggauggguggguaagugaauggauaaagugcagccacucuucuccgugguauuuugagagcacuaugaaagucaguagccagauggacuaugcacuauggggcaaguauuauucuuuggagagacaagcagacauuugacuccagaagagaaagcagcacagugcagggcauagaucaagcagaguaugccuaaggcagaaaagccauauuccauggcuacucacuuauucuugccauccuacuccacuucaguucacaugccacugacuuugaguaauuaggccagggaagauaaaaaaaacuaacuccuaauaccaaguucuuuuuauccaaauuuggagcaaaacuccugagcucuauucuugggguugaaugagacagcacugcugaugacugaugucugaaaaggcaccauauggauuuguacaaagggaagaaaauaauccucaguuguaaaaauaucuuuggucuucauaagggugauauguacccacauguuucugucaggugguuuugcuauaaaugauuacucuuggacuaauagaaaaauuuccuuuuauagugauuguacauuuucccagauuaucaguguagcaugcaaaaucccacaacuucagacauuuaaaagaucaaaggcagagaggccauuggggucuuuugacucaccacacaccagaacaauaguuuggcuaccaaaagucccuuuaacgacaacaagaaagugugcuuucauaauuaccaagcugcaccgugaaaaccaguaugcauuccuaauucuugcauuaaauauuccuguuguuucuugauggcaguaaaauucaaauugucuccauaugauuaaaacguuggccaauugagguucggagcuguuuagucgauauuaacugcagugguguugaacugauuuucuguuucagaugacagccaaaacuaucaaauaaauccaaaaauauuuauuaggguggcuucugaauauauagaguguaguuuaugacacucucaguaaucucacugaaggaagggaaaauauauuuuccaucuguguaaaccccucaguagcuggcagaggguaguugcuuagaaaauguuucgggggugcaugaaaagaugagcaacuugggcauggagauuugaaaguaaggcucuguuaauuuaaaaaaucuaacaaagacacagauaaugcuaacaaaucagccauccgcuuagaacuuuaguccuauuucaucagaguucugauuuguguguauucaacaaacauuuauugaguuucuacaaugugccaagcauugggaauauaaaaaagcauaagaccuaguccuugccucucagcagcucccaggucacuaggagaaacaaacauguaaacaaacagccacauucaauauuaaaggugaccuuugaguaaaaugaggcgggagcaaggcggaaagggacguuugaaacacugguuuugcucagcagggacuguggagcacguaucguacuagaagagauuaugugcuuguuauucucagcaguucccagcucucacaucacuuucuuagcaguuuaguuuuguugucgugacagcauagcagcucugcugugaaaguuucuuccuagcuccuggaacuacaaggacaggcauacaguuuguggcaucuaaauaccccgcugauuugcuugcuuguagcucaggagugcccuuuggcaaucugugcucugagagcccuggcuccugagcucuguugcacacccgagacagcggucucauuccuggcuuucuucuaaaggaucguaaccacggucauuaaaauggauucuuggaauccaagcaagacacauucagguguaguucuuuggaaaaauaugauccuaggaagggaaugcgccacaguagaguaguaauacuccguuucugguuuccuaucuggcacuggcugaauuucaguucaugagaaagaaggacagagcaggccaguaguuuccagcuuuuauuuacuugugcacuggccagaaugcaggacggagaaagugacuaucaaaaggucagguccuuuuuuucucucugcccgaaguaugcacaaggagauaaccaaauguuuguuuuucuaucagagcguaaguuuggguacaucuacgugacuaacggcagcugaauugaaauccugugucaaagacuuaccuggaaugcucuaaacugcucucaacagccugagauggcauuagaaauagauugagucaccuuguguguuuuuuuuuuuuugacagaguuuuuucuuguugcccaggcuggagugcaauggcacaaucucagcucaccgcaaccucugccuccuggguucaagcaauucuccugccucagccuccugaguagcugggauuacaguugugugucacuaugaccggcuaauuuuuguauuuuuaguagagaugggguuucaccauguugguuaggcuggucucaaacuccugaucucaggugauccaccugccucagccucccaaagugcugggauuacaggagugaacuaccgugcccggcaagccaccuuguuuuauagggugauugcauacaccaaugaaugaccuuugguccauagucauuaggacagaaaaguugaguaauuccucuauaguuucgcauuuccuuaacuuuuccugugggaaaauauaauggauaucuuaaacacugacuaagaccuacauaacacuuauuauaugugaugauugauuagacuuaggauucuaaguuauauuuaagcaaguaggaucuucaucucccaaauuaauucaagaauguucaugaugcaauaauaauaaugacaacaaaaauaaugccuaccgaucauucagccuacacaauagcagaacacuuauuuggaguauucuacuauaauaacugauauuauagucgucacaacuuauuuaggauuuguuauaugccaagcacucagguaaaucuuccagugcauuuaagccuuaacaacaguccugugacaauugcauuguuauccucguucuccagaaaccagaucaucaagucacucccccuugaggaaaagguaggcccuuuuucugucugccucuaaaacacuuccucuuaaccuucaugcuagacuaagaccuggacacauuauuagguguuuuauaaacacagucucauuuaauucucaagacaagccagguauuauuauuauccuuuuucauacaaaugaaaguccagagcuccagugccaaaagcaaggagccagaauucagacccaacucggccugacuccaaagcccaggcuuucuguccacucaauaugccgccuccagauggcuuccagggcauuauccucauuccugaauugccuucccagugacuuuucuucccccugaaauucccuuauuagggaauaacaccuuccauuccauaauuuggaauauaacuggaaaagcaaaauccugcugggauauuugaagauugacccaaagagcucuggguugccaagggcugcccaggaggagggggugcaggaaagggugcauggggaggggaugaaguauaaccccaagagagcaaaagaacuuaagaaaaggagcccugggagguaaugaagaaagcacauacuucacuuucuuuuugagacugagucucacucuguggccaggcuggagugcaguggcgcaaucuuggcucacugcaaccuccaccuccuggguucaagugauucuccugccucagccucccaaauagcugggacuacaggugcacaccaccaugcccagcuaaccuuuguauuuguaggagauccacccuccucggccucccgaagugcugggauuacaggcaugagccaccacgcccggccauacuucacuuuuuuuauaugggcuaacucaguggguauuagauugccuuguuuauauguauuauacagucgugugccacauaaugacauuuuggucaagacaaacugcauauaugauauggucccauaagauuauaauggagcugaaaaauuccuaucacacaaauguuuaucacuguguuuauuucuuuauacuauucaguacaguaacguccugaacagguugguagccucugagcagcaggcuauaccauauaggcaagguguuuuguguaaguaugcucuaugaugcucguacaaggaugaaaucucuaaaaacacauuuuuagaauguguccccugucguuaagugacacaugacugaauauauauauacauauauauaaauauucauguauaaauauauauauuugacucugaacuuaguuuuugcuuugaauuucacuguaguauccccugaagauacuauuuauaagaagaucuaugccaaagaacauauacaaacucaacuugguuuuucuugggucuuucucuuaaaucuucuuuuggauuacuaaauucucaaauguucuacccauguaagguuaucccacuacuccaaaugguugaguuucucaguccaguuuuccugucuucuuagguucaacccaauauucuuuccugguuuauuuccgggaaaagagcaaauaaagaaugaaccaauuuuuauccuuuuacccuuuuaucaauuccaugcagugacugaaugcuccccacaaugccugccacguguggcaugaauauugcauagugaggaacuuaauuuaugggaaucaagcugaugaaaacucucaaaaccaggaugaggccgggagcaguggcucacaccacgccucuaaucccaacacuuugggaggccaaggcaggaggaucacuugagcccaguaguucaagaccagccugggaaacuuggcaagacccgaucucuacaaaaaaucaaaaaauuagcaggauguaguguugugugccuguggucccagcuacuugaaaggccgcagcaggaggauuacuugagcccaggaguucaaggcugcagugaguuaugaucaugccauugcacucuagccuaggaaacagagugagacccugucucaaaacaaacaaacaaacaaauuaagaugaccauuaaauaaaucacccaaacuggacuacuuuucaaauugaaagagggugcgauuaacacugggauagcaagcagaagguaggccauugcagagcaaagaaacggcaaggagaaagagugaagucuggccacuaaggucgugucagcccuuuuagguaacauaguccuugucauuuaauagacacugagaacaaucacgccuauucauuuacaaacacuaggaaaguacuaugcaccaggacuaggcuaggcccugugaaggauuccgccaugaagcucagagucuacugcaacacacaaaggugacuuacaugaguaacaguaaugguacuaaccaacuuuuauugagaacuuuccauaugacacauacguugcugauuaccuuuuguucacgaucucauuuaaucuucaccuaaucuuguaaacuagguagacucauugugcuggguuuuaaaaucuggauacugagacucagagagguaaguuauauguuggucuuccacuggucucccaacucauaacugguggaaacagaauucaggacucaguguguggaaucugaaggccugagcucauagcuccaugcuuugcugcuucucugcacaggacacuaagauaaaugucaugguagagauaggagccaagugacaauggacugcaaagcagccucuucccccuuccugucaugcauggggagcacaagagaagggaaagcuuuacaaaggagaugacauuugagaugggccuuaaagacuaccuagacuuuauuuuauuuuauuuuauuuuuuucuuuucuugagauggaguuucacucuuguugcccaggcuggauugcaauggcaugaucuuggcucacugcaaccucugccuccuggguuugagcaauucuccugccucagccucccgaguagcuaggauuacaggcgcccacuaccaugccggcuaauuuuuuuuuuuuuuuuguaguuuuaauagagacgggguuucaccauguugaucaggcuggucucgaacuucuguccucaggugauccgccugccuuggcuucccaaccugcugggauuacaagcuugagccaccgugcccggccaagauuaccuagacuuucaucagggagcagagaggcaaaguggagacauuccagggcaaguccaagccucacaggccagugcaugcggcaggggagcaguuuucuccucuguaacaccaauguguaaggggcagugauggaccuguguauugaaggcugccugucucugcgauggcgagcaggaaagggccccaacuugacaacauucuugaggcacauaaauacauaaucacgugcagaguuguuuggucccuaggaagugguuucuaucacaugucaggauuguagacucuguguuaaacauccagucaaggaaucugucaagaaagacuucagcaaaccuuauuugucagaggauaucaaauguuggaguacuaucuaagugaauucugaagauaacuaaaaaggaccauuuuaauggcuuuuuuuuaacacuuaaauauuuuuuggugcaaauauuuucaaaaacuauuauuuauuuccccaaauuacccaaaaggccacuguuaugaugguaucucguuguguccacuggcacaauaaaaaguuauaagucagucucuuugcauauaaacuuaucuuacaaaugaauugugucuuacaagucugauugcauuucacucuaaaaaucaugagaugugcuaauuaguaauauuucacucaccuucuagaugaaauuaaauuuuagaaguagucucaagcaaauuuaccugccugucuacauugacucuuuuguuaaauguauuuuugguuccaaugccaagauggagugucucucagcuguagccacagccuuuagaauucuucuacuuguagccuggagaggaggcuccaucacagacuuuuauauccuuggaaccagacuguaaaauuuuauagucaauuguagaaccguggucugaaaaaccuauucaaaccuuucaaauacaaacuucauccuacaguagaauuaagagccauuuauuuucuaucaaaagcaucauaaacagcuccauaccuuguagcaaaucaggaaaccagauugccagggaagguacugggccuacuaacucagcugcuggagcuguuucaaaagcuccuggaugaccuccaaaggccccuuccacuucaaaaaacucccucacuuuucagcaagucgugacuuaugaccaggucuugggcaacccaauccgugaucaucugugaaagagcaauccauuuccagaucauuaggaaaauuaccaagccuagcacuuaguugaaauaaaggccagaaaaguugaaggugggagaugugggcaagaaggaauaaauguaccaagaggaaauuccgccaaaacgugagcgucgacuaacaugagugaggaaggaauaccaaagacguaagcucuucuguacacaugggccuccucaacaccagcccccuucaucaaaugcugaauaauuuucuuagguauaucucuaagcuacguaaccucuuuucaguuuucuaacaacauuaauuccacuucauucaauauguuccuucaacaagcguuuauugagucccuuguacguguuagucgcucugucaggcucugggacuacccuggaggaucauaacuguaugauucaugccuucauggagccaaugacagugguagagaguggaaaguaaacaaggaaauaauaaauaauuguguuaguuguaggcagaaaacagcacgagugcuucuuuugaugggguggacagggaaauuuccuuugaggaaauaaaugucaguuaaggagaagacaguuaagaagucauuucuggcugggcaugguggcucacgccuguaaucccagcacuucgggaggccaaggagggcagaucaugaggucaggcauuugagaccagccuggccaaccuggugaaaccccuucucuacuaaaaauacaaaaauuagccgggcauggaggcgcgugccuguaaucccacucaggaggcugagacaggagaaucacuugaacccaggagguggagcuugcagugagccgagaucgccccacugcacuccagccugggcaacagagggagacuccgccucaaaaaaagaaaagaaaaaagaaaaaaaaaaaggucaugagacuuggggaagaacaagcacaaaauucucaaacaaggccgggugcaguggcucacaccuguaaucccagcacuuugggaggccgaggugcauauaucaccugaggucaggaguuaguuggucaccugcccaacauggugaaacucugucucuacuaaaaauacaaaauuagcugggcaugguggcacaugccuguaaucccagcuacucagaaggcugaggcaggagaaucgcuugaacccaggaggcagagguugcagugagccaggaucgccccauuacauuccagcuuggaccauaagaacgaaacucuaucucaaaaaaaaaaaaaaagaaagaaaaagaaaaaguaaaaaaauccucaaacccauaaagagcaggaccagauauuuucuaggaacuucuagaggacacuugugcucagaacuuagugugcaaaugacaguggaacaauuugaggugcaaaaacuggcaagcuaucgagauacuacagggccacagccaagguaaagagcucugauguuaguguaugugaauguuauucuacauuaaaagaauggcugaacacaacacaaugaauagcaucuaauaauaaaagaagugcaucuucagauaaauguucuuaaaauacagcuguaguuaugacauuuuccugcucacagauaacuguucaaagcaaaaggaaacucccaggcacugaggaaaggguccuucuccaucucacuguacacacaucucuuccaccucccaccauguguccugggagccaaccaccccuccacuugaacacguacugcauuuuucuaggcucaugcugguccuuucuccuccuuccccacuccaacauccgccuguugaaauucuacccauccguccagacccagcuuaaaggccaccuguuccagcaagccuucccuuucugucucugccagaauuuuucuuuccuuccucuguccucccaaaggacuuugcacuucucuuaaagugcuuaccacacucugccuugaacuauaccuauuacccacaucaccuucccuccugaguacaaccugcucaaguucagcuagguggcaaugaucaguuuaugaucgcauaggaucauuguuccuacgggaucaugaacaaugggaucucccaugagaucaggagaucccauuguucucauaggaacaaggcacccuuagguaccaaagaaaguagaagagauacugggaaaggaacauaaggcaaugaaaggugaagaguaggaugaggaaagaaaauuguuaaaauuuaauuuaaugucuuuccuuuucuuuucuuuuuuuucuuuuuuuuuucuuuuuuucugagauggaguuucgcuuuuguugcccaggcuggagugcaauggcacgaucucagcucaacacaaccucugccucccggguucaagcgguucuucucccucagacccccgaguagcugggauuacaggcaugagccgccacgcccggcuaauuuuguauuuuuaguagagacaggguuucuccauguuggucaggcuggucuuuaacucuugaccucaggucaucugcccgccucggccucccaaagugcugggauuacaggcgugagccaccaugcucggccuaauuuaaugucauuuuaaaauuaaauuaaagagauagggucuugcucugucgcucaggcuggugugcaguggugugaucacgguucaccauggccucgcccuccagggugcaagcaauccucucaccucagccucucaaguagcuggaaccacaggugcuugccauacagcccagcuaauuuuuaauuuuaauuuuaauuuuuauagggaugugggucucauuauguugcccaggcuggucuugaacucuuggucucaggagauccuccugccuuagccacccaaaguucugggguuguagguuugagccauccagcccagccggaaacaaacuuacuaaauaaguaacuaugcuuugaaaaugcuucaaagacuguauuuuaagcuuuaggcuuccuaaacuuaauucaagcagcauauucaucccaagucaacuucacuuuugacauauuagugucauuuuguagagguacaguugucuggucaacaaacauagguuccgguucaggcucuacuuauaauuagcugcgugaccuugcacgaaaaagcucuuagagacuaaaaagcucuacaguuuuucuaugugaaaaauaaagaugaccuuagcuggccugcuuuccugugaaugucuaaaauguuacggugacaaggcguaagaagaguugccaccauaugaugacuggaugaaguccccaauaccucugcagcaauagacacaggccacaaccuccgaagcucugcugucgaacugacuauaacuaacaggugucugaguucggguauucccagaagcaaacgcugagucaaggauucaagugcaagcaauguagugagaagugccaggaacaaggguagguguuggaagaaaugaccagggaagcgaagauagucaauaaaaggugcauucuaagccagucaucucaaugggcaaauggcuguuagugcaaugggaaaacacugaaaaacagugcaaaacacugaaaaacaguacaaaacacacaccucagaaucgucccuucugggagguaacaaaaaccaagauauuuguacuccacaucugccauucauugguuaaggagugccccugugaggacgugaacucccaggcacuuccagcucccugugccugcaggcaccguggguuccaugugccguuucacagcaguuuuccaucaaagagcaaggugcuggcccuugacagccaggcuggagggcacagaaaugguaagggacuggagggaauagggcagaguucagaaaacaucugcccuaacaggccuacaaaucaggccaaagagaauaauacuaccucaguggauucagaaucuagcauagguaggguguucuuucacaauaaaaacacagaauuaagcauuguguagucuaucugcauggcuaagagugccauucauuauaguauauuucaaccuaaucaaugcauaaauuauaucuacacaauguaacauaaugcagcuaauaagaauaguauauuaaagcuauuuacaugaaaaaaugcucauaaaagugaaaacggcugguaugguagcucacaccuauaauccuagcacuuugggaggcugaggcagguggaucacuugagcccaggaguucaagaccagccugggcaacauggcaaaauucugucucuacuaaaaauacaaaaauuagccagucacaguggcuuaugcuuguagccucagcuacgugggaggcugaggcaugagaaccacuugaaccugcgagggugagguugcaguaagccgagaucacacuacugcccuccagccugggugacagagcaagacucuguccccacccccccaaaaaaaagaaaaaagaaaaaaagaaagaaaagaaagugaaaaugcaaguuacauauuuuuuuaaaagcaugucuauauaaauacgccuaaaaaucugggaguacauauuuauauagacaguguguguuuuaacagggguuaucuuugagugguaggcuucuuagugauuuuaauuuucugcugaucuauauuuucucauuuuucucuaauugaucuauaugauuuacaaagacuuaacuucagaauaggaaaaaauaaucagacccaagagcaggaucgaucaaauaaagccuucgagaggguaaagucaauuugauccagaaaugucuauaauguauguuauauauauuuccaagaauucucuccugauugcuuuggugacacguauauuaaguucuuuccucacucugcugcagucucucguuuuuccaguuuaauucacuuucaguagaaaaguagaacugacuagaaccccugauaggcaucuuuaaacaugcaguuucuuugccaaagucaccuuaaguagagguuggguaaaaaacugaaaucaacacuuuugaacuucauucuuuaagauaaacucuuuuucaacucucuuugaaggaaguaaccgagguaccagggugacaccugauugaccacuauucuguauucucuguguacaaacaucauggguacaugcaguuugguuauuugcagauuucuguugggguugggagccugguucaugugucucuccucggcucuucuuccaggguccacuuccuuccuuacauaccagcaucaggaacugguucucuucucugcuaauaagcuuaguccuggacaagcuucugcacuuggaguauucacuaagcacagaagcagcaggaacaagagggagaacuauuccuuuaaggucacucagugagaagucucucuaaagaucuauuuguucuucacagagaaaggagucagcauccauuucugcuaaguagugaucaggagaaagucaaauuagauuaauuaccuggaauaaaaauggacuuguacuuuugcuaguaauggauuucuaguccagggagcuuuacaaguauuaauagcauacuaguucuuggcagaugacagucauuagugagaaaguaacucuauccuccggagaugauuuagcuuugucacuauguaguaaucuuugucuuaaucuuauguugaggcagagaaaaauuuuucuuaaauuugcuugugaagcauaauaguuucuagaguaagucacagaaagggcuuuucugcucugugugugaguuuugucuuuuuuuuuuuuucuaucguggguucugaauuaaauauaguaagauucuuuuaauaauucuuuauuuugagggcccaagugggaaaauuguucugagaaagaacucaucagaugcaacucaucagaugcaaguucuuuuuaaaugcacaagcuuccuuucccuucauacucuuaacucaguguucuuuaaaccaaggauuggccuuccugggccaaguagguuaccaucaugucuccacugugaccuuuugaggggcccuccaccugguuggaacuuucuuucucuuuuuuuuuuuuuuuuuuuuuuuuuuugagauggagucucucucugucaccuaggcuguaauacaguggcaugaccucggcucacugaaaccuccgccucccagguucaagcgauucuccugccucagccuccugaguagcugggauuacaggcgcccgccaccacgccuggcuaauuuuuguguguauaguagagaugggguuucaccguguuggccaagcuggucucgaacuccagaccucaagugauccucccaccuuguccucccaaagugcuaagauuacaggggugagccaccgugcccagucagaacuuuauuucuuuaaucccgagacugcagucuguguuaaguacauccccgucagagaaauuaggguauuuaaucuauuuaaugccagauuuuaacccuuggucacagcugaguugcagaugaccauaacagucacagguggcaguccucacagggcccuaugguggcaagguccuaagagggggugucuccuuuaaacugcacccucgggaccuuccuuccuuccuucacacuagucuuggcccugacaugugcuuaugcucacaaagcacuuuuaccuacauugccuaaauugauucucacuacaaacuuaggaaaucaagugaauacaaggaucccuccccaccaguugauaaggagccugaauuuucaagguaaaggucuugcaacaggacugggaccaagagcuucauuuuuaaugucaucuucucucuaguaaacuacuuuuuuucccccucaaauggaagggaaacuacaaaaaaggcaaaggauggacagaaaggauggcagcaccgucaucccucagcuucugucagggauuguuucuagguccucuguggauaccaaaaucagaggaugcucacaucccuaauagaaaaugguguuguauuuucauguaaccugugagcuuccucucacauacuuuaaauaaacucuaggauacuuauaauacuaauacaauguaaaugcuauguaaauaguuguuauacugcauugcuuuuuauuucuuuauuuugagacaggguaucacucugucacccaagcuagagggcuauggugaaaucauggcucacugcagccuuauccuccugggcucaagcaauccuccuucuccagccucccaaguagcuagggcuaggaccacaggugcacgccacuaugcccagcuaauuuuuuuuauuuuuuaauuuuuaauuuuuauuuucauucuucuuuuuuuuuuuuuuuuuugagauggagucucgcucugucacccaggcuggaguccaguggcuugaucucagcucacugcaaccuccaccuccuggguuaaaacaauucuucugccucagccuccccuguagcugggauuacaggcacccaccagcaugccuggcuaauuuuuguguuuuuaguggagacaggguuuuaucauguuggucaggcuggucucaaacuccugaccucaggugauccaccugccucagccucccaaagggcugggauuacaggcaugagccacugcgcccggccauuuuaaaaaauuuuuuguagagauggggucuuacuguguugcccaggcuuauuguuuucauuuguauuauuuucauuguuguagucauugcuuucuuuuuuuuucuccaaauauuuuugaucugaguuugguugaauccauugaugcagaaaucuaggauauggaggcccaacuguaaagauaaacccuacaguucuuaucacuuauucuuguuccuuguguggggaggggacagcaaccucucuaaaggauucaacuagcagaggcuaauuucagaaguagauaaaacacagaauaaaauagagaugaaggcugggcgcgguggcucaugccuguaaucccagcacuuugggaggccgaggugggcagaucacgaggucaagagauugagaccauccuggccaacaaggugaaaccccaucucuacuaaaaauacaaaaaaguuagcugggcaugguggcgcaugccuguagucccagcuacucaggaggcugaggcaggagaauggcuugaaccugggagguggagguugcaaugagcugagauagcgucacugcacuccagccuggcgacagagugagauuccgucuaaaaaaaaaaaaaagauagagaugaguaagaugaagggagaaagugggagaaagggaagagaagaacgugauuuagaaacuagaauuuauguagagcauauuuggucaucagagcaaauuauagaagacaaguccagcuggcugaaugcaacacugccuugaaaaaaggcacugacaucguguacauuuggugcuauuccaugaauggaaauuuucuaguagcaaaguuaauuauauaaguaaauuggccauuugucauuagcuaucugucacaucuuuauauuuuuccuaaauaacgucugcauguuuaugugguuggauaauuuagaugucuccuugggcugagcauuuuuuugcccuuuuuuuuccuccaugagauuaacauauauaugccacauaagcaacauuuucugcaaguaaggauuauuucgaaagugucacauuccagaaacuguacuuucagaugaugauucgauguaguuacagauuacaaggcacugugcagacagauacaggaaaugauuuuuuuaggacucacccaggcaaaacggaauccuaaaaugccauaaaagaagauugucauuaccaucaaaauaagaagaugugguaaaaaggagaaagaaaauacaagagguuuuagucaagcaaaucuaaaaugaaaaaaguaaaaucagccauggaauccagaaauaguuuucugagaaguaaauuuuccuauacuuuguuugucuuuuggaaucuaauagcuacguacuuuaaaaaaauuuuguuccuuggaucaaagaggagaaaaauauacaacaaauuucucuuuuuuuuuuuuugagacagaguuuugcucuucuagcccaggcuggagugcaauugugugaucuuggcuuacugcaaccccugccuccuggguugaagcgauuuuccugccucagccucccaaguagcugagauuacaggugcacgucaccacgcacagcuaauuuuugguauuuuuaguagagaugggguuucaccauguuggacaggcuggucuugaacuccugaccuccggugauccaccugucucggccucccaaagugcugagauuauaggcgugagccaccaggccaggucaacaaauuucuuaauaaaauuuuauucaggucagaaaauaagaauucaauaucuuaaacucuuuuuuugugugugugugugauggaguuucacucuuguugcccaggcuggagugcaauggcacgaucuuggcucacugcaaccuccaccuccuguguucaagugauucuccugccucagccucccgaauaguuggguuuacaggcaugugccaccaccucagcuaauuguuguauuuuuaguagagacgggguuucaccauguuggccaggauggucuugaucucuugaccuugugauccacccgccuuggccucccaaagugcugggauuacaggcaugagccaucgagcccggccauccuaaacucuucuaaugaauuauagcagugguucucaaagugugguucccuggcaggcuacaccagcaucaccugaacacuuguuggaaagucaccuuucagcugccaccccagacuuccugaaucagacacucugaagguggggcccagcaaucgugcauuaaugaggcuucaggagaucaugaaguuugagaaccacuguauuacagaauugccuugcaggcucuaaauagaaaccaaugaagaguuuacuaaacuguuacuuguaugacuuuauuuuggagaaccaccaaaaucaaauucuguguaccuauuaguguauucuguaaucaacauuucuuuaaauuuaaaaggcagaaauaucuguaugaaaaauuuuauuuuagaacucauauucagaaaacagcuguuuaaauauauaaauugacaggcauagaaaagcuuaauuccaagugaacagaaaguucaauucuuagauaaaacauuucauacuaaaauucuuuugcugaauucuaaagcaacacaauucagaaaaauaauuacuuuugauagaaauuauuuauugauuuguauaaauuaauuuaacuaaaaguuacucauuuugauuuuaaugacuuuguuauaaaauuauaaaaccccaucuaaauauuuagauagguguuauuuuaacuuaaaauguucaaacuuaauaauagcuacaaucuaugagcguuuaccacauaucaggcccugcuaaccuucauaacaaccauauaagaugaguaccaguaguugauuuuggcagaugguaacugagacagagaguuuaauuaaugacuaagaaucgcacagcuacuugaauggcagagcugggugacaaacuuaggcuguuucuugaguuuaugcucuuuuuuuuuuuuuuuugagauggauuuuugcuguugucacccaggcuggagugcaguggcacaaucuuggcucacugcaaccuccaccucacccauuugagcgauucucuugccucagccucccaaguagcugggacuacaggcaugcaccacuacgccuggcuaauuuuuguauuuuuaguagagacacgguuucaccacguuguccaggcuggugcugaacuuuugaccucaggugaucuacccgccucagccucccaaagugcugggauuacaggugugagccacuggcgcggcugaguuuaugcucuuaacuaacaagcuacacccuccauuauuacauuauucuuaaacacaaauguucauauuaaauaggcaauauauuggauaucuaggcugggcauggugaugcaugccuguaaucccagcaccuggggaguccaaggcaggaggacugcuugaggugaggaguuuaagaucagccugggcaaaauagugagacaccaucucuucaaaaaauuuaaaauauaauugggugugguggcccaccuguagucuuggcuacucgagaggcugaggcaggaggauugcuugagcccaggaguuccaaguuacagugagcuaugauugugccacugcaguucaaccugggugacaaagugagacgcugucaggaaggaaggaaggauauauuggauauguuucaacuaaauguugcacagaagguaacgucuaccagcaguaauuaacaaauuaggcaagugucuccauaaacuuuuuguuaaagcaagucaucaauuauuuaaacaagaacauauaucuugauaaggcaugucagcaaaugaaaauauuaguugauuauugguaugaagagaaaagcuuaugaaaauucaaaccauuuuuauuguaaacugguuaagaacagaaauuuaacagaaaccuaacaguuauucauguuacauuuuguguacauacuacugugaaauacuucaggauuaacaugcaccuuuaaaaauuuguauuuaaauuucuuauuuaaauagaaaugaggucuuccuaugugguccaggcuggucucgaacuccugggcucaagcaaucugccugccuugaccucccaaagugcugggauuacagacaugagccaccacacccagccagacaugcacuuuuuaucauguuuuagaguugcuccaauuucagcauccagaagcggagucuaaauuucuacagguguucugguuuuagauuugugugcauaucacagaugacaaacgcauauguaugucugacaccagccacuccacuuuaauaucugcucccucacacugccccaugcaaggggaugcccaagguagaaacagaaucauaagcaaaguuacuuauguaucuuucaccaggcaugucuuccaucuuuuaauuuuucugccacuccucauguccuucucucccccagaaaugcccuguuguuuuagcuuuaccaguugaaauccaucacacuucaaagcccaaaugcuacgccuucaagcucugaugaaccuuucuugaugaccccagacagaaaccguuggcacucccugagcauuuuguccaaucccaugacauucauauuauaguuacucauguagagagauguucacacccuuaugagacugcaaauuccugagagaagugaacgaaacaccuuugcuuucccauaccuccuaucacagcguauugcacaugaaaauaagaaugcuugcucuguuguuaugguuuacaaagugccuucacuaaaacucucacucuauccucaccucuacccugugacguaggaaugauuauuaucucauuguaauagaugaagaagcagagaguaagacugaggagguguuuugcguaaugccacugugggucuccugacuccagaucugugcugcuucuaguacauaucugcccucaaauauuuguuaaaugaaaugacaaauuuaaaagaugaauuaaucaauucuggggagggucagagauugaacugcaaaguugauguuacaaccuuccauggcuucuccacaaccuucuagacuucuccacaaaucugccagcuuccccacagacaguggcgacagggagaacggguauggaauguaacugccauguagaaucugacagauguggccuggggaauucaucucccauccccuaaagguuuaaggagaaugaccugacaaugagagucugaagggaaaagagaaagcaucuucugaccuagaaagugccaaauugcacaggaaucccuaccugaaugugaagguguuuuccuuucaaucccaaucuuucucauaaggcagaguaucagauucacugacccaccugcagcuguuccaaaaugcagauucccaaucucggcccuagggcuucucauucauuagggucuacugaagagucuugaaauuugcucuuuuuuuucuauuuuuauuuuauuuuauuuuauuuuauuuuauuuuugagacugagugucacucuguuacccaggcuggaguacaguggcgugaucuuggcucacugcagccuccgccucccagguucaagugaauuuccugcuucagccucccgaguagagggauuacaggugccugccaacacacuuggcuaauuuuuguauuuuugguagagacaggguuucaccacauuguccaggcuggucuugaaccccugaccucaagugauccauccaccucagacucacaaagugcugggauuacagacuugagccaccgugcccagccuauacccauguuuuagaugagcaaacuaacagagaauugccuugccaaagguuguguaguaaaaaagaguaagcuguggcuuggcgcaguggcucacaccuguaaucccagcauuuugggaggccacagugggcagaucacuugaggucaggaguucaagaccagccuggccaacacgguaaaaccccaucucuacuaaaaauacaaaaaguagccaggcaugguggcaggcgccuguagucccagcuacucggaaggcugaggcaggagaauagcuugaacccaggaggcagagguugcagugagccgagauugcaccacuguacuccagccugggcaacagagugagacucagucucaaaaaaauuuuaaaaaauuugaucuuacaaaggcagagaguagaaugguggaaaacaacaaccacaacaacacaaaaacaacaacaacaaaaaacaguaauccuauugccuccacaucuaacagcccagcgacccaccuucagcuucuugaccuuuggguuuauugcuacauaucuacaaggauuaaugaacugcucucaagaaaggauaacuuugaacucuuggauauuuugucuuuaaugagugauuuauguaguucaauuauccagaaauauagauuugcucacauagaugugucugagccugauuuauuuucauugugaauuuccauaaaccuacaggcuaaaauuguaaaauauuuuauucagaagagacauacaaguaaccauaaguuaugauuuaaaaaucgcuaauacuguaaacuaggcaauuuacucauuugugaauuaaccaaaacaucuucaacuugacacuaagacuaacaucccaaacuguaauaauuucccaaagaaauacguuucaugauauuuuucaaguugagguuuucaaguuaagacccgaacuguguucagaaaacaugcauguaaauuguaggcccaccucccgucaucaaucacucuuacaugcauauguaacuuucauucuuuuaauguccaaauggugagaacccaaacugaacaaagaaaagcccuuaauucucaagaguggcacaacauauuugugugugucguuguuggagaaaguuauguuuauaguaaagaagaaucuaaauuaggaacacacuaagauuuccuuuuuuuccauuuuuuuuuuccuuguaugacacaugacagaagaaacauguuuuuaauuuuaggacuuuuucuuuguugaaauaaguugcgacaacaucacuuuuauggccgacucaauuccaugucaguuuucaggaauggaacuucuauuuauuuugaucucgacgcugccagcaaugguuuuaaagcucaguuaaagaaaagauccuugcuuugcaugacuugguaaaggaaaauauaaagauccaagauuuauuuuggcacccacuguaaguagagacaaacaauaauuuggaaaauuuguguaaauguuaccaguaugaaucucauugaucugcuuuuuaaauaaguaaugguaagaaacaccauguagcacuugacuaagaaauacacaucggaaacaaaauaaaaaaucuucccaaguaaguucuuaucauauacugcuuucugcaguauuaauuaugugguuguuuuaaaaauaaaauacaguaaacgaaugcaaaaggaacuggcagagcuuaauaaaccucgacucaguuuaaacucauugaguuuaauuucauucuaauuggaguaucugaaauuuaaagaauaaauuguuuuaauuucugauauagugucugucaggccccaauauuugguuguuuuuauuccaaacaaagaguuaaguuuaaaagguuuuaguuuucugaauauuuuaauuagaauuauguuaucugacugcccccucccccacuucccacuacagugcuaacuaggucaaccaggguuguuuggcagccuuugggauuauggacuccuugugugguuucaugguuucuuaaaaaaaaaguuuuguaacgaaacgaaaccaaaccaaagcuaugauucucaaggguuuguggcuugauugaaaucugaacaggaaauauggacuggugaugcuaguaacgugaccagcugucacaaaaacuuccucacacucuaagcgaaaccaggaagcuucgucaagagagggaaggaagauccccuuacaagauuaguaagagacuacauuugagaggaaggagguggagcagcaaaccaaggugcaaagaaaacauagacaauucuauugcuggcccuaguucaugaaacugaauuaucuaugaauuuaaauuccuaguuaagcuuguaugcugucuccacgaaucagcugguguacaucacggagcucacagguuuucuuuauugccuguauccuccagagaauucauuuucuacaagguaugugguuguuugccauagaagaaaguuggaaaaaauauuuuuaaaguuacuuucacaggacgcauagcaauuuaauucaucuuucuucuuauuuugggcacauuucuuuucuuucucggguuuuaccauugauaacauucuguaauuuaacaaguaagauuuuguucuucccucccccuccaucuuuuuuuuuuuuuuuuccagcagagcacacaacaccaaagcucugauguuguucuugauucuccuucuauguaagcuuuguuaaaaacugaaucuugugcugggcacgguggcucacgccuguaaucccagcacuuugggaggcugagguggacagaucaccugaggucaggaguuugagaccagccuggccaacauggugaaaccccgucucuacuauaaauacagaaauuagcugggcgugguggugcgcgccuguaaucccggcuauucaggagacugagucaggagaaucgcuugaacccgggaggcggagauugcagugagccaagaucgugccaccacacuccagccugagcgacagagugagacucagucugaaaaaaaaauaaaauuaaaauuaaaauuaaaaagugaaucuugcuacagugguauuuggaaugaacaacauauuggucauauaaaugcagcaacacauuaaauguaagaguuacccuuacauagugacacccccaccccccaacccagucugcuuuacuugccugauucuugagaacuauuuggcuuugcaacucucauucuagaaauaaaagggacaagacuuggugcuuucagcugugaaagauaaaagaggagguagaaccaacauuuacccugagacuauacuacuagcuaaggccgaggggugaauacuaucacaguuaaauaaaacaaaaaaggaggcacaucaaggaacagauuguggagcuggguagcagcgcuaaggaucaauuuuuuuauuuuuauuuuauuuuauuauuauuuuuuuuuuggagacagagucucacucuugucaccaagcuggaaugcaguggugcgaucuuggcucacugcagccuccgccucccacguucaaccaauucuccugccucagccucccgaguaccugggaguacaggcgcacgccaacacgcccagcuaauuuuuauauuuuuaguagagaugggguuucaucauguuggguaggauggucuagaucucuugaccucgugauccgccugccucggccucccaaagugcugggauuacaggugaggcaccacucccggcccaagaucagaauauuauuuuaauuuuggacuugucugucaauauaucuuguugcauuuuagagaacuccuguguguguccauaucuuguugacuacaggccauacugaucaccaagacuguuccaaaaucauccacucauuuuugcccucuucuuccacacccucgacacccccaccuccccaccaguaauuccagguccuacuuugcugaguucuaggcuaauuaccaagagcuccuuuaaguuuacuuaacccaucugcaaaugccugauauuccucuucuuuucugcaaacauuucuccuuacuuuuauuaauggccuccuccuucugucccuucuuagaguaaaagcaccuuccucuucuacgaccuacacccaugucucagaacuucauugcaucacauaaauaaauaggugaggucauguaaaagcacaugugccacgugagagaaguuauuuuuauauuacuaguagguucuuuucuaagaacuuaguucuuagaugauaccuuuuugcauuauugauguuuuucuuucuuuucugaggaguggggagaucguuuuaaaauugaauucuauacaacagaaaagaaauuuuaaaccuaucucaggcugggugcaguggcucacuccuguaaucccaucacuuugggaggccgaggcgggcagaucacaaggucaggaauucgagaccagccuggccaacauggugaaacccugucucuacuaaaauucaaaaaaauuagccagguaugguggugggugccuguaaucccagcuacuugggaggcugaggcaaggagaaucaccugaaccugggaggcagagguugcugugagccaagaucaagccacugcacuccagccagggcgagagugugagaguucgucaaaacaaaacaaaacaaaccuaucucuuauuaucuuauuugaaacccuuaacucauuccuggauuccagucccagcucugagaccccuagcucaggguuuaccauccucuacccgcaacucaggcuauggaaggucccaggcuggaaaggaacaaagcaacuucuuucagagcuguuagauuccacagucacuuggaaagcauuaauagcacaguccucaaaggaaggccuccugaggacuggguguugaauccagacuucaccacuuauugguugugugacuauggaauuuuauacuucaaauuaggcuggaauuucauaccucaaauuaggcaucaagaucgcaggacgccagggcaagaccagagcgccucuggcguaggacuuaagagggugucagaaccuaaguuguaaagauaaauaaaaucuaaaugcaaugguuuaaaacaucaaaauuaaugccaaaaaaauccauggugaacaaaauaucaaaauuuuaaagaaagacaguggcagcaauaaugcuguguagaguucuauauacgaagccugagccaaagaaaaaaaaucaguaauacugauucuguccuuauuuacgauugugauguuuuuuauuuuauguuuuuaauaguugaaaaaaaaauagagacgaggucucauuuguugcccagacuggucuuaaguccugagcucgagugauccucccucuuuggccucccagagugcugggauuacaggcaugagcuacugcaccuggcccaguuuugauguuuuauucaucgugauuuuuuuuuucaaauugauuugcuguuucuuuuaaaaauauuuuauuaguauuauuuaucuuaauuacugaguacuuuuugcucucacuuaaaauuugaguggaagccaacugccucacuuugcaucauuccagucucagcucuauuuagcauuauuuugauaguuuuaauuccacaggccaaugaauaauucuacuuuaaaauuaaagaguuuauuauucagguaaggaaaacauuuuauuuuaccuauaaagccaguugagaguuaguuuuggcugcauuaucacagugaucaucccuuuucagcaucccucucucugcauauuccuuacugacaaguaguuaaaacaagugcuuaauccaauggaaauucaaccacuagcuacuucagucaacugcuugacugaaauauuuagucaguuccaucacaauuuuugaacuggugguuucccaaacaaccaauccacuaagaaagcuagagcauuaucuauaaggaacaagaauugugggagauguguaucucacaacuggaagaaaauaguuugguuuuaacucccuauaaucauuagcuucaaguccagcaggggacaaaauggacuaguuacagggaguguuuucccucuguugacauagggacauaauuugucagcagauggggaagacuucguacucucuaaaguaauuugaguuaccagugguuugucuaauuucauagaaugcaaacaaguaaggcuuagaaaagucauucuauguuuuaucugucaaguaaugacaacuacuuucauuuuuguuccaggaauacaggcuuacaauaucacuuuagaggugauuaaaaugaagggaacacaccaguggauuaaauuugauuccaugauuagcuaucacuaaaauccuucugcaacccaugggcaauguaaaggauuuguccgaauauucagacacgaacacaucuuuuuaauauaaaaaaaaugcugggcuuccuuugaccuaauaaaucuguagaaauauucuaguuguaauugaagcuggagaagacaacaagagaaagggaagaagaugcuuauuuaucauucguucagugucaauuacgucuuggaucaaaaggugccaaaauccucaugaggcccuguggguguaaucaaacucccugcuggaauuggccaauuccaaguggucaugcugacguagguggcugguccuggcagucagaaugucuccgaaaugggagaauugauggacagcccagcucuggcguuuggcuucuuuauuuccuuggugcucaaacaaaaucagcaguuucaaauuccucaauuugaaugcugggaagugacugguaauggcauuugaagguccacuaagcaccccugaaaaguuuaucauaaggcaagaauuaccauacaugccagauaagaaauugacccaaaucuuuuucuuuucuuuuucuuuuucuuuuuuugcgauggaguuucacucuucuugcccaggcuggagugcaauggugccaucuuggcucacugcaaccucugccucccggguacaaaagagauucuccugccucagccuccugaguagcugggauuacaggcaccugccaccaugcccggcuaauuuuucuguauuuuuaauagagaugggguuucaccauguuggccaggcuggucucgaacuccugaccucaggugauccacccaccucggccucccaaagugcugggauuacaggcgugagccaccgugcccagcuucuuuuucuauagaguagucccaaucagaacuacucuacagaaaaagaauuauuuuagaggaaucuuagaaauuggccaauucaaaccuuucuuguuuuacagauaaugaaaccuguucaaggucauucagucuuuuagaauaaaccuagauguauagacuuccuauuagugacugguguuauuucuaccaguugauucugccugugguagggaauguucuuuuuuaaguugaauauaguuagaauauuacggaauaaaauuggaaguuuuuuuacaugaaguagaaaaacuauucgcaugaauuugagaugaaaaaugugucugguuguuuauguuauagacauacuaguucaauuucaaaaucauuccuaucaaagaucauuuuaaaguguuccaaauguugaaauauuaugugauuucaauauguagguauuuaaccuggauaugccaguuuucuccuguaugcacuguuccugccuaagucacagagucagucucuguccauuccagcccacaagguaagcagcacuaagcucaguacagugaucauuaauguaaaaagagagaaaggaaucaaauauuguaugugaugguaaaaguauucaugacauggccuauaaauaccugauacuuggaucuuauuugcaugauaccaucauuuuuggaaugacuuuauuggggguaaugaacaaaguagugaaauuguaaaacaggauugucuguaccaaaugaguucccuucucacuuuaaagaccgccuguguaaaacacaauuugauugguucucuuauugucuacauaggaacauugucauauguggacaguaaguguuucagucuuuuuauuaaaagggggcauacugguuuuuugcuaguuuccucaacuuucugaaacuuguucacaaaccuuccauauucugcuuaauuugguggguuuuuuuguuuuuuguuuuugagagagucuugcuuugucaccaggcaggagugcaguggugcgaucuuggcucacugcaaccuccaccuccuggguucaagcaauuaucuugccucagccccccgaguagcugggacuacaggcacgcgccaccaugccuggcuaauuuuugaauuuuuaguggagacaggguuucaccauguuggccaggauggucuuggucucuugaucucgugaucugcccgccucagccucccaaagugcugggauuacaggcaugagccacugcacccaucuguuaauuuaguuuuaaaaagacaauagcauggacccaacaaccuagcuuuccaguaaaaacauuucaaugucuaugaaaaucgaauaagugucucuguuuauauaucaaccacuuaaagcauccacagaauagaagauauuuucaacugaacuguaaaaacauagcagauuggacaucaauguaacugccaaaaauccagcaggaggcaaacaacagcccaauacagaaucaacauaaguuucuaaugcaauuaaaaaaauuuuagugaaguauaauuggcauacaauaaacuauguguauuagucuguuuucacauugcuauaaauuuugaugaagucuaauuuaucaauuuuuucuuucauaguuugugcuuugggugucauauauaagaaaucuccuaacacagggucgcaaaccuuuccuuucuuuuucuuaugugaguuuuauaaguuuuacauuuguaucuguuacccaucaugaguaaauuuuuguaugugguguaagguauggaucaaaguucauauuuuuuuccccaucuauggauagccagcuguuccaauacuauuuguuggcuauauauccguucucuaacaaauugccuuuacaucuuugucaaaaauuaguugucuacguauguguaguucuacuucugggcaaacuauucuuuuucuuugauuaauuuauauaucuugacacuaauuaaacacuuucuugauuauaguagccuuauaagaaguuuugaaaucaggcaguguuagucuuucaacuuuguuauucuuuuucaaaauaguuuuuggcuauucuacauuuauuuucauaugaauuuuagaaucaucuuguaaauaucuccaaaaaacugcuggaauuuuuacugaaauugaaucaaaucaguagauccaucuggcgagaacugguaucuuaauaauccugaguguuucagcucaugaacaagauaugucugucuccauugauuuaagucuucuuuaauuucucucagcaauauucuguaguuuuuaauguacgcauuuguacaucuuuugucaguuuucuaguuuucuuccaaaguguuccauguuucuguuguaauuguuaaguaauuuuuuguuuguuuguuuuuguuuuuuuaauucaagagauuucacuccgucacccaggcuggagugcagaagaggcacaauccuaguucacugcagccucaaacuucuggguucaagcaauccuccuaccucagccucccaauuagcugggauuacaggugugagcuacugugccuggcugcuuuuuaaauuuuuauuuccaaauguuuguuccuaguauaugaaaguacaauuauguuuauauauugaccuuuuauccugcaaccuugcuaaauuuauauguuacuucuaguaucuuuuuauaaauuccauuagauuuucugcauagacaauuaugucguucauuugagaauacagacaauguguuaauucuucaucuagcuuucuuucaaucaagaaagaaaggcuaggugccucucuaguuuucuuugauuaguguuagcaugguauacuguuuuucaucuguuuacuuuuaaccuauuuuaguuuuuauauucagaguauacuuauuauagauggcauauacuuuuuuuaauccaaucuagaaagaucuuucuuuuaaggagcuguuuaggccauuuaaauuuaaugugauuauugauauaguuagguauaagucuauuauccuacaauuugcuucauauuuuuccagucgcuucuuuguuccacuuuacuucauuuucugucuucuuuggauugauaaauuuuuuaugaauccaauguaucuccuuuguuggcauauugcuauaacuguuuguuauuguuuuagucuuugcuuuagaauuuauagugcauauuuuaaacuuauuacagacuaccuucaagcaauaguauacaacucuauacauaacguaagagcccuaaaaaaguauacuuucauuucaucccuucuggcauuuaugugauuauugucauauauuguauuuauauauauguuauaaaugcuacaauacguuauuuuuauuuuuauuuuuugagacagggucucacucugucacccaggcuggagugcaguggugugaucacagcucacugcaaccuccaccucccaaguucaagugguucucaugccucagccugccaaguagcugggauuauaggcacacuccaccacaucuggcuaauuuuuguauuuuuaguagagacaggguuuuaccauguuggccaggcuggucucaaacuccuggccucaagugaucugccugccucaaccucccaaagugcugggauuacaggcuugagccaaugcaguuggccugcuuuuauuuuuauuuaaauagucaguuaucuuuuaaagcaauucaaaugauaagaaaaaagucuucuauauuuacucacuuguuaccauuucuguugcucuacaucccucuguacaggugcacauuuuuaccuaauaucauuuccuuuagacuugaaggauuuccuuuaacauuucuuauuaugugagucuacuauugaugaauucuuucagauuuuguauaucugaauauauauuucuagaaaaaucauuuuguugaauauugaauucuagguuuaucggguuuuugcuuucaauacuuuaaagacauuauuccauuguaauuuuuuccaaagaguaaugcacuuuuuucuuuguuacucuguauauaauguguuuuuuuaaucuugcuacuuucaugauuuauuuuuuguugcugauuuugauuaauucaauuaugguguuccuugaugugauuuguuucaguuuucuuguguuugagguucauugggauucuuggaucuguugguuuauaauuuuuaccaaauuuggaaauaguaggcuauuguuuuuucaauuauucuucuucuccuauaccuuuggggauuucaguuauacauauauuagaccacgugaaguuaucccacaucucacugaugaucuuuguauuuuuuaaaauuauuuuucucuguguuucuuuuuaaauagcuucuguugcuaugucuucaacuuuauuaaacuuuucauuugcaauacauaauuuuauuaauccuauccagcguauuuuuaaucucagcuauuguaguuuucaucuuuagaaguuugagacuuuuuauauuuuccaugucucaacuuucugaauauauggaauaucauuauaaugacuuuucaauguagugcucugccaauuuuaucauuuguguccauucuuauuucauuucaguugauugcuuugucucuucacuaugguucauacuuuccuggguuuuuguuuuguuuuguuuuuauuuguuuguuuuuguuuugcaugccugguaaucugugaucgaaugccagauauugugaauuugacccugcuggguacuggauauuuuuguaauccuguaaauauucuugaguuuuguucuggggagcagugacauuaccugaaaauauuuugaucuuucaaggucucuaauccauuugauuaauucucuuccuggccuugaauaguuuccucacauacauucuuugaucagauucagccgaaucccagaggaaggcuuucugaagaucacugcaccucucucucaucucacaaauucuguccugagaacuccaguuaccucgaucuccccagagucgguuucaucuccucaacucagagguuugucaggcuccaccucaguuuccccucccugcagugcaaccuagaaacucucucaaagcaguaagcugggggcgaucauaagguucacuuuauuuuccaucuuccagagaucauuguucuugcuugguguuuggugucuugcaagccaugguuucaaauauuuugucugguuuguucugguuuagccuggguauuggcauugguuuuaacuguuucaggcaagagcauaaauuaagucccuuuacuccacuuuggccagaaacagaaguccucaauuuaauuuguaaccuauuuuaaaacuagucuacauuuucuuuugaaaaacuuuauauauuuauaugucucagcauuuuaaacaguaauuuaaagcuuaaugguacaaauaucacaugggagaaauaaagaccccugguuucaaagaaaaacacaaaagcucagagguuaaaugauuuaguguuugccugugaccguaaugcaaaccccugcaaaaaaauuuuacaugaccaugcaggggucucuuuucuuaguuaaggaugacuguacccuaaacuguaaaauaauugaguuuauggaagauacaauaaauaggaauaacugaauaacuguuuuguuuuguuuuuuuuuuuuuuuuggagacagagucucacucugucacccaggcuggagugcaguggugcgaucuuggcucacuccaaccucugccucccagguucaagcaauucuccugccuuagccuccagaguagcugggacuacaggcacucaccaccacacucagcuaauuuuuuguauuuuuugguagagaugggguuucaucauguuacccaggcugaucucguccugagcucaggcagucugcccaccucggccuccuaaagugcuaguauuacaggcaugagccaccgggcugguugggaaucacuucuuaaauacuuauuuggaaugaucguacccaacagaccaaaguaaagguaugaauucccuaaaacauugcuuuaauugaugauacuuauuggaguugauaaaaacauagccuacaaaaccauuuguaaaauauuauuaucugaagccuuccucacuucaauuuaugaaauacauugauaaaauguuacagucaaauuuuggcaaauugagagugcucucaauuuuaaugauucauauugcuaauuugauguuaccauuucauaagugaagauaugacauuauaguauacaaccaugcauaacuuuugaauagaacuuuguccugaccuaaaagaaaagguguaauaaugauagaaagugccauaaagcuaaucuccaaaccccacaaucacacauucaacaauaagguauccccuauccauguaaaauaaaauauuaacauagguaaauaccagagacacaaaacaaauccaagaguagauccagguuugcuggaaccuaaaauguauagaauuugaagguuucccuuaaggaacacaauaccaaauuucaaauauguaacucugacaaaaaggaagucaacacaguauuccugaaaggguuccaguccuggaaggcugaguuacccucaaaagcaacuauaaaccacaucaauacaucauacucaacccaaagaaaacguagcuccaacucaagucucccugagacgaaaaguacaaaauaugucuauggccacaccagugccaccugaugcaaggaaaacugugcaggaaggcaaaugggaauggaaagacauucaauauuaaucuauugcaguuaauauaccuugccuuugcagguguuacagaaccauaugaccucgugcauauauugucaggcccuggggucccugagguaaugcuucauuagcuuucuccuaaccccaccuaugagaaaaagaagggaggagacuucauggaaguacagacugacacaacuuaaaaucaucaucucucuucaaacaaguaacuuuauuauuuauuuauuuauuuuaauuuuuuuuuuuuuugagacagggucuugcugugucacccaggcuggaguacaguggcacaaucuuggcucauugcaaccuccaucucccaggcucaagugauccuccugcuucagccucccaaguaguugggacuacaggcgcaugugacugcaccuggcuaauuuuuguauuuuuugguagagaugggguuucagccauguugcccaggcuggucucaaacuccugacuucaagugaucuaccugccucagcgucccaaaaugcugggauuacaggcgugagccaccacacccagcccuauuuauuuauuuuugagacaggguuucacuaugucccccaggcuggagugcaguggcacaguuacagcucauugcagccuucacguucugggucaagcgauccuccugccucagccuccagaguagcuguuacuacaggugugcaccaccauacccagccaauuuuuaauuuuuuguagagguagggucucacuauauugcccaggcuggccuugaacuccugggcucaagugauccuuccacuuuggucucccaaaguguugagaucacaggugugagccaccaggccaggucuaaacaaguaacuuuaaaaaaccucaacauugggcacucauggggaucuugccuuuaauacaucccuaaacagagaaaguucaaaggccauuggguacaugucuaccuauagguuuuauuuaaccaggaacauaaaaaggaagguuaaaggaaacaagugggugaaaaauggggagauggacuagaaaugucaucuagauaugugguccugcuagcacagagauuuacaaaaugcccaggaucccaggucuaccuggaccucuuagcuccauccacugacucagucacugaccaccuaaacaguugcuauagagaccgccuaagguucccauggaugggugccguugacuaaacauccugggaaucucagacaaaagguagcaacccuaucccaugccuggauuaauagcugggcacggaacauuuuuuccauccucagcuauucuguucuugucuaaaucaauuugcuaugccauuauguuacagaauguauucauacagcaauuuuugcuaacuuacuucuugcccuuccauacgcaguaacaaacagagagaaguccauccaccaugaaccuagccugaggagcauugcauucucuggucacaagucuucauauuuuuuuuagaacacugcagcgcguuuguaaagagacacuaaauuaaaaacaaauauguuccugugcauacacacacacucucacgcacacucaaacacacacucacuuacacacacucacacacguacacauacacacacucacacguacacacauacacacucacacacacacauacacauacacacucacauauacacacauacacacauacacgcauacacacacucacauauacacacauacacacucacuauacacauacacacauacacacucauauacacacauacacacauacacucacauauacacacauacacacuuacauauacacacauacacacacucacacacauacacacucacacacucacacacauacacauacacucacagacauacauacacacauacacacucauacacacauacacacucacauauacacauacacacauacacacucauauacacacacucacguguacacaauacacacauacacacucacauacacacauacacacucauacacacacauauacauacacacauaugcgugcacacauauauacacacauacacacacacacacacacggcaauccuguagugccccacauuucuauauaguaaaugcuaaagagaaaagccuaugucaaauauaauuuccucuggagauauuggaaaucccaggacauucuccaagaugguguuucuuggugucuuucccacaaagaaauauuaaacuaauggcguggauuacaccuucggugaaaggugaaacugaacaccaaggcagccccuggaggauuagguuuugauuucugacaccaccuguuaguguaagaaucguaaccgcugagagcacaaaauggcucagaggcgggacugcuaguaaaguucacaagugacccugucaguuuuuaauuucagucauuuugcuaggcugacaagguaaaaggacuuuaguaaaagggcauccagugccacgacuguagauuuguugaaucagggucauacaguucacaaaaggaaaggagcccuggggccaucuguuuauauugaccauuucucuacauuucugagucagcaacaagcaggcaauugcaucaucugcccuccaaauaaccacugucaccccaagcacacacuucaucccgaaaauguuucauuuuuuuccccuuuguguaaagaaucuuugaaguagccagaagaagcaugguauuuuauuuaauauucacauaguagcuugugauuauuauaauacauuuaauuagucaauucuucaucagccuacuuauuugacaucuuguugaaacaagaagugguuuacaaggugaaaaggaaagaguauggcuuucagauucagaugacaguaguucccaacgcugaacccucaauuugaagauucuguaauuuuggaaaagcuucuuauucuaaguaucaguuacuuuuucucuaaauagaaauaauaccucugguggagauuuguugggaggauuaaauaaauauuauccauauaucuggcaaauaauaaguagacaauagauauuuccauuucacaguuccuauggcaguuuguguguguguguguguguguguguguguguguaugcaggauuauuuugugugacuaaugacaaaauucccuaaguuuucagcaaaggucucaaauaauucuuuccaugaaagccucuuaucgaggcauuaaaaugauugauucugggaauauuuaauuuuauuauucuuaaaagagcucuguaauaugaaguagcuuauuuauggaaccaaaaggucuucuucuuuuuaacugaauucccuauuagauuuccacguuuugcuugggacuguuagguugggcaaauaaaauguaguggaaauuaaugggacaaauuggaauucggcaaaguuuauuuggcuucgcucuguucaaacuuaccacacaaaauccuucacgucuuuuaacucccuugugggugaucuuucucccaaauaacccuagcuuucugcauucaauuaauccacaaguauuuauuaaagacuuccacugagacugugccauacuaaacacuaugggguaugcaagaaaaauaaaugaugacagauuauauaguacuuagugguucacaaaccacaaguagaaccugucuccuuaccucuuaguuucaccuugaaaaaaaauuuccacacucuaggaacuugaaauccagaaaaauaagauuaucucaccuuaaucaauuagcaagcaauugaugcuuaucuauuucuuaagucgugugaccuaaacuuucuuaaauaguuggccagaaaugggauauaucacuagggguugggucaccaggaguuacaucauggaaauguuugcauuuuagguggauguuaaaggcaaggagaaaaaaagagcggcugugaaauagugaaaguaugugacuugugggcagaguggaucaccagauauuuauaaggagccagaugauuaauuugggaucagggaggagaagguacggcuagagacacugccuuuagcuagaugagaaaagcuugaauacaaggcugggcuuuaugcuauuucauucuguaagccauuauggugucaguuaggggaaagaggauuggaagcaagaggguuagaagaaaauaguaaacccaauaagaucagauucaauaaagaaauuuuaauuuguuucucgaggguucaccucuugccuuguuuuuccauuaauuuacccacugucuuccccacucaaauaacuguuucacuuaacuguccucuucauucaguuugguucaguucauauacuuuuugaccaccuaugaugugcuaaacacaguccuaaagaaacaaaaagugagaaucaauccacucucucaaggagcuuacaguguagcccagaagacauuuucugaccugagaccugagacguuuucuggguguccucaaggucaugauuuugccauaaacccugauagcacaaaagcagggguggguacaacugcuggcaccugagcacccauggcggcaguaucacccaacugcacugguugucauauucuuuugucaggcaauggcagaaacaaaaauugccaauuucacuuaagaacguucuccauacagcgguaaaaauucuuaaccauauuaaauuuuaaccuuugaguagaugucucuuuuuaauaauaauaauaaaugaggugaagucucacuguguugccuaggcuggucuugaacucuuggacucaagggaugcucccaccucuucagccucuuaaguagcugggaccacaggcgugcuccagggacucagaugucuuuuugauacuuccugugacucacugcauaaagcacuucugcugcacacggaaacaccgugacuguuucaagauaaaggcgccugugccauuguuugaguugaacauaucgaggcaccacugaacaccauguuucacagaacauuuuaauuaaaaugccagacuacaguuaguccaauaugagcauuugggagaaauguucucaaaauuuaacaaaaugaagcuaucacuuugagaaacgcaacugacaguauuugcaaauaaaaaaauuuaacuuuuuaggaaaacacuagaauuuuggaaauauuuauuugccaccaguaauuugucagcuuguaaauacuuaaagacuuuuuggccaggcgcaguggcuuaggccuguaaucccaggacuuugggaggccgagauggguggaucaccuaaggucaggaguucaagaccagccuggucaacauggcgaaaucccaucucuacuaaaaauacaaaaauuagccggaccugauggcgggugcuuguaaucccaacuacuugggaggcugaggcaggagaauuucuugaacccaggaggcaaauguugcaaugagccaagauuucuccauuguccuccacacugggugacagagcaagacucugucucaaaaaaaaaaaaaaaaaaaaagacuuuuugaugagauuggcggugauacuaaugaccgauuuuuaaaaaguauguauuguacaauagaugugucaacauacuguacaucugcacaauucauuaagccaauguaugagguuauaaaaucaugcuuaaguaaaagauccaagugcacuguagaccaaugaauuucaauguaacagaguucgagaaauucauuaauauaguuugaaaugucacauuuuaacuaacccuuaaaaaacuuuuuuaugucaaauuuugguauacuaacaaagaauacccacaauaauuacguagaaagggacaaucauaaucuguaugugggaggccacauuuucuuuguauacuucaaccaaaauaacaacacaacagguuaaauacagagacagcgaggggaauccagauguaagagaucugccaaaagguaaaagaaaaaauacuacucuucuuacuuauauuuuuguuguuuugggaaauauaguuucuuuucauaaaacagguaaugaguuuauuaucauuauuuuaaaauaaauaaauaaauauuuaaaauuguuuucaguuuucauucccaauaugauagauauaaccaacagaaacuaaaguucucugagguucuuaucaauuuuuuaagggcaaaauggauucugacaccaacaaguuugagaacugcuggucuaaccaaucacagggcguccagggaaggcuuuucccacauuucaggugcuccuuuuacccucugauuaauagaaaucagugaagcucacuaauuaucagggugcagcuauuacucagaacuugcuaagcuuccuccgucugccauuuuuaugucauguauuucccuuuccauucuauuuauuuaauuucauuuuuccauuaauuuaauuaauuaauuucaaugucauauaugcuuugcaggcuuuuuucuuuucaauauuuaaaaaaaauucaucaaaauuguuuucgcauaguuuugaggcaaauuuucuacagaacuugacaaagaaauuggaucucucucagcugccaaaccacccucaaauuuucagcccccaaaggcaauuacuaucaaaguuuccagcugauucuucgguuaucuuccucuaucucuuuccauaacacacuuauguuaugaagucuuaauuuuccaaucguuagcaugcuaucuacucacuccccacguggaagaugagaauugagcuccuuucacuuccuggucccuaaaccagcccucuccuuguccaaacacuccucauuuccucauucuccccaaaccaacauuucaauuagauaaaauuuaacugcauacauuauuauauauguaugcaugauucacaauaaaaccauguugcacaguuagcaauuuuucuuucucauuuguuuuguuuucucuagauuaguaauuuucauuuucuuucuacuuaccuuuuuuucagccucaaacuuuucuuuaccugcauaaucugcuggugauauuguaaucacauuagcuguucucuuauuuucaucuugcugagguagucacccugucugggugguugcucuccaggcagcucggugguagccaucuuggaucucuucaccaggacucacccucuguugcugaccccuuguccuucucuuuuuuguuuuuuuccuuaguuugaugagacacacucuaguagcuuccccaaaaaggguacauggaagauuaaacuucccaaaauguauaugccuaaaaauauauggauuaauagauuguaaaugaauaaacaaaaaaauagauucauuauuuggaagauaauuuccauuugaaaaucauuuuacuucagaaauuuaaaguccuugcucuguagucuucugcuuucaggauggcuguugagaggaccaaugcuguuuucauucuugguucuuuguacaaaaacuauuuuggugguuguuuucuuuuucaggagaauuuuggguucuucuccuugaccacacuacugaaaauuagugugcuuugggaauguauuucaguuuacugucuggauauuggugaauucuucagcgccuaaacauuuuccuuaauuauuuuguuuaaugauuucuucccugcugguuucucaggucucucuucccgugauucguuuuauuuauuuuuuauguauuuuauuuuaucuuaauuuuuauauuuauuuuauguuuuuuuuuuauggagacagagucuuacugucacccaggcuggagugcaguggugugaucuuggcucacugcaaccucugccuccuggggucaagcaauucuccuaccucagccuccugaguagcugugacuacaggggcacaccgccacacccggcuaauuuuuuguguuuuaguagagacgggguuucaccauguuauccaggcuggucucgaacuucugagcucaggcaauccacccaccuuggccucccaaagugcuaggauuacagccugagccaccacgcccagacaucccaugauucuuuuaaucagauauucgaccuuucgcaguggucccuuacuuuuaaaaaaagcauuuuucuccuguuuugcauuuuugucauuuuguuuuuaguuuguggagauuucuucaaguuuaucuuccaauuucugucauuuuuuauuccuugcuguuuuauuuuuuaauuucaaagcgcuguuucuuauucucugaauaaugcuuucuuaguaucgucuucuuuuuucucguaggaauaaugccuuucuuaucucuuaugagauuuugaaguuuuuuucugccucaauauuucucuuuucuuuuaguuguuuugccuuuugguuagcuugcuuggggcuuugucucuaaucuuagaggauuuccucagauguuuugcugauugaugccugguaguuuguggguuguauucaaaauuagagcacucaaaaacuuacuugaagggcaagacuaauaaguagacuuccugauuguggaaugcacugcagagugaucuaauuuggcucuuuauuuggaaggcuccaaagccaguaucauuaggccuuuuuauucccugauggugcuaauagauuucccaaagaaggcucauccucugccuagcugcagaguucugggggcugagcuggggaggaagucuggggauuucacucuucgaacauuugcucaauuaccuuagcacauggccucccuuuuaacugguguccuguguuccacugugcccggcguaagugaauauucuuuauaaagcuacuugaggguauuggaaucuaauaacagagagaaauggaguuugauaauaaaugauggcuaacaucaaucucucauuauuuucaguauuuauugaguacacauuauuaggauaugcucuacuagaaacucuuaaaaccuguaaagagguguuggaaagcuaauuuuugucauaccuuagaaaaauaaauucaaaagggaaaauaagagccaaaggcuauuaaaucaaaggugacuaaaauauccuggcaauuaaaaucugccuacucugugggaauuaugaauugacugcaguuuuugcaucuguuugcaaucaugcuauucuccaaggauagcuggggugaguggcuaauggauaacauacuuuaaauaucuuuccaguacaaauuuuuuaaacucucaaauuauugaagguacauuuuucacuuaucucuugaucucugauaaauuucucuuaacuguaucaucuacauccaaaauaugcacgauaccagcauuccccagugugaacacucaguacuaguuaaugcacaauuuucauuuugaucuucagagacagcaagagggcacaccgaacacugcuauacuuucauuguaucugauuuggcucugacuuuguccuaaacauuuuuacuuuuuuacaaauauuugaauuauuuacaccaauuuuagaaaccaaaucuacucauucauuuccacauugccaauaaucguagcuaaugcuuuuuggccuuaugcuuugugccaggcccugugcuaaauguuuuaugcauauuaacuauauucaacccucacagcaauccagcauuacagaugucaaaaccaaagccaaggaggcagaauaacuuccucaaggucauuuaauuagucaguaauaaaagcaggacuuaaacugcccccaacccuucauucuucaauauuacaaaauaaggccucccagaauauggucacaauucuuuuuucuuucuuucuuucuuucuuucuuuuuuuugagauggaguuucucucuuguugcccaggcuggaguccaaugguacgaucucagcucacugcaacccaugccucccggguucaagugauucucuugucucagccuccugaguagcugggauuacaggcaucugccacuaugcccugcuaauuuuugguauuuuuaauagagacaggguuucaccauguuggccaggcuggucucgaacuccuaagcucaggugauccucccgccucaaccucccaaagugcuggaauuacaggcgugagccaccgcacccacccacaauucuuaaauuacaauagaaucuuaacauuagcauaacuaauggggagaaguagaggaaaaggcacaagaaaugccaacugaaauuccaaagaaggaaaacauguuguaauuauuggaaugagauaaaaacuguuaagcauacaugaaaaccauugugcaaauugugaaauuuaaucucaguucuguuuauuuugugacaauguaaaaaucacaauuuuaaaauaacgauuuaauaauugcugguacucugccugugaaaauguguuuguucaugucaacaccuacuuaugaaaaaacauugcuuacuuggauaaauucaacuggguuuggaagcuacaguuauuacaaccaaauaauguaggcuccaccaaaaaauauguauauacauauuauuucuaggacuauuugggcaacauagugagaccucaucuuuuuuuuuuuuuuucgagacggaguuucuuucuugucacccaggcuggagugcaguggcggggucucagcucacugcaaccucuaccucccagguucaagcuauucucgugccucagccucccgaguagcugggauuaccggcucccgcuaccacacccggcuaauuuuuguauuuuuaguagagauggggcuucaccauguuggccaggcuggucucuaacuccugagcucaggugaucugccugccucggccucccaaagugcugggauuacaggugugagccaccacaacuggccuagagaccucgucuuuacuaauaaauaaauaauaaaagaggaaaacagaaugaugcagaguggaaggcaauacccuaaugcagguagcauccaaguccggaguugaugauccaagcaaccccagaagcuagaggcuuugcugaggucacagaaugccaacaagccccucaaccacucacagcugauugcucacucuugacuagagauuucauucauacauaccuaggauuuacuuuucaccuucacuuuuuuauucuuggucuguguauucuaaaucagauucucauucuccauaagaaguguggaguauuuuccauggaacuuuaugaggagaauuaagauaaccaaagucuguaaagauaagaguucagauguuauccauugaggaauaugaauucugcuuuggauuauuuauacaugcaugcacaggauuucauuauauuucuccauguauguuucauuucaauuggucucagaaguguucguuauauaaauaagccauggcaagcuuaagaccucacacugcauuaaacaugaaguguuaacuguuuaaagugugugagcuucucuaugauuguuaaugggauuuugugccuaauuaaauguggagaccugucauauugugucaacauccauauuucaugcugaguugagauuuuuacgcaucugacaauugaugaguauguagggaccaugagugaggauaucaaaagaaauuuguauaacuugacucuuagggagugaggaaauggcaauaaaaauugcauguauuauuugcccuaugaucuugaaaacugaacauagcucaaaugcaagagaaucagagaauagcuuagcuuuccacacucagacuagcuuccccuuguaagcaauagaaugauaaggcuggaaauaccuuucuucugcucaugcuaacgcucucgauaaaacccguugacuuugcauagcuucacccgaugucugaaaagaccagcugucucacuuuuaauucuggguuuucuuucaaagucuucgugauuucugauagaauucugaugucccugaucaaagcaugcugagaucaguuugccauauacaauuuccaauacagaguuucugccagaaauaccacugaauuccuuucuuaaaaagauauuuuccugguacuucaggcaaguaauguaaaagaaaggggaugaaaggcuuaaaaugagauuaagagccuucagauauuuaagaugugaucaacuacucuuaauauuuauggaacacuacacaagagaagaagagcuuaauaauuagaaagaauguuuuaauguuuuaucaccuuacagcauguuucaaaaacuuucaaguacagcaucuucuaagaugcauccccgcaccaaaaucgguuagaaggacauuaucauucugcauuuauaccuaaugaaucugagguucagaaaggcugagucuugcauucgccucuagacagcaggucugcaagaccagaucuccugacaccugcccuaaagcuuuucuugcuccagcaaaaacugccuuucaauuuaaaacgauuuuagagauagggucuugcucugcuggagugcaguggcccgaucacagcucgcuguaaucucaaacucuugggcucaggcgguccucccaucucagcuucccaagcagcuaggacuguagcauauaccaccauggcuggcuaauuuuuacuuguuuacuuuuuaauuuuuuuguacagaccacaucacucuauguuguccaggcuggucucaaacuccuggccuuaagcgacccccccaccucagccucccaaagcacugggauuacaggcacaagccuccgugcccagccaaaacugucuuucuauauagggaaauguguuuuuuagaaaaugaaagcucccuaaaaacuggauaugacuuucaaagaaaacaauaagaaauuccuuuaguugagugucuuugauuuagcugauuacugaaggcagaggacugaauuugguaucaucucaccaucacuuauacccaaggaucguaauauuacugcuacaagaaaaaucuguguucucuauggaaggucauccaguauaugaaguauguagaguaagagaaauuuaugagagacacugugguucaauggagaauguuggcuucauaguccugggcuauucacuaaaauuagguguaaucuuagauacacccucuuauuugcagaauuuacacucccuuucuauaaaauuuguaaggaagguuggcauaaucucuaggaucccuucuuucuugaagaaacuaugacuuucugagguuccuccucccuucuccauuaauucaacacauuuuuguccucaauauccucacugaaagccagccucagcauuuaagaaggcaaaaagaaagaaaauaaacagaagaucuuauuucugugagguuuuucauucuuauuugugcuuacauuuuaaguguaccucauucaauaguucauuuagaaaauagguaaacuaaaaaaaaaaaaaguaaacuagaccaggcaugguggcucaugccugaagucucggcacuuugggaggccaaggucaggaguuagagaccagccuggccaacaugugaaaccccgucucuacuacaaauacaaaaauuagcccagugugguggcaugugccuguagucccagcuacucaggaggcugaggcaggagaacugcuugaacccaggaggcgaaaguugcagugggccgagauugcgccauugcacaucagccugggugacagagcaagacuccaucucaaaaaaauaaaaacaaaacaaaaaaaaacacaagguaaaccuauuauacugaaaaugcguaguuuucacugaacucaguuuccaugcaaaucaauuuuuguuuucagaugucagggcuuugagauccacagucauuccauucccaagaaccaguguuucaucuuacuuugaacccucauggagaagauccaagugcagaggcuauuucaguacucaaguagacucugugcuuggaucagcuccacagaaagcauggggaagaugagaaaccagcucaauuucagaauaaaacaguauaaaucaaauuuaagaacauccagagauauuuagcccaggauagaaaacuuuaaaugaguucuuuuaggccauaaaagauucuuuuuucaaaauuauuccuuuuaauuccaaguuuccauccuaacuggucuucaugauuuugcuacaguaauugcaaucugucuaaauaacgaaggguguauuuuaaaggauguaggcugaggauguuugacaauguccauuugauuggauaugucagcacaauauuugcuuuugaucauucguaauagcaauauucaaugaaagacauuuugaauuagucaacuuguaacaaaaauauuuacaucuuuucagacugucucaacagcucaguagccaaugugaauauagaaaaggaaaugucauuauaaagcaaaaaaucagagucuaaauugacuacugaagauacuuaguagaguucuauuuccaccugucauuuuuaaugcaaaacaacugaugcuacauuguguccuauucaguuuccccacuacuccccaaguaccccggcacagaaucugaucauuuuaccuuuuguuaugcuauccuccauccugggucacacucacauucacugagucuucugagcauuguuggagaaaagcaggacauugugccaggaguuuguuuguuuguuuguuuguuuguuuuaacaaaucauuaaucuguaaauccgccugaguuaauuggggguuucggcaaauggcuaguuccccuaguaaucagugccccuggcugggcgcgguggcucacaccuguaaucccagcacuuugggaggccgaggcggguggaucaccugagguggggaguuugagaccagccuuaccaacauggagaaacuccgucuccacuaaaaauacaaaauuggccgggcaugguggcccaugcuuguaaucccagcuacuugggaggcuauggcaggggaaucgcuugaacccgggaggcgggagauuguggugagcagagaucccgccauugcacuccagucugggcaacaagagcgaaacuccgucuuaaaaaaaauaaaauaaauaaaaacaaucggugccccugacauggcauucccucgaauaaauaauagaagcuuuugacuucuuccuccauccuuucuacuccuauuugccucauccaugguagaagcaggugccggaaccggcugaacagucuaugccccaccucauggcucuaauucaucccuuaaucauuccuuaucuugccuacagagucuguucuaggugauuccacuccugauggccacacugcuuuucauacauggagaucuguaccuuccccuuucugccuugccaacucugugugacacagagccacaucuuucucacugucuccaagcacaucaccguagcuucagggaucucucauucuucaguguuaucucagagaagaagcuguagcuccucuucuccaagaccaaggccuuuccagaugucucaguucuguggaaccccaccuucuuuuaaauucuacacuuucagaugcaccgguuuuuuuguugugucuuuaauauuugauucuguauuggguuuuaccuuguaaaucugcucaaaccuucuaucuaaaaacaaaaagucccuuuccuuagcucugcugggauuuaucucuuuuuagguuaaccaauuaguugauguauuauuuuuacccuacuccuguucucuaucugcacacuuuuugcuuucuuucuuuucuuuuuuuuuuuuuugagauggaguuucucucuuguugcccaggcuagaguguaauggugugaucuuggcucaccgcaaccuccgccucccagguucaagcaauucuccugccucggccucucgaauagcugggauuagaggcaugugccaccacaccuggcuaauuuuuguauuuuuaguagagaugggguuucuccauguuggccgggcugguuuugaacucccgaccucaggugauccacccgccuuggccucccaaagugcuggauuacaggcaugauccaccgagccuagccuugcuuuacuucuuaacagucugaucugacuuugggugcuuccuugacuggaucuguuuucagugguuaccaaugaccucuuaaaugucaaacccagagaucuuuuguucagucauuauucuucuggauuacucaguagcuucuccuaaaauccguuucuuuauuuaguuucuaggcuucuacauggaccuaguucucuuuuuaccgucaaguuuucuuucuaaccaagguuguucguuuuccuuuuuucuccuucauucuuuccuucaaccugagcauucauuauucacagccucccucacuucccuuuuauuucucccucaggaauuucaucucuuuucauggcucuaaagaacaccuuucccaaaucuuuagucucgaacucacucuuuaucuuuaucugcaauuagauaccucuuacuaaaaguccugugguuacuucagacugucaacaucuuaaacuggacucauauauuuuuagccaaaaccaguuuauacuuuauagauauaauugaaaacaucauuguuccaucaacccaaaccuaaagauuuugaacaaagucuuucugcacaaauguaauacaauauauacuuaaguaugauaagaggacuaugugcaaaaguucuaaggaauaugguugacuaagaaaucugaagaauuggaaaagacauggggaguuguuuaagaagaaaauuuuagagucuuguaagauugagcagccaagauccuauuucuuugccuuuuauuuauuuauuuaauuauuauuauauuauuuuucugagacagagucucacucuauagcccaggcuggagugcaguggcacaaucuuggcucacugcaaucuccgcuuccugaguucaagugauucuccugccucagccucccgaguagcugggauuacaggcacauaccaccacgccuggcuaauuuuuuuuuuuuuuuuuuaaauuuuuaguugagaugggguuucaccauguugaccagguuggucucgaacuccugagcucagaugauccacccaccuuggccucccaaaccguugggauuacaggugugagccaccaugcccagccgcgucuuucuuuacacugauuuaucacuccuaccuuccuuucucuuucuucucccaucagauaacauauuuaguauucucucaugcauuuacuuacuuauucaauagcuggcuagucagcauuuucucugcuugugccugacuuccucuucugggugguuuuuaacacauauauuaaguggagagauuuaguuuucucccaaggguauuucuguucccagauuucccccuaaacuaccauauuaauauucuuaagacaccucuucaugcacaucagugcugugcuaagaagcuuuucauuuacaagaucaaauccagguuucuuugucuggcauuggagauucuuaaaaguuugaaucuccucuucuccaccucuacucccucuucacauccaucuuuagaacuuccauucauaucuaucugucuaucuaucuaucuaucuaucuauauauauauauauauauauuuuuuuuuuuuuuuugagauggagucucacucugucgcccaggcuggagugcagcggugugauuucggcucacugcaaccuccaccucccggguucaagcgauucuccugccucagccucuugaguagcugggacuacaggcgcccgccaccacgccuggcuaauuuuuuguauuuuuaguagagacaggguuucgcaguguuagccaggauggucuugaucuccugcccucgugauccgcccaccucggccucccaaagcccugggauuacaggcaugaggcaccgugccuggccuccauucauauuuuuacaucaaaagacucuucucccaucuacuccuucuuuuguaacugggcuaugugcauucaagauuccaaagcauuccuucacccuucuugccaagaauacccuucuccaucuagcauagccuuuacuguaaaucccucccuuccuguuaaggccaggccaggcaccacaucccuuauuaggccaccuacaauguucucggucuucagugucuucucucuugucugaauuccugcagcacuaaucgucuauucucuuccauugggaauuugcaugugauaucccauguugcuauguauuuuuauacauguaagcaaacauucuuuuuuuuuuacuaagugauaagcccuugaagaacgaguuaccucuucguguuacugacauguaagaugcuagcauuuaguaaaguuuaauacacuuggcuguuuugacaacucuuucaaugagauaaaaauuucauuuucucucucauucccaaaagauaccauggacaguguuaacacauugcaguauauuuuuaaaacucugaaacugauguacaucuuuaaaauacagauacaauuaguaucauuugcaaucuucucuguaguccauaccucuacagaauuuaguucaaucuaacaacuacguauagauugcuuguuaugugcaaaacucuauguaggaacauggcggaggcagagauaauaugauaaagucuugcccuugaggagugaugaccuuguagugacaugcccauguucccauccucuagugcugggugugaguguagcacugggugugaguggaguuguaagacauacacaaagugguuaaugcaaaugaauaagcaacaaaauuuucuuucuuuguuuuuuuuuuuuuuagacugagucucccuuacucugucaaccaggcuggagugcaguagcgcgaucuuggcucacugcaaccucugccucccagguuuaagagauucuccugccucagccuuccaaggaucugggauuauaggcaugugccaccaugccuggcuaauuuuuguugugucuuuuaguagagaugggguuucaccauguuggccaggcugcucuugaacuucuaagcucaagugauccgcccgccucagcuucccaaagugcugggauuacaggcaugcgccaccgugccuggccagcaacaaauucugcuuagagaaauuggaagagucuguggagaaauuggcaagaaaauuaaccguuguuaauuaauccauucuguauuaaacauuauuuauucauccuuaaaauaauaacuaaucugcauuacuugguuaauuaaacaacuuagguuuuuuguuucauuuuaugcaaagcaggggugcuccggaugcaccaaagggauauagaauccgaagacaaaggaaaaaaacaacugaaauaugcucuuccucuucgacugucacucaguugcucaauguuauacucugacgccagacguguggggcuuuuccccacauaccaagcaagcaaucaguucugcagugagcaccaacuggguguccuuuaacucaauucaguucugacgcugucucccuggagauagcaucagaucccauagggugaggggagggcucagaaucccacaagacgauaccccauuucugaugccaagcauuaaguccuauguugucuuaccugugcuccugugcuccugacccuuuaguuacaauuuuguacaauuuguacaauuuguacaauuuuaguuacaauuagucaacuaauuuugcuagagcagcacaccgaacucagggaaacacuuuacuuacguuuaacugguuuauucuaaaggacauaaaugaagagacguauaggacaaggcacgcacgaagaggcguggagcuuccaugcccucccugggcaccaaucuccaggaaacuccacauguccaacuauccgaaagcccucagaaccccuuuugggggguuuugcggaggcuuaauuacagaagcaugauugauuaagucgcugguuauuggagagcaacuuaaccuucagccucucucccuuucccagugguuggaggauggggcugaaagucccaacccucuaauccugcuguggucuuuccauugaccagccaccauccugaagcuaucugggagccuccagccaucagacaacaucagcagacaaaaagauccuuaucauuuugaggagcccaaagauuuuaggagcugugccucaggaaacuagguggaggaccaaauauguauuucacaauaucacaauaacauuugaucuuauuuuuucucuuugugaaaugaauugguguaggaaacuuuaguuuugaacuuugagaacuauauaacuuuucacagacuagaggaaugagaagauccagagaggccugauaguugaguucuuugaaacacauauguagauuauacauaaaacaacauuggcuuuguagauagagaaagggaacagaguaguagcagucaagauacuaaaaacacauauuuugaaacuccaaagaucacaaaagaaaugaagugaaagagaugugugaagagguguggacggcuuugaaaagggcuaaaaacagaggaaugaaaucguuuuucuuauaaauaggaaucacauagccuugauugauauaaagaguuuuugaagacacaguuggagcauuuugaauacaccuguuccuuuguauccauugggguugguuccaggaccucaucucucaaugauaccaaaaucaguagauucucaagucucucauauaaaauggccuaguacuggccaggcgcgguggcucacgccuguaaucccagcacuuugggaggccaaggcgggcagaucaugaggucaggagaucgagaccauccuggcuaacauggugaaaccccgcgucuauuaaaaauacaaaaaauuagccaggcgugguggcaggugccuguagucccagcuacuaaggaggcugaggcaggagaaaggcgugaacccaggaggcggaacuuacagugagccgagauugcgccacugcacuccagccugggcgacagagcgagacugucucaaaaaaaaaaaaaaaaggccuagugcuugcauauaaucuaugcacagucuuucuucuacuuuaaaccaucucuagauuacuuauaauagcuaguacagugucuauacaucacuucauucguguggauucaagguaguacuugaggcacagcaaauucaaguuuugauuuuuauaacuguggaauuuuccuuaauauuuuugaucugagguugguugaacccaugaauguggaacccacagguauggagggucacccuuuaguucugugcuuguucccauugaaaaacaaauaauauacuuuuaaaauuauaauagucucacauuauauagggcauuucucuuaagauaucaagugucaaaaauagcguuaggccuguauaucaaucccuuuugaaauauaauuacuuaguaauuucuauaaaagaucaaugucaagguagguuuaauauaguaaguugcccuugaugauauauuuuguguuuacaucaauuuuuuuaaaagguaugcuuuguuccuaaaacuaaauagaauuuuuugugggaauuguuagacuccuuaccugguaugguuuggcuguguccccucccaaaucucaccuugaauuguaauaauccccauguuucaugggcaaggccagguggaaauaauugaaucacaagggcgguuuccccccuacuguuaucaugguagugaauaagucucaccagaucugaugguuuuauauaugggaguuccccugaacaaacucuccugcuuaccaccauguaagacgugauuuugcuccucauuugucuucugccuugauugugaggccuccccagccauguggaacugugaguaaauuaaaccucuuuucuuuauaaauuacacaguuucagguaugucuuuuuauuagcagcaugacgacagacuaauagauuaccuaacacauuuuacagugcauuuucucugauuacuguccuaggccguagagcagucuucagugaagcaagccuggcccuagccuuaggugauccacaaucugaugggggauguaaaauaauagucaaauaaucaugacagagugaucgaggaaaugcuuuugaaaccucagaaggagagcagccuaggacauuuugggaggcuucccagaggaauugauauuuuagugggaucuugacaaugggucggaaggaaaguaagaggcuucacaaagaaggugauauuuuuuggugggaucuuacagaacuucuaagaguggagagagcucuuucuuucucagagaggaucaauaauuuuccaagaaucuucaguguacuaggaggcuuuaauauaucuugcaagauaaaaaccugccaagcacaaaacauuacaguaucuuugucucaaaucagaagcauagcaaaguuuuauugcagauaagcuugauucauaaucuucuuaugccaaaccaucagauaauucaaauucugucaaaacugagugaaaaaaaaauccaaagugugaucaagccuucugagaaaaauauaucagcucuuuagaaauuuuuauuuauuuauuuauuuauuuauuuuugagauggagucucgcucugucacuaggcuggagugcaggggcacaaucuuggcucacugcaaccuccgccuccuggguucaagcgauucuccugccucagccucccgaguagcugggacuacaggugcgcaccaccacacccagcuaauuuuuuuuuuuuuuuuuuuuuuaguagagauggggguuucgccauguuggccaggcuggucucgaacuccuggccgcaagugaucugcccaccucggccucccaaaguacugggauuagacgugagccgugagccaccgugcccggcucagcuccuuagaaauuaaaaugcugaaucaauuacuguggauuuguuagagauaccucugaauuccacaggucuggagagaugugaucagguagcacaucuaaucuaugguuucucaauauugaugcuguugacaagggacaggaugguguuuugucguggaggacugucuugugcauugcaggauguucggcauccuccuuggccucgaccuucuagauuucaguagcagccgucauaguggugaugaccaaaaaugccuccacacauugacaaauguccccugaggggcaaaaucacaaccaguuuaaaaccauuaaugucaucaauauaucauuuccucucccagaaauggaguacagaguagagacguggagauaggagugauaaagacagugauggcauugcucgcagccaacugugcacugccauucuggauucucugcacucagccuaggaccagugacacaaacuggcccuuuaugacuuuugccugagugguucccucagauuuagaaacagaaauccaagccacuugcuugucuugcuggaaagaauacauugcaucaguucuucaauuuauaaccaguuugagaauucaucaguauacuuacuucaaaaaaaaaauucuuaccaugugcaauguguaaacaugaaaaaaaaaauccaagggaaauaaaacccaugaaauuuuuggcccacugagaguuaacgcaaccaaacagaaaaguugauccaucaagggaaacauaauugacacaaaagacagcaguaaaaugaaacccaucaucacauucuaggaaaucaaucagucuuugaacauggcaaguacaggagaaaauguaacguaguuaacagaagagaagugggaagugaguuagucagcaggcacuggagaauuuggcuaaagagaauguccugcaagcaaaggacucuuggcccuuuuucuagggccccuggccagucccauuguucccaaggcuuuggcauguugaacugaagggcagcuccagcccaggauggaccagccuugcccaguggucuuucaauccacugggucaauccauggacccuguggggcuccucucccuaguucugaggccaugcaaucuggaagcaucaaccuucauuucgacucagacuuuuaagaacggugaaaaggcaaccugcaguuauucauacggaucccacccuuuuaucccagggaaguuucaaaaggguuuauggccaagauauuaaauuucucuuuguauucaccauuggugugagccaaagagaaggcaggguauuccacaggguauuccagauucuuucaaucuggaaagccaaacuaggaaggugccacaaaagcagaacaaacacaggagacuucugguccagaaugcuggaaggcgacaaacugauugaugagugccaucucucuccuuaguaacugucuucuuuuaagaaguauuaugcggccuggcgugguggcucacaccuguaaucccagcacuuugggaggccgaggcaggcagaucacgaggucaguagaucaagaccacccuggucaacauggugaaacccugucucuacuaaaaauacaaaaauuagcugggcguggugaugcaugccuguagucccagcuacucaggaggcugaggcaggagaaucucuugaacccaggaggcagagguugcuguaagucuacaucgugccacugcacuccaaacuggcgacagagugagacuccaucucaaaaaaaaaaaaaagaaguaccauucuucuuuugacuuacaugcuguuuguguucuuugcuguuaaugguagugauuccagucuuacuagaacacaaucucucaguucaguuuuaaaucaauaugugcucuaggaaacagcccauucaaggacaaauccccugauccuguuuuguuuguuuucuugguccuagccauguuuuucucccuucuucacuuggcagcaauugaaggacucacgauguuccuuuaugcccccuuuuggagaaggagcucuucaaugcaauaaguuagucuagacaaagaaaauuagggcaauuaguagaaagcuagcaaaugugcuguguaggaggcucugucauuacggacccucacucaggcuccugugguuugguguguguacagaaugauaguucuggguuuccucucugcagagaggaauaaaauaauacuagguuucaauuaaagacauaacugcaauuuagucagggguauaggaacagaguggcugucagcuaugccaagcuaaugucauaagacagaaaaucucagcacauagcaagggauccugaggcaucugaguuaccgcagcccucauacucaauaagacaccaagacuagcaauuagaaugcagacagaacaaauauuuacauuuugagaaaacaaaagaggaggcaucaacaacagaaugaaucaaaagccacaaggucucagaugugggcaagcaaaguguugcugucagugugaagcaggaaggcagaauugguuuccaguauuugcaauucagagauguagauuacuggaaaauuuacaauaacauugcaguuuaaaaucuccacuucauccguguuacccagaguugaacaugaggagucaauugcccuuuuccuccuucuaccuacuauuagcuccaagucauuucuucauguguauauggauuaugaguuccagagagccuggauacguuauuucgaggcuuucaaagucccagaaaugcuuaugcauuuuaaaaacuguauuucaacucagaaaucucuuuuguuaagaagccugauguucugaaugaucagaggguauaguaaaaucuaauaacagaagaaaaauuagggcucugggaaggggcuguccaggaagggaaagagauguguggcuccccucucaucucaaaguaguagguacacauuuuccucuuuuguuuaauuuuagaugggucacucaugcaagcucauggaguggauccugaguaggggauaaaauccuggcugguugggcacaucauagcaaagagacuugucaccaccaggaagaccacaagccagccauuauaacugcagcgaggcaggguuuugaccaauuuggcauguguagggcuuuuauaagaaauccauaagggaugguaaguaagaauggaaugaugggggccuggcuagugaggaaaaguugcucagugcacaaggcuuggcuuuaacauggcaaaugaugcugacuuuccccuuccuaaugucucuaauucugaaauucuauaagcaugagauggugucucagcccuuuuugaucuacaucaacccaugguggaugucugccauguacuuggcaucaguacuugggaaaaugacuuggcugccaauuaucugaugcuguuauuucauuucuaaaaugcaauaucuagaaauuguucauuugagagacauuucaaagcauuuguagccaaugugccaaguuucugauucauuuugggagagacacccacacguaguauuucacucaauuuaauauuuuguaaauaauugguauuagucgaguacauacaguuuaccaaacaugguucuaaaaaguuuuuuguuguuuguuuguuuguuuuugacaguaucuggcuaugucgcccaggcuggaggguagugaguggcacgaucuuggcucacugcaaccuccgccuccugaacucaagugauccucccaccucagucucccaagucgcugggacuauaggcacacaccaccaugccugguuaauuuuuguauuauuauuauuauuuuuuuuuggagagacaaaggucucacuauguugcccaggcuggucucaaacuccugagcucaagugauucacccaccuccacuugccaaagugcugggauuacaggcgugagccaucgcaccuggccucuagaaagucuuuacaugucuuuaauacaaaugcaggcaggugaaaucacuggaugauuccaugguguuuuaaaccuuuucccagguuacugaaaggguuggcauuguuagagaagcaaucaaucacgaaggagcuaagaagaaaguuuaaaaaggguaaaaagugugagucaagacaaagccaccagucauagcauuugaggggugcaucuaaccugaacuccugaacguuuuagguuagcuuauagauaauaagaguaacuaaauuuaagaucagcguggucaagaaauuuugcuuucuagacaauccuacuuugacuuguuccucuauuuauugacugucauuacuuugaauucuauuguuucaaacaugaaauuuaacgagcuucaguguuucuuuaguuuuaauaaagcaaaacucggguuuuuuaaaugggcauggcauucugccaaucauuuucaggguucaagaucugaagcaagguucuacaggacauuaugaaaguuauuguuuaaauaauggauauuuugcaugguauguaugauuaauauauuauauuuguauaaaagaguaauauaccuucacuuuuugcagggcuuacucaguguuuuuguuuguuuguuuguuuguuuuugagacagagccuugccauauugccaggcuggagugcaguggcgccaucucggcucacugcaaccuccgccuccuggauucaagugauucuccugccucagccucccgaguagcugggauuacaggcacgcgccaccaugcucggcuaacuuuuguauuuuuaguagacaugggguuucaccauguuggccaggauggucuugaucucuugaccucaggugauccacccaccucggccucccaaagugcugggauuacagccaccgugcccggccugaacuccuuuuguuguuucuuuaggcaucaacuccuuucccccucuuuuuuugucagugcuguuuuuugcaucuacuacacuucuuaaguguccaucucuguguucucuggguagacaacuucagagaacagagaggcuaccaggcaggaauuccuugcuccuuaaaacucaucucccuccacaacuaacuauauuuuucucuuuauuuucuaucucaaagaaagauaacuaauuuuguccagcauuuucuuuccuuccucuacuuuuacauuuccccuauauuuugcuuuuguuuauuuaguuauuuguuugcucacaguguuuaaauauauucaaauagcuuccauuucaaguuuaaaauuuuuaaagguaaaggaagggaggcaaggaggcuacaggucuauucuggcuucuggggaaaaaaaucuguauuuaauuuaucuuacuacagcacaacuaaaagugcuuucacuaauguaucuaagucuuaggaauuaauuggucauuccaguuuaucuucuuuaguaugucagcaucucacuuuggucagaauuuaguugcuuaguauucuugcuuugcuuggauucugugguacuccuccuuccaaaccucccugucuucuuugaagguuuguuaucuucuguucagcccaaauagcaguuuucuucaagauccaacauuugccucuuuuaaaucucacauuaugcaucagagaccuuauccccaugcacguagcuaccgauggcuuccagaucuacagcccccacugccauuuugucuuaaacucuacagauggcuuccagaucuacagcccccgcugccauuuugucuuaaacucuacagauggcuuccagaucuacagcccccgcugccauuuugucuuaaacucuacagauggcuuccagaucuacagcccccgcugccauuuugucuuaaacuccugacccauauuuuucacaugucauguuuccccauccgaggaacaauuaccaaucccccucuuggacugagaaaaucaaauugcccagguaugaauagcaacugcuuaucccucuucauaccaauuuacccuuccaucccugcacauuuucuuuaggguuagagacaaauuaaccauuggccaauucaaggucacugcaucccccugugugcuuggcugcaugacccuuucuucccauuuaauuaucagaccuuacuucaggauuuguuauauucccuuacucauauguuuuaaaccucacacuuucagcuauguguucguccuuagcuuuaaaaauauauuuaaauauaucccauccaaauaaguaagugaaugaauaauacauuaucuccauuggagcugccuuccuucuaacugccauaauugagggcuuuuuuucuuaaucaaauuucuugaaauugaagguacugugguuccaguuccucuugucuuaccagucuucagcuccuugcaaguuggcuucugugacaccugcuccagugaaaccugcuugcagucagguccuacguguucccaaacucagagggcucacuucagucuuuaucuuacuccacuugacucagcugacacuggcucauucccuacuucuugggaucgucuuucuguugguuuucaugggagacuugacuaggcuugucuuucucucuuuuuacucaggguaucugguauaaauauuucuuucucuuuuuucuuucuuuuuuuuuuuuuugcgauggagucucccuuuaucaucuaggcuggagugcaauggcacaaucucggcucacugcaaccuccaccucccagguucaagcaauucuccugccucagccuccugaguaacugggauuacaggcaugcaccgugacaccuggcuaauucuuguauuuuuaguagagacaggguuucaccaguuggccagguuggucucaaacuccugaccucaagugaucccccugccucggccucccaaaauguggggauuacaggcaugagccacugugccuggccaauauuucuuucucacauucguccuuuaaacauugguuuaccaaggaugucauucuuggcuuuuuaaaauuuuuuuucacaaucucuccuuuguacuaucuuucuucuuuacaaacucaaagaaauguuguaguuaaaaaacaaaaacaaacacaaaacugguuuugagaaccugaacaaagcucagcucuccacucacuuuuacuaacaacacaacuauggauaaguugcauaaucucuuuaaguauuaguuaucaccucuguaaagggaaguguucauaucaacucagauuguuaucguggguauaauggauauaacauacacaguaauguaaaguauuacucaaugccuauacuaagugcucacaacuauaauuuuauuauuauugucuuuauaauuauauuuaacuaauagcucuauguuauagacucaaaucuaucaucuuacacagaguccucucuuggaguucagauuuauauaauaacuacuagaugucucuacucagauauaccucaaugaucaacauacagaaacagacagaucaucucucccuuccucuccagacccacucguccugcuguguuucuucccucaguugguagcuaaguaucuggcgucaccaaauuuucgaaacccaaagguucuagcuuccucaacauguuucugucccuucuucccgcccauacaccaaugccuuguucaggcccucacuuuuuccuaccagggugauugcaguagccuccuaacuagucuccugcauuuuagcuuuuccucauuucaguucaucuuccauaguauugcauuuuuuuuuuuuuuuuuuuuuugagauggagucucgcucugucgcccaggcuggagugcaguggcaagaucucagcucacugcaagcuccacuuccuggguucaagugauucuccugccucagccucccggaguagcugggacuacaggcgcccgccaccaugcccagcuaauuuuuuuuuguauuuuuaguagagacaggguuucaccguguuagccaggauggucucaaucuccugaccucgugaucugcccgccucagccucccaaagugcugggauuacaggcgugagccacugcacccggccuuuugcacucucuuaacugcagaugugaugucucucuuagagcagaacccuuucaggguuccucauaauugacauaaaauccaaucuauugaguagcacauauguagauuucuccaugaccuugucccugccuucccuuuuauguuucagugaaaacugauuguuuuucucacauuuuguaugcucuauuuuuuugcucaugcuguccuccucccugagaugccucacaccucucuuccugaauuguccaucaucugcacuuucuucaagaucuuucucagguuugucccugcuuccuuauucaacaccauaagguuaagcuaauuucaauuucaggacuagcccauucauaacuauuuuggugcauuuuccacguuugauucaaguuaucuguuugcaacucugccuuuccaacaaauacauaucaaccaaaaguagcaccaggucuuaccuuacauauuuaauaguaguaacauuuuuccaugugaacuaaacgucacaggcaacucaaaaaugacaugcuccugauggaauugaggcucucgucacaaucguccccucuuucuguagacuaguuucccaauaauggaagcagucaccauccauucuaucagccaaaucagaaacccuggaggcacagccaaugguaucucaauaucuguucaaccaccaaaauccuuucugucuugcccacccauccuccaaauaucucucagauccaacugcuccucuaucccaauuguugauucuuucuuugacuuugugggaggcuguguguacugcuagaugccaaucacuuuguccuacuucuacacagagccaccuacuccccuugucccaguugugccuccucagugcuucugaugggacuuucuuauuacauaaauauauuaugcuuaaaauucucaaaggacucccucguuucuucaggauagaguucuauaacauuagcaugagauaccaagggcuucucaacuguagaguuuuccagauucagcuccaaguauuuaucaugccuugugugcuuuagcuacagagaccuacuuucaauucucagaacaugcaaugcccucacagaccgcuaaacugaucuguucucuuuggcuagaaugccuuuccuuuucccaaccuuuucacagcuagcucauuucuauuaguucuuuaagggccaauucagauauuccuccacuuuucauuauucucauaggaagugauuuucauuuucccagucucuacucccagaucccccuucuucacaccucaggcauaccugucucauacaucucauaaugcugacuacauuguguuccuuuuccuguccaacuccucuacaaaaugcugaguucuuuguggguaguuucuguaucauaguccccucuguaucgcaauaucaauuacaguaccugcuguacaugaggacuugcuuguuacggguugaaugaauaaugaauauaaauaaagcucagaaaacuuaaaugacuugaagaguaugaagagugugaagcaaaacaguguacacuucaaagcagaaugcuauagccaguaaagugcccagguucugugcaugacuuugggaaauaaacuggguuugacuccuaucuuggcuauuuacuaauuaacuauauuuagauagagacuuaacuucucuaaguauuucuucucuaugaaauggugauggugaugaugaugaugauucuuaccugaggugguucuugccauauaucuaucuaucuaucuaucuaucuaucuaucuaucuaucuaucuauauauaucucuuauauaaagugguuauuccaguacuugacauaagauuggcccucaguaaaugucacuucuauuucuuccuuaaaucuggcagauugcuuuaaauuguacuuuuuauauugauuagucuuuuaguuagaaaugauugcaagagugaaaaccaauugcauaacuuugguuaacuuugggaaauugucaucaaguuagagacucauagauuuauagagauggaagggacaauuaagauaauuuaguucaaggccgggcacucuggcucacaccuguaaucccagcacuuugggaggccgaggcagguggaucaucugaggucaggaguucaagaccagccuggcgaacauggugaaacccugucucuacuaaaaauacaaaaauuagcugggcaugguggcgugcaccuauaaucccagcuauucgggagacugaggcaggagaaucacuugaaccugggaggcggagguugcagugagccgagaucgugccacugcacucuagccugcagccugggagacaagagcgagacucugucuaaaauaauaauaauaauaauaauaauuuaguuccaaauccucacuuuuuauauagggaaaucauggucuuaaaagauuaaguucuaggucaaagagcuuguuagaggcuaauuguuucuugucuuggacaggaaacaaagugucuaccaauggcuaucguuuccaauuguuuggauugaagaaacucacaugacaauuauauuucaagagaaaugagagcuagcugggcacgguggcgggcgccuguaaucccagcuacucaggaggcugaggcaggagaaucgcuugaacacaggaggcggagguugcagugagccgagaucacgccauugcucuccagucugggcaacaagagcaaaacugucucaaaaaaaaaaaaagaagaagaaaaagaaaagaaaagaaaaaugagagcacucagagcugaguccacgucagggagcaggcagacgccuugcagguaaugggcagagcaguggccucgccacauaaccacacaccaacuccacuauucuguucccuaauuuccuuuguuugggaagcuuuucuuuuccaaugaaaagaagaagcacucaguggaaaauucugaaauacuauuacauacaaaucugauuaaaauugcagcaacuguaaaccuuaacuugagacggacgcauuucccaggcugacaugcagcucugaucauguuuaauuucaacguuucugucuagcuuguacugugcugcuuuuccucuauuaaguaaucuuccagaaaaauuuaaaguuguaauaauaucaccaauuuguuugagguacuccagcggguuagaaagaaaauccauauaaauagagaugaacacaauggagagagcaugaaauaaaaguaucagucugugccagaaaguggggaaaaagcuauauggcugagacuauuucuuccucuuaugggaauccaagugggaucuucuauaugagucuuccuugguuaagggaguuuucuaauuccaugaguauuuuggcaauaaguucaauuaucccaauuauuugugaccaaaucugauugaagauuuaacagaauaaaagaaagccuuuaauaacacaggcuucuaaaugucugucaucauuugaaauuucauaggaugguuuacuccugcucuguaauuucuuuaaaacugcaaaaguuagcucaagaaagcauugugauuuuccauucauuuccuucguuuuuuacuaucuuucacaagcauuugauugcuagacaaagugaaugauucucucaaacugugaggcccuauuuuuguccuuuagauucaaggaaaaauacaaccgaaggaauagcguuuggcuuggaguucuucauacguggcuagcauagaaagaaucucaggacuuuuuggugguuuaucauugcaucgccuuauggaccauugaucuuuuuauuuucuaaaagaaugguuucauuugcgaugguccuaguuuagagugguuagugaugauaacuauuauuuauaacucuauguaauuccuuugaauuguauauuuuaugcacaacaauuuuaagauaccuuucuuuucauggaagccacaugugauccuuuugauccuuacacuaguaaacagagucauauauuuuagagaggaauguugagagcuagguguguagaaaguaucuggagaauagcuugguuuuuugugugcgaaccagaaaugaugagagaauuuaaagcaguaaaggcuuuuagaaaucagcuugucuggcagguuccaaaauaugucccuugcuuguaaugcuaguccagugagauacuucuccacaguuuccauugucugagaauucaggaaaucugcacauuauaacucucuuuuagagacucacauaucacauuagucacauuuaagucuuccagaaaaggggcuucuguggcucuuuuuaacccugguugacuuaauucauaugguuauagaacuccuuauuguuccacgaaacuagcauuuagagacugauguuuuagggaauguugagguacuaccuuuucuugaaaaaccgggugcccaaugagguugucaaauggucaaugaguaucugagacuagaacccuagucuucugacuucaaguccaauauuuccuacauagagcugaaauguuaaccagaauuucaggauaaccggugucccaagaauaucuuuucaaaguccucaaguggugaaaguaagggcugccucuguguuugcuuauuaaauaagucauucuuauucaagcagcaaugauaaaugucaauguccuagacuauaugaaauaaaccugggaaucuaaagggauuaaggauacgcagacauugcuugggaguguaauagcaaagcaucuucucucagaaaauuuagggcaacuuauagcacuaauaugcucaccccauuaccauuuuuuuaaaaaaaaucauuaaaaauguauuuauaggacuuucugauaaucuuggaauuucaugauuaagaggguucugagcaaacuuaaguuguuucuguucuuuuuuuuuauucaucugacauaucucuuuacuugucauauuguauaacagauacgucagauauguauuuauauuagcuugcuggaagguagaugcccacauagguuauucuucugggaagucauuucacaauaagaugguucuuuagcuggggucaugagaaugacaacaugggaagaccgagauuuuguuaaaugagcuguuauccucuauguucauucaaaugguuccaacuuuccauucccuguugucauuuccuaaauucuuugaugcaaauauacaaucaccaguuuaacaaacuuuauaagaaaaaaaaaacauaaucauaggcagcuaaaaaaaaaaaaaaaaaagccuauccacugguucaaaugagucaaucaagaaggcacaagauggauuuuaaugacaucauuggguccaaacuuccugagagcucauccaugugucuucccagccucaccaggaaauccugcaggaaaauuccuucccaagcccuuuauagaccuacugaaugaaggcuagaagguucgugugagcaucagaaauggucagauaauaaagcaaauacaauccaaacaguuuugaucguguuccaccuuagggcgacucuggcugcugaacacagggacucaucaagugcuccuuucaagaaagcccugagagcccuuucucggggauguaggagacagagauggaaaaccacucagguuaagcgagucuccuugauguggcuuuggcaaagcuggaugcuaaaucugaagcucuacucggauauaaaggacuguucuaaggcuagaaagucauaaaaccccagcaggcaggcuguucaucauuucccuggcaaggccuugguacggcugcaacugagaagccagagugcuuggaccugcacuggaggggccggugagaaacauuuucaagugcagauucgucucagccacucaccgagcacagugagaaugggcaugguacuaauuacuuagguaauuacauaauucgauugcaguuguuuuguggcuuauggguuuauccacagaaaacaguaccuaccauuccuaaaauacauauacauuuuuuucaacccagauacaacuuucuccuuguggccaauaauguuucuaaaauauuaggguuuggagacaggugaauaaugagugacuggcuggugagaaucacggccauuugggguuucaaauggacuaauguaauaaacauuauugagccucugcuucaugaaauucacauaguaaaauccaaacccagaaaugucaaagucccuugaacuugucucugaggcauaguaaaaaacgaaaagucaaagucccauaagaaauuucauuauuuaaaaggcaacuguaucucucagaguaaaauuugauacucaaauagauauuuaaauggagcucaaacuucugugacccucugucuuuucaaauauaacagaggaauaagaaguuuacuauucuuuauugugagaguuaaaugagagaaugugugucaagaugucagcacagugccgggcacauagcuuagcuuugaggauuaucuauuauaaguauuguguuuuuuaacccaaauuuucuguaucucugaaaauuauuaucuggauuuucuauuuaauccuuuuuuauuuucuuucuauaauuucauuuuccucugguguuaaaaaaccaggacacaaccaugaggccauuacauuuuuuauuuguuuguuuuguaauuuuacauacugcgugguggaauaaacaaagauagaaauacgacacuuggauuugaguuuuguauucaccauggcuguuugaccuuagacaaguaauuagagacuuugugugcuuauauacgaaguagggauaacaguaccacauuuguguacugugguagagauuagagaucaugaacauuauaguuuagcuguguaauacacauugaauaaaugagaauuuguuucagcuaaauucuuucuuccuucuuccuuuucugucucaccuacguaccucccuugucccucuccuuccucagaccucuuauaaacacacuaacacauacauucaaaauguuuucuccugucagcagagaagcagauuauaaaauguuuuuauuuucuuccuguccucuuugauuguccuuaaacaagguauuuuuguaaaaucugaguacacacuaagaaguugguucaaaagcaaagacacuaaaauuaauacuaaucuacuuuaaugauagaaaauugcccuaauuaucuuuaugcaguauuauuuuaaagacucccagugaguccuauaaauaguuucaaguuacaaauacagagugauacaugaugaucaacaacugugcaucuuguaaaaucuaucaagauuaaauuuccuuucuuuaauaagaauuaauggcauuuuauaucugggcugcugagauaaguagaaaacauaccaccagaucuagaaaaggauuaaucaacaugucagggauacaaauuacugacauugacaacguacccugugcuggaaauggacuuaauucuuuuuuccugcucaugagcucuuucuguuucucuuccuuuacuucucagccaucucacuagucugggcuuugaagauugcuguugguaaguauugcuuagcugguagaacaucagcuaauaggguuaaaagguaacaagauaacugaccccauccuagagguucaaguuucucuccagccagugcccuuaagccaucucuucauaugcucagaaaagucacuuagaaaugcaauuuuuaaccuggcgacauccaaauuccauuuuuugcugcguguaaauauugaaggacuuucacuaaagcacagauuuuuuuuucguaauuuggaacauuguaauuuggaacagcaaaagaacaaugugcgucugucuaugagaugcucuugaagacacguccacguaagcacggagauuuggaauugccucaaagacagaugggggucagagagugccugggagaucaguaauagaauauuuaaaucaaaguacuucuugggagagaggcaaguuagagaagaaggcaggaguaaccugaucuaggccguggcaccgaggcuagcagcugcaccagggcucuacuggauggcugagcaagccagagggaacacagcuuuaaaugcuugccggauuaguguugaaggcacagugaagacugagcugcuuugauuucugcagaaaccagcauguuaagcuugugugcuguuuguaagaaaugccuuaauuuugacaaaauaaucacccccaaacuacccauccguugcaauuauugucaugauaugauuauaaaauagacuccuaaugucucaggaugaauuguccaccaccuggguaucugaaucacguuagagaggcguggcagacgaaacaaugccccccuccaaagaugcccacguccuaaucccuggaaccuguaaauaugucaccucaccuggccaaagggacuuuguagauaugauucaguuaaggaccucagauggagagauuaucccggguaauccaggcaggcucaauauaaacacgugaguccuuaaagcaggaguacguuucuuggcuguggucagaaggagaugugacugcaaaagaauggccagagaaaugcaacguugcuggcuuugaagauagggaaauaauaccgggagccaaucaauguacacaacuccuagaagcaggaaaaggcaaggaaaugauucucuccuagaacuuccagaaagaaacacaucccuguugacaucuugauuccagcccagugagacccaugucagauuucuaaccgacagaacucuaagauaguaagauuagaacugggcgcgguggcucacgccuguaaucgcaacauuuugggaggccgaggaggguggaucacuugaagucacaaguucaagaugaaccuggccaacauggugaaaccccaucucuacugaaaauacaaaaauuagccaggugugguggugcacaccuggaaucccaacuacucgggaggcugaggcaccaaagucgcuugaacccgggaggcggagguugcagugagacaagauugguugccacuguacuccagcacucuguuuaaaaaaaaaaagaaauuaacauuuguggagucuuaagccacuaaauuuguggcccuuugcuacggcugccauagaaaacaaauccaggaggauuacagguugcacaaguagagcccuccccauuucccuucauuccagaaaagccccucauggcuccaggcugagagccaggagagccuuaagauccauccuuugggccugcugccuaucucuccagagagaagguaagcaaggagcaguagaccuaccugcggcacaaccccuacauggagacacagcacuggacacagcucagaaaucuuaaggaaagaaauuaggacauuucuugcgcaguaagugugucauugggaaauggucagaagcuugcacagaauccaguguuaaagggagaagggagagaaaggaagugaguaccagucauuuagggccugcacccacuaggugcuuuacauucacauggaauuguagcugagguucccgaggaaguagagaaaacuaaggcucacagucaaugugugaacugcccaaggucacggugucucaguagcugggacaggaggugagaacuaggccugccugaccccaaagccccugggcuuuccacgacuggccuagcuguuaaaucccauugcuucaacaucauuaucaugaggucacuuugggcucgugcuaaaggggcugaggcccugcugauaugucuauuuuugucuuggaaguaguucagaaaaccaugguaggaaaaaagugugcaaaagaaaggucaucaaaaaauaaacacauuucauucuaguauggcuuuuguuguuuuaugucacacuugggaaggccuucaccacaaguagauuaucuuaaaaaaucauucuucuauggcuucuucuaaugcuuuucuguuucaguuauaucucaggucccuggggaauuuguacugguguacugugagcaauuaacccaaccuuauacuauacagauuacuugucaguugucccaacaccauuuauuguaaaaucuauaauucugcacuuauucaaaaugccaccauaaaucacuucuuaaauucccaaauguaucuauguuuuuuuucugaacucccuauucuaucucauaggcaaaucaaaagacaaugaacuagauuuaaaaaaauuacaauacaugucauagacaaagaguauaauauguaaauuaccucuaaaaaauccauugagcugggugugguggcccaugccucuaauuccaacacuuuggaaggccaagaugggaggaucacuugaggcaaggaguucauaccaaccuggcaacauuuuauuuuuugucuuuacaaaaaauaaaaaauuagcugggcgagguggcaugugccuauagcuucagcuacuugggaugcugaggcggaaggauugcuugagcucacaaguuugagguugcagugagcuaugauuauuacaucacugcacuccaaccugggugacagagcaagauucugucucuuaaaaaaaagucaaucaaaaugauuaaaagaugaguaaaggauuuaaacagacaauauauaaauagauguuaaauaaaucaaaaguuacuuaaccuuuuaauguggaaaugaaaacuaaauguuaguaacacacaacauuggcaaaaauaugugguugcugagcauacaaacugccauggccucuaaggaagacuguuuggaaaugccuaucaaaauugcagcuacaugcagccuuugacauagccauuuuucuucuaggaguuuauauuaaagguaaaauuucauauauuuaaguaacccauguguaagauuuuucauugcaauccugcacguaguggcaaauaacacacacacaugaaaaaacaaaacaaaacaaaacaaaaaaacuaaaggaucaucaauaaguuacugguuaaauaaauucuuacaauacauuuaaugaaugacuaugcagcuccaaaacaacaacaacaaaaaaaaacagugagaacacuccuuguguauugguauggaguuuucuuuaguuauauuguuaaaugucuccccaaaggacauuuggggaugucuggggaacauuuuuggugucacaucuggagagggagggagaaacugcuacuggugucuaauggguggaagccaggaaugcuacuaaacauucaacaauguacuugacagccccuuacagcacagaaugauccagcccaaaauaucaauugugcugaagcugagaaacccugcuccagagugaugaucagaaacugauuauauuacuagccaggccuggugacacaugccuguaaucccagcuacucgggaggcugaggcgggagaauugcuugaauaugggaggcagagguugcagugagcugagaucgugccaaugcaccccaaccugggcaagagugaaaacucugucucaaaaaaaagaaacugauuauauuccauaccuauugagcuaagggucagggauggguugaaaguguucauugccuuccauuuuguaauuguugaauuauguaccuguauguacauguauuauccauucaaaaauauauaaauagcacugucuucuuuuuucaugguuaaagucauuguugaaucuuuuuuuaagaagguguuuuauggagaugggaagaaaacucuuugauuuugcuugugauuuaccugugauuuuucuuccuucguggccucuuguucuuuguaaauaaagcucaaggacaucuacauugguuguuucgagauagaugaaguguucuuuccuggaaaggaacuccaaacaauagagugacacaggagcacgaaguugcaauguauuguaucucaccaaacaggcuuuagucuuagcaaacaccagagaaaauugucaccuaaauuacuaaaaguuaacaaauguguaagucaauguuuucucaggggcaagggcaaacauucauauaaaaggaacugauaacauagaggugccuuuuacuccugacaacaaugacguucucuagggaccuuuaaagauuucucuggaaucauuuuauaaaucuacuguaaauuuucauuauuaauggguccagcuccauuuuaccacuagauguuggugguaaaauuguauuuaccauuaaaucucuucucugucuuaauuaccacuguuccaaaauugcuuugccaagguaaagcauucaauggggacuugaaugugccagaagccagauacauuguugucaggggaggacuuugcccagaguguuauucacggcuuucccuggcauucacguuucaaaagucugugcucuauauuugcucuuucauuucaguauaaucccuuuuuucgucucuuucucuuuguuucaggauuuucuuugaaauugcaauuauugucuuaguuuuuuuuguuuguuuguuuuuguuuuuuuuuuuuuuuggagacaggguuuugcucugucauccaggcuggggugugguggugugaucauggcucacugaaaccucaaccuccugggcucaagcaauccuccuacaucagccucccgaguagcugggacuacaggugugugccaccaugccgagcuaauuaaaaaaaaauuuuuuuuuugguagagaugggguuucaccauguuguucaggcuggucucaaaauccauggcucaaguaaucugcccaccucggccuuccagagugcugggaugauaggcaugagccacugacccuggccuacauuuaaaauuauauuuuaaaaacacagaaaaaaaauacaucacauaugugaccaccaauguguaugaaauguugguggccuuacagguagaaagaguuggccauuuuaagcacaauaugggcgaccccaggcaaguucucuagugugaauagaaaauauucuaacagaugucauuuucaccugccauuuccccauuugcgcuuccuuugguaugcuaacugccauuuccuguuucuuuguuuuuuuguuuuuuuuugagacggagucucacacugucgcccaggcuggagugcaguggugccaucucggcucacuguaagcuccgccucccggguucacgccauucuccugccucagccucucgaguagcugggacuacagucgccccucaccaugcccggcuaauuguuuuuuguauuuuuaguagagacgggguuucaccguguuagccaggauggucucgaucuccugaccucgugauccgcccacuucggccugcuaaagugcugggauuacaggcgugagccaccgcgcccaccccucccguuucauuuuuuuaagauauagaacagugagaaagcaggggaaagagagaacauauuaaggucuuuguguguggacaucuauaagcugcuuccaucacucacaagacagaaccaggaaaauauaaagccuucauaacugacagcauagggaauggaacagagcaagggacucccagauggaauuuaauggcaucaaaaucagauuucaccuaaaccacaguuauaugaagaguguauuuugguacuuuauguuguccugcuuuuccaaaaaauaaccagaggaugggauacugaaccagauuguugguucuaagcuaaauuuagcaaaaacaaacaaacaaaaacuaaaaugcuuuuuuuuuuuuuuuugcccaugaagacaaaauaucauaccaaaaaaaccuuaaaaagauaaacauauguaaaaacauuaauuccuggacuggcacaguggcucacaucuacaauuccagcacuuugggaagccgaggcaagaggaucacuugaggucuggaguucaagaccagccugggcaacauggugaaaucucgucucuacuaaaaauacaaaaauuagcugggcaugguagcacgugccuguagucccagcuacuugggaggcugaggcaggagaauugcuugaacccaggaggcagagguaguagugagccgagauuguaccacuguacuccagccugggcaaugaguaagacucugucucaaaaaaaaagaaaaaguuucugcacuuaaugaauuuauaaucugaaugaggaaaaaggaaaaaaagacacuuuuaugaaacaucuauuucagucuuguuccucaagguaacuuaucuaugagcagaguccacucacacugucccaaagccucauucagccaugaccauuuugugaaaagagacaguaaagguugaggugguuauuugucccccugcauucugcugcuuggaauccuguguuugaaagagaauggacuaguugaccaccagagcucaucccaacucuaacacaugacuccuaggcucaaaggcuuuaagagcaaauuaggguaauugaccaugugcuuggcauacucauacacacaaaaauugcauacugaagaaguaaguuugagcuggccuuuauaagugggagagcaauuccggauuauaguuuugaugacuauuuuauuuuauuuuauuuuauuuuauuuuauuuuuugggauggaguuuugcucuuguugcccaggcuggagugcaauggcacaauccuggcucaccgcaaccuccgucucucggguucaagcgguucucaugccucagccuccugaguagcugggauuacaggcaugcgccaccacgcccagcuaauuuuguauuuuuaguagagacgggauuucuccauguuggucaggcuggucucaaacucccgaccucaggcgauccauccaccucggccucccaaagugcugggauuacaggcgugagccaccgcuccuggacuuggugagcuuuucauacuccauugcuaaguccuuuuuauuuugcuuuauauaucuuuuguggaagauagaaauaaguugaugaugcccucaagaaaaaaaaaauguaucuuuuuauccccaguacagaguagacaaacaauaaggauugguuucagaaaacuugagaaauaaaaggauggaggaagaaagaauauuuaaucucuaucaaaacaaauaugcuuucagauuuaaaaaaauguuacgugaauaccguauauguugauaucuaacuugaccaagaguccaaaaauaauuuuugaaacuuaguauuacugauugguuuaucggugggaauaugggaauuuuauuuuuggaaaacggugguuauaaaggcuaaguccuguuaccaggauagagaugaagcaugaaaaaauaaagguggcaaaaagaaaggaaauaaaggaaaaaaaaaaaacuagagaaguuaggagaaaguugugauaguagaaucaauucaaacagugacauuagcaaggagcuaccuauaucaucaugggcagggugagacaaaacuuccaauuauaauuuuauauccagucuaagagcauuuguugugcggacacauggucccauacacaucacugccuuuuguuuuuuccuuaaacuaauaugugaauugaacacuuagaaaacuugaggaguguuucuucaccuuccaaaaauauuugcuuuuugagagaaucuauuguaaaauucuuucacauaguuauaaacuuuuagccuaauauguauguauguguguguguaaugaaucaguuccugaaauuugguuuccauugaguauugucucuuuauuuauuacacccugaagacccacaagaacacuagucuuuagaaauaacugaagucugucaagaaauaaauucaucaagcaacauaaacaugcugucacuuguaaagacaauauguacuuugagagccuuuguuuucccauuagugauguuugguagcaccaagccacgcaugcagauuuucauccaaagccucuuuugaccaauggcauaacuuuugaaguaggagcagagugaaauucguugccaugaaaacggguguuuauuuuggugagguggauguuucugaaugagauguaauucuuugaugagaacaugauuuucaaauagaauuaucuguucuuauuaauugaucuagacaacaaauccagaaacucuuagaugucaguuguuaacucuugacuuucagacaugagaagaauuagcagauaaaauguuuaaaaaaacccaaaaacuaaggauguauuuucuguuuaaaauuuguguccauccuuuaaagaaaaagcaaguacauuuaucaagaaaaguuguugauuuugccuuuuacauaugaaugacuuaauuaggucuaucucuccaacugaugauaaagauugauggaugauaauauuucaaaacggcaauuuuugcuucugccaagcaucucucuauuccaagaauauauagcccuucacagagcauaaaugggucaaguacagccuaaauuaauugggagaaauuggugucuuuuaggaaagugaaaaacaacuuuuuggcugauguaaaaggaguuuagcagacaugauuggcaggaauuaugaaauuuugcucuuacuguggaaaugaauaaaagugacaucaaugacaaaaccugcugcuucguacgauguugccuucacuaucucagcaucucugaaaugccuuugauugacgcuauguaggauucgggcuguugaaagcugggggauuaggcagugggucuauguaggaggacuccuauuuucugcuggcauuauguguguuccuagcuauaaugccauuuuuugaaauuuguauuauuuuuaacaaauucauuauuauaaaaaagcaaggaauuucucuugacuagaugauaaacuuccugauaauauaguugguaaacaacauagcugguuugaaauaaucucagauauucaggaugaccaggagaguucuggaauagccaagccucuacgugugaucagacucauauauuuauccccaggagcuauuugauguguguguuuguaucugugugcuuguacaugcaugccaugacacacaaaaaauugugaaccauggcuugaaacauaaacuguuaaguaagguuggcugguuaauagauuuaagauaauuugauuguucauuuucuuaaaauauuaugcuaugaagcucuuagcccacuaaggaguaagaauacauacuaugguuuaucauagcaucacaacuauaauucccauucagagggcugagaaguucaguucuccuuguauuugugagauacuuccaaauaaauaguacugcauaaaggaccagcuccauaauauauaagacccaguggaaaacaaaaaugugagacuccuugcacaaaauuuacuaagaauuuuaagaugauccaacaaaggguugcuacaauucuuaaauguaauuuagugguuuucuuuagauacuuaaaaugauacaguuggaaaggaacacuguuaaacuaucgauagguaaagggagguaauugugauauauuugggaaaagcaaggaacuuuuaaaaucauaaguuugaauucugguucuuaaaaauaguggcagcucaguuuucucauguggaaaaugggacuucaugguuuuguuuuguuuuuuuggacaaauauuuauugugaaagccugauauguauuaccuuauuuaauccucacuauaacauuaugagcagguuguauuguuuuccccaguuuauagaugaggaaacucuggcacaaagcgauuugaagacuuccuaaaguguucaccaaguguucacuagugacaaguacuagagacagagcuggagccuagacggucuagcuccagggcccagacugaaaucagccuggccgacccccaucuuccaauacguguuacaucacuggaucacacugggcaugauaacaguaguaacaaaaauuaaaacccacaauucuggcucagaauuaaggcucacuugcuggcacuuacaauuuucuaggucucuaaaacccugaaauuuucucauaauugggaaauaauacaaaucaggagguaggugauuuuuguuguuguuguuuaaaucuagacaagagauuacaaccugagaaacagcaaaucaaauaacauucuuuuggagagacacaguauauaguauuauacauacuggaagucccuaugaaaggaguuuucuucccagaugcccccaaauguguuuuuaagauauccucauaaaugcucuucuaauaauaucauucaaaaugaaaagucuaaugaaauccccaaggcagcuaaauaaguuuagggaacaauagaauacaaauaaaaucaccaguauccauuuaaugccucauuuugauaaagagaaaacagacuggauuuucaacaucaaaucuauuaaucaguuacacaguuacucauaacugugaaugugcaggucugaccuaagaucauuuugcgcuuccuaaagaauuaccacuaagagucaggguugaacuuggugcuguggcgcaugccucuagacuuaccuacuggggauacugaggugggauaauugcuugagcccaggaguuugaggccagccugggcaacauaacaagaccccaucucuuaaaaaaaaaaaaaaagucaggguuggagagaacucaaugaccuugauuccaaaccaaacuucucagaaguccauggaguauacuuggggcauggggcgggggacuguaugggaggucuaccauaaaggcuuagcucuuucucauuagaagaaagauccaugauuucaaugacugagaucuagaaaccuuuaggagccagaggaaucaucaccuaguaauuuagcauuaacucugugguuuaguggugguccuuuuuauguucaagagggggaauuguucaaacaauauaguugguuugaaauacuuccaggaccaaugcaaacaccaagugggcugcccagaaaccacacauuguuucccucagacaaaagauaaugaugcacuaaugaguuuuacccuuuauugcccucucuggaacacagccucaggaagaaaacccacgaaaccaaauuguuaguccucaaauuuacaauauuuugcaaugaccccuaucccuuuuucuuuaagugcuaguacuuggguuaaguauuuguguuguuuuacucauaaauuccaaccucauguaaucucaaaagugcccucccagagagagaaaggaaaugaguaaaugaggaaaaauaauaaaagucucccugauaauagaauacuuccaagagacuuaaagcacuucugagauauuaucuaauucugauguacuuugaucucauuaaagggggagaaaguaacacauuauuuuaacuauggagugugaaagugaggcaaaaagaaguuggacucguagguccauuuaacaaaaaucauuuaguaaauaaucaaaacuaugaauggaggaaauuaguacccaauuaauuagacuuguaaaaguguauguauugaggauuuacaggauuuguuggaaucauuuguaguuguuuuauugaagagcaagcuuaauggcacaauugcacaucacuuggacugaaaucacccacaacccuuccuuaaccucaucaguccuccuccccauucccgcugcuauuucuguccuauguguuuguaaaaucuccagaaagucuugcuuauagguaugguuucuacauccucaccucuuuccuaucuaauguggcuucauuuucaaaacauuuccacugaaaguguucccguuaaaguauguuuuguuuuguucaguuuuuuuuuuguguuuguuuguuuguuuguuguuugagauagaggcuugcucuguagcccaggcuggagugcagaggcacagaggcuggagugcaggggcacagaggcuggagugcagaggagauugagcucauugcagccucgaucucuuggguucaaacuauccuucugccucggccuccugaguagcugggaauacagcugugcaccuccaagcccagcuaauuuuuaaauuuuuuuguagagaugguguuucaccauguugcccaagcuggucucgggcugcuggccucaugcaauccuccugccuuggcgucuugaagugcugggauuacaggugugagcuauugcuccuggccuucuuguuaaaguugauaguacuuuuuaaggcuggaggaccacagagcuguuucuuaucucuuguucuucucuaguuucuguuuaaauauguucauccguaucccuaacuuuaagcauuguucuuacuccaguguguacauuucacucucaccuuucauguaaacuuuagaaaaccugaguuuuucaaauguaaaucuaauagacaucucaaacuuaacauggccaaaauagaacccuugaguucugccugagacucuucuuccucuagucuugcuuacuucaaaaacuuugcuccagucucaccucuaauggaauaugugacacguuguuuuuauuucugaaacgcuuuuuuuuuuuuuuuuuuuuuugagauggaaucucgcuauuguugcccaggcuggaguauaaugacgcaaucucagcucacugaaaccuccaccuccuggguucaagcgauuccccugccucagccucccgaguaacugggguuacagaugcaugccaccacgccuggcuaauuuuuguauuuuuuuguagaggcauaguuucaccauuuuggccaggcuggucuugaaguccugacgucaggugauccacccgccucagccgcccaaagugcugggauuacaugcaugagccaccgcaccggacuauuucugaaacccucuuaaagccauuucugucucuuuuucuccacuaccacccuagugcaaacugccauuauuuuucauuuguagauuauuccaguaauucuuaaauggucuuccacuuacauucucaccaauauaccuuucucuauaaagcaguaugaguuaaguuuccaagucauaaaauuagaugaugucacuuugcuacucuaaacccuguuguggcuucucaccaaacacagaauccaaacauuuaucacgguccauaagaccaugcaugaucugguccccaucugccguauccccaucucuggauacuggcccccucgcacuguaaguuccaaccauccuggccuuucucuucucuucuucuucuuuuuuuuuuuuuuuuuuguagauggagucucacucugucacccaggcuggagugcaauggugugaucucggcucacugcaaccucugucucccagguuaaagcgauucucuugccucagccucccgaguagcugggacuacagucgcaugccaccacgcccagcuaauuuguauauuuuuaguagagaugggguuucaccuuguuggccagguugaucucgaucucuugaccucgcgauccgcccgccucggucucccaaagugcugggauuacaggcgugagccacugcgcccggucaccuuucucuucuaagaaccugaagaguuuguccucaucccaguucauucucaugcuagcucuucucucuccucacacaucuggguaucauccuugcuuguuauucaggucucacguugcaugccauagggaagcccccuaaccauucaaccuaauuauguccuaccccacaccauucucucuacuaccaucaucucuuuuuauguccuucauagaacuuccugcuaucugaaaauauuuuauaacauuuacuaguguauuaucuguauauccucucuagaauguaaauucuaggaaagacaggaucauaucugcuguauuccuaguacccaccacugcaccuggcacauaguaggcucacaauaaguauguguugagaaugauuaauuuacaucuccuugaaagugccaaaguaguguugucuaauggagaguucaggaacaggaauugggauuauagaggauauuaaauuucuacuacuaucagggccauaacuuuaauaacuuaaauguauaacaaauucugucaacaaacugaaauaugaaugugaguauuuuacaugaaaccuuauauggaaugauucuggaaacuuuuuaaaauacagcauuucaaacaaguaagaucucaaaugucauauugcuuuuaucguuuuuuucuuuaaaucaaugcgucagggaaguaagaauguauuacaauuagcaaaaaguagagcaaacugcauucagugguuaaaauuauuuucaauaaaguccucugcuuauaaguucugcgacagaaagcucaugugugagaucaagaugaauaaguaauucauugugaaaagaaggaaagagccuuaguaguaggaaaauagguggaauuuuaauuauaacuucuggaaugauucuacuagcccggugcugaguuauccagacaagucacuuuuuauuuuuaaaauguauauuuucuauuaauauugaaggauauugucccauuugaagcugagacuuuucucuuauuaauagauauuuauuuaacacacuauuagaaguuuucauacugaugcucuagucacauauauucuuuauucuucaccaguaaauucuucucuuguauuuuucuugagaaaaaaaucucccucaaauaauuuuccuuuguccuucacuauucccuugcauugaaaugguaacuggaucuucaacauaaaucuauuaugcuuaaaaaccauuugcccaagcaaacaaaaauuacaauuaaaaugguuugacaaguguacagagagauggaaagcacauguucuuuucccugcuucugcuuaacuucugccuggucugccagcuccuuggccuggucuggaguuuugaagugucaguuuccacacuuauucuuauugggguaugagggggugcagcagcugucucauucaucuuucccuggaccacagacacuugauuuccuaaacagauacagucauucuuagguaucuaaaagggauugguuccagaauccuccaaguauacugaaauccacggacgcucaagucccuuuuuucuuugagauggagucucgcucuugucgcccaggcugcaggcuggagugcagugucacaaucucggcuuaccgcaaacuccaccucucagguucaagcaauucuccugccucagccucccaaguagcugggauuauaggcgcccaccaccacacccggcuaauuucuuuguauuuuuaguagugacgggguuucaccguguuggccaggcuggucuccaacuccuaaccucagguuauccgcccgccucggcuucccaaagugcugggauuacaggcgugagccaacaggccuggccucaagucccuuuuauaaaaggccuauggauauucucccaugguaaacauggccuauggauauucucucguguacucuaaaucaucucuagauuacuuauaauagcuaauucaacaaaaaugcuauguaaauaguuguuauacuguauuuuuauuuguauuauuuuuuauuguuguguuauuuuucauuguuuggguuuuuuccugaauauuuuugauaggcagauguggaaccuauggauauggagugcugacuauacucaaacuuaucaaauguuagaguucaagaucuguuagugagaaacuaaugcuacuucuagauaccuaacuuauaauaauaauccaaaauuaauauguacacuaguguucaaaacaguauuacuuguaaaacugaaaacuggaaacaaccuaaauagaagaauaauuaacuacuuugaacacauauacguguuagauuagauagucauugaaaguuacuuguaguugucauuaauguuuucuaaauucuccaaaauuucuacaaauagcaaauaauuuuuguaaccaaaauaaaauuaauuuaaagacaaaaggauuacguuuuuuaaaaagaaaagcugguuaccuugguucauaccuaaugccacuuucuacuuaaugcagacgucucuuuuuugucuccuggaagcauaaucacaaaaccuucacuuacguauuuucuuagagaaaaagagaacaauauuugauuuuuuauuaauuuaaauguuaaccacagacugaauuuguucaucgaaaacuuuuaaaucaccacuuuaauuaaugucucugcuaauucauuucuuuuaauugaggugaaacucacguaacguaacauuaacaaucuuagguguacaauucaguggccuuuaguacugaaaaguguugcaaaguuuugcaaccaccagcucuaucuaguuccaaaacauuuuuauugcccccacaagaaaccccguacucauuaaggagcuguccuuuccccuccacccccagccccuggcaaccagcagucugcagucugucccuguggauugacauauuccggauaccauuugauuuuuuuuuuuuuuuuuuuuuuuuuuuuuugcgacggagucucgcucugucgcccaggcuggagugcaguggcgcgaucucugcucagugcaagcuccgccuccccgguucacgccauucuccugccucagccucccgacuagcugggacuacaggcgcccgccaccacgcccggcucauuucuuuguauuuuuaguggagacgggguuucaccguguuagccaggauggucccaaucuccugaccucgugauccgcccgccucggccucccaaagugcugggauuacaggcgugagccaccgcacccggccuaccauuugcuuuuuaaagagcgauaauuauuuuuauaaauggauguauugaguaagaauauuucucccagucucucugcucauuggucucagcuuugcucuacaguagcccaggaaggcuuaaccguagcuuccacaugacagcccuucaaauauuugagagcagcucucagggaucaugaguucuugacaccccaucacuacccucuccaguacuuacuuccaccaaauacagaugaucuucuucauauugaauaugcagaauuccuucuauggccccuucuaccauaacagaugccugccuacagauucucuuccgcuucuuaaguucccauucaauguguguugccugaaagagauucgaacuucaugggaagcuggggagagaaaggggcagggaggucauaagagucaaaugagcaccgggugcaguggcucaugccuguaaucccagcacacugggaggcugaggcgggcggaucaccugagguugagaguucgagaccagccugaccaacauggagaaaccccgucucuacuaaaaauacaacauuagcugggcuuguuggugcaugccuguaaucacagcuacucgggaggcugaggcaggagaaucgcuugaacccaggaggcagagguugcagugagccaagaucgugccauugcacuccagccugggcaacaagagugaaacucugucucaaaaaaaaaaaaaaaaaaaaaaaaaucaaaugagcuggcuccugggcaagccucugcuuggacaugcaugcugaccuucacuacaccugaguuggagugagccaggucccugguucacacccuguccacugggcccggugcaggggccucucucaacaugacccuccauagagcugcagaaggcacagcccacaggcuggagaagaaaggcauccuaauuggaaacacaugucacaauuacuuucaaauccucucccucacaucuuccugucacaaaucauuaaagaaguccucuacucuaaacauggggaaauugcucaaagaaagaagagauguuagaucuaaauuucaauuaacucuaacacugauugcuacguaucacugcauuagucucugguccuuauuaaugaggauauaauuaaugaaguuugccccaggcaauggaccagagcccaaauaauuacauuuuagacaaauaauuugggcuuuguuuuucagaguauggggugcuuauuaaaaauaucaauucucagguuccagcucagaucuugagucagggaauucuggaaguacguggaccuggaaucugcauucccagguguguuguguucauaaugaaguuugagauccacuuauaaaagaaaaagaaagucguuuauugaauuuguguugcauacaaguaauagauuguuaauagaacuugcucuauggaaaaaugugccaauacuuguguuuggaaacaauguauuaaaaaauacuugauaagcuuggcuuaagguauaacugguucuguuugauguuaacaagaaacauucucuacaaauacuucaaaaguucaguagaaguccuuuuuauuuacauuauuuauaauuaggcugauccuaggaaagaucuaaacaguuauaaaaggcagaauggacacgaaacagcacgagcacaugugcacucaguaaauauuugcugcaugaaugguacacuuacauuugcuuuauuuccaaaauaaaaaggccaagaacugauucuccuaaccucccagacguuccccuucucaaauaucaguuauauucuggcuguuugaauaugagcaaauacaacaucuacaguuucucugaaacauuagauguguguucuuucauucaauaaauauguauuggucaucuacuauguguccaggaccugugcuaaaauccagagauacaguggugaacaaaacagacuuagucucuacccugaugaaguuuuccauuguagagagcuaguaaguuagguauuuggaggagaagguuaauuauuugagaaacaagcaaaauuucagaaaaauagagggaauuucaagcccaggcaccagcucggcacguaccucauuguuuagcuuuucaggaugauguaucuuggguucccaaugcugugggucagaaaacacuuuccauccucucuaguuauuucauuuacuucacuuagaguagauccuuaaauauuuggaagggcagacaaauuaugguuuaucagcaacauuuuaaagcauagucaauaggauucuguacacaucgucuucacuucuuccucucugcaaucuuguuucccucccacccccacccuccuucucugaaauucuuccaccaaggugaccucucuccauccagugaagacuuuucagccuuucccucaucugccuucuuauagccuuugcuauuccugcuuuuccuugucuuccuuuguagauuuccuuacuuccuugaaaagcugguauucuagccaggcacaguggcuuaugccuauaaucucagcauuuugggaggccaaggugggcguaucacuugaggucaggaauuugagaccaccuuggccaacauggugaaacccugucucuacuaaaaauacaaaaauuagccgggcaugguggcacaugccuguaaucccagcuacuuuugggaggcugaggcaggagaaucgcuugaacccaggaggcggagguugcagugagccaagauugcaccacugcacuccagcccggguaaaaagagcuagagaaagaaagaaagagagagguaaaggagggagggagggaaggaggaaggaaggaagggagggagggagggaggaaggcaggaaggcaggcaggaaggaauggagggaaggaaaaagcugguguuccccugaguuucacucucagcccacuuuucuucuuacucuaccgcucaguaaucuuauuacccacacagagcugggcaucgcuggagagcaauuuucugaggcccguguucuaccagacaucuuuuauuccuugugccauagaaacucccugcccugcccaaaaccagcucuuccuccgauauucucuaucauggugaauaccagccccggcuccagccccaucauccaguugccugaagcagcuaccuagaugucccccuucuucauuguugugucacucaaucccuucaacacgcuaaagcccaagcaucugaaauguuuccuucaccccuagccccaucaccacuuagcucaggcucacauugucuuucauggcuuacucaaacagccaauucccuagccuccaauguccagguuuauugucccuuucgguuucuuugucuuauuccagggaggaagucaaugucuuauucuucuuuguaucucaaaccuuaggaaggugcauggaacauggaaaaugaaugaaugaauaaauuaaugugcacaacuuuaacaaaagugcugccuagcauagccucauaaauggagaaugcuuuugguauugguguucauuuuuaauccguuuucaacacuuuuuuucuucacuuuucccguaacucccauauccacuggcauguuuuaagucuccugauugauuguuucugauuauguuuguuuuccuuggucgagagccuugaauuugcacucuaauuugucugaauucagcaucaguugucaauaaagcuaacuugaaaaaggcagggugcguaagacuuaacaccgacgaaaccagacuucuuguuucaauuaaauuacuuaauaugagacuuuccaguccucuauggacccauuagcuaauagacuguucugaaaaacugucaggaaagagaggcugcagaauucaagagacuugagugagugacuaggagaggaaugaagccugaggucuuucuuuauaacauuuucauguggacauaaaauuuuuacauaucaaagaguucaagaaugacuuauucuucuugcccagaaucauuaaugauauucucaugcuugcaaauaauaauauaauaauaugcuuuaauauacuucaguguacuguucuccaaacauuuuuaguucuaaaucuaugaccucucacacuuuuuaauugacaucuaaaauuugcaguagauauuauguaaagaguauugcaaacuggaucuuuuuuuuaaaaaaaugguuauaccacguuuuaaaaugucuccagaggaauauaaauaccauugcuauuuuauacccacuauuauacacuuuuuaagaaaaauacauguagaaauacucccuaaaggaaauuuuacauuuuuuucuccuuaauucauauuucauuguaguucuacccauagaacuauuucauaauagguuuuauauauaaaaggcuuuucaccauaucauucuuuuuuuuuuccuaucauucuuuucuaugacaaaaagaaugcauguagauuuugauuuuaauaauguggucacauuaaaguauuuaaauuuuggggauuaauuuuuuuggcucuuuggauugauuacacauuagagugaagaacaguauuugauaaaaaaaggcauaaauauacccaguaacacugaaaaaagagggcaaaauagcauaaauauuuuauaaauuuaguaaguaauuauuaaauacaaaaagguaaauuucaauuauuuucaucucuuaaauagaugccccaugaauggaguuuuuuuauuguuguuuuuguuuucauauaugaauacuacuuuuuccuagaaagaagacagggcucagcagacauucccuacugugcguguguaugauuauauaguauaaucauauaugcaauacauacuguauuagucggcuauaaagaaauaucugagaauggguaauguauaaagaaaagagauuuaauugggucacaguucugcaggcugcacaggacgcaugauguuggucaucugcucagcuucuggggaggccucaggaaacuuacagucauggcggaaguugaagugggagccagcacuucucacauggccagagcaggaggaagagagagauaggggaggugccacacccuuuuaaacaacuagaucuugugacaucucuaucaugagcacagcacuaggggaaugguguuaaaccauuggaaacugcccccaugauccaaucaccuuccaccaggccccaccuccaacauuggggauuauaauuugacauaagauuggggcggggacauagauccaaacuauaucaucuauuauauauauaacauauacuaaggaaauguguucacauaaauagaauauaauacaauguauuuucuuaacagcaaugucuugauuucuuaaaauccuucaaacuuagacgugaaaaaaaucuaacagcaaucauuaucaaaaauuauuuuuggugauauauuagcuguuaauguaauuagauucuccuuuaauuuugguuuaaagaaaauuaugggaaacagccugacuugcaaaaggaacugauuagucauuuacuuuuuagugaggguaacaauauuuagaauugucccuuugcuuggugcccuagagccuuuuuuuguacuuuaggcgauauaccacaauaagaguggguuggaugggagcuaucacuuucuucugucaagugcaagaagagaggcaggaaaggauaaucuguccauucuauuguaggcacuuccucaacagaucucguggaagaaaagaaaaaauggaaguugaggauuuguauauugauuccccuaaaacuacccuuguacucauaccucuuggaaagccuacggguagcccccgaggguuagacauaugcugauuugaagaccaguuacccagaauugcuguaguaguuaagaugagaaauaacaaagaauauuagaucagugauugaaggagcaaagagggguggaacacacuuugaaauaaaaggaagaugaggaccugcaaaaauuauuaguacugaacaguuuuuuuccauuuuuucaaauauuccauuuuuaauaauuauguucacuucugauuuugauagcuagauaggcauuaaauuauugugauuaaaggcuuauguagaaagugucacuccuauugagaaguuaagccaguuucaaguucuucuuuauaguuuuuaaaaauagaaaaaaugucacaucuauacuaguguagguaaaaccuggucaaucauccaguccuucauucauucauaaauuaauaaacauuuaaaacuaugcucuagacccacuguaagugacuguggaaacaaagauuaaauaccccucucuuccaauuacuuagacuccagugggggagaaaaugugcagacaauagcuacaccacaucuauuggcuauaugaaggcagucugucaugaccauggcgaaaauaaagagcacaggaaacauguaugguuucacaaaggaaacagcauuuuauugaagccuaagugacuaacaguggccagagaaauaauaucucaggcuaaagcaauagcuauaugggaguggaaagcagccuugcaugugguagauagaacacauaguuuugugcauuucaagcauaagguguaagguaaagggauacuaucugaugggacaggaagaagacaaagauugcagaaggccuaugcauugugccaaagacuuugaacuuguuuguaagugacgagaaaucuuuaaaggguuuaaugugaaggaauaacacagacagauuugcagguuaaaauguccacucugauaggagcugagaagauggaucugagagugugaaucugaagggagaagggaggccagcgaagagacuaacacaauguucagaugaugaggaucuaaaccaaagugguaacagugggauuaagaagugaggaaugaaagaagaugaggucuuguugauggacuuaauauacgggaagauaaacugggauacucuccaguagcugugcaaaagugauuuaaauacuaaagaauuuaacucacgaacacgaaguccagagguaagcaguuccagggcugcugaguacaguggcuuaauaacauaaucaagaauccaguugcuuuccauuuugugcucuauacugcaaagauuugauuugcauccugugcuugccccucauggaagcugcuaaagccucagucaucacauccuugccuaaccacaauaaagaccugaaugguaguuucuccuggcaugucucuuuucaucagggaauaaaaacuuuuccaaggaggcugcaccuugccucacaguuaccuuauugcccaugcuuaaaucagucgcuugcaaggacaguggaauaaccaauuggcuuggaccaaccaccuuucaacuccacgguguguagaaaggucuaugaagaacuugaaauucaauaccugaacaaauuaugguucuguuaguaaggaagaauggagaucuugacucuuaggaaguaagugaacagagucuguucaaauucaacuuucugguugaggugaaaggaucggugcuguucuguucauugggauagcaucuaucagaggaaugaugagugggaagauaugaaaagauuuggaacauauagaauuugaggugccuacaggacauuuggggaauguuugauaggcaguugaguagagggucuaugagucaugagcagagagcuaguugaagucguaggcaugaaugaaauucuuaguagaaaugugaggaaugagaagacaggguuauggaaaaaauucuuggggaacaccaaccuuuaagaggagagcacagaaagaaaaaucacgaaaagauacuggaagagugaagcaaaauaauugaaaaauauuuucucaagaguuucagaggaaaaagggguuacagugauaguuucaucaggcuuugcuaugugcucugucaccauuccuccaaacuaacauacagcaaguauaaugaaguagcuugaaguaagagugaacaggaaaaguugguggguugcauggacaggauauuuuugauuuuguucaaagcauuuuagacaggccucuugaauuuuuauguauacagagacagaaaagcuauacucugcuccgagggaaguggacgucugcuauuuuagcucucacuggacacagaaugcuguccuaggaaggucgaagagggggucuuugggcuguggaaucacgagagcaugauugguguuucgggcagcagucuaaaaucuuuaucugaaaaaaaaaauauuuagguacugccuaauggcugcagagaacaaugucacuggcuguaaaauucuaauggauagcuucugauuucuuccuuccuuucaaauaaaacucaugguccuuuuugcucggaggguucuuggguuuugaugugauuucagugucacauucuucugacagcaacaagguccagaggguggcaagugucauuaacaccauuuuacaggggagaacccagagaagccugggagugagucacacggggucacaacaugggcagcucagggcccagaaaccauguucucccucccauccgcacauggauguacccuagagagaagcagcccacuuguguauaaacgcacagcuuuccaagcgcuuccucauucaucuccuuauuuaauuuaaugcuuugcugccaucuugcuucagcauuccauuuccuauccugaauuuaucccaacaauuucuucaaagauuuagaacguugauuacaaauucccuaaugaugcauuugcuguccagaagucaaaguaaguaaugauaguaucauuucuucucuguugaaaaccuuuuuaagaaaacauaauauaauuuuuccagaugaaauuaagcuucuccuggaacaaaaugauagucaguguuccacucaggcaaugucacuuggaaaaguaaaugaauccauuuggauuucaaacuucugagucaugugggaugcccugaucuuucugcuuugaaguugcaagucacuuccuauuauuuccaugacaguucagaagauuuauaguuggaaauucuuauuuuuccuuuccucauauuuuaauuucucucacuucggguaaguuguaaucauuuauuuucagucacacagccauggcauuugagcuugcuguacaaucagagagaugcaaauuaaaaucaucauaagaugccaucucaaauguuucagauaggcaaaaggcgaugaaucugguaacaccaagaauuagcaaauaugugcaccagcaggaacucacauauuacccaggggaaaggauacugguacuggcauuuggaaagcaacucggcacaacuuagucaagcucaaguuguacauauccugugacccagcauuuccaccgcccggugccuccucuagaaaaacucuaacagaugggcauaaauaaacacaugccaaaauguucaguucagcacuauuggcaauagugaaaaacuggaagcaaaaaaacuguuccuccauaagcugaaugaauaaacugugcuuuaauauucagugguggggauaaacaggcuccuucuacaaauauccaugugcauaaaaucccaaacacauaucucuuggggaaaaaguugcaaaagagugugauauaauuuauguaaagauuaucggcugggcacggcagcucacgcuuguaaucccagcacuuugggaggccaaggcgaauggaucacuugaggcuagaaguucgagaccagccuggccaacacggugaaaccuugucucuauuaaaaauacaaaaaaaaaaauuagccaggugugguggugggugccuguagucccaguuacucgggaggcugaggcaggagaauggcgugaaccugggaggcggagcuugcagugagccaagaucgcgccacugcacuccagccugggcaacagagcaagacucugucuggaaaaaaaaaaaaagauuauccacacacacaaacauacucugauacacagaacaugagcagcaaaagcaucaacaggaacgacgaauaccaacuuugggaugcuggucaucucagugagggaugaggagauaggagagcauuuuagcuuuacuuauauuaacauuuucaaaacugaaagauugcaaaauaaaaaugggaaaugucaguauuguuuucaucuuucuggugaguaccuauuguuauauuuucuguuuugcucucuguuugaaauguuucauaguuagaaauuuuaaaauugaaagcuacuuuucuggcaaaagaguucaacacuaaagagaaggcaaagauugaauuggauagaaaauguuuggagcaggacuuagcaaaguguuucuguaaaagcccagaaaguaaauauuuuagaccaugggcauuauauucaggucuccaccacucacucugcccuuauagcaccaaagcagcagccauagacuaaaugaguggcuguggcuguguuccaacauaacuuuauuuacaaaacagaucucagguuggguuuggccugugggccauaguuugccuuaguuuauagaagcuggggguaagugguuucagcaagcaagcaaucuuuggcugcgaggaugaucccugaucccagggccaagaaacaucgaccucugucucuaaagguuuaacugaagagccagaccaccacccucccagccuaagaauccaagucaucgaugaagugccuuuaguagcugaggcuguggcaguacuaaaccucauaaaaaugaccucugaaguguaaucuuguugggaguuuuguuugguucugccaugguuuucacuuggguaaugggagcaaguuuaucccagaugugccuaucaguauucagcuauucagcccuggggacuucccuucaacuuuccaagaaugccauaaaauccucagguuguagaaaaaguuucagccccacgccauucaccauuccugcacagcccagggcuaacuugauuugacuucuaaaacucaagaaggccacucuuggagugaguucaucagcuuagcuguacccuuugccauuggucacuugcauuugccugucaggaaggaugacucagcacuacuguauucuuuccuagaaaucaggaaguuuuauuguucaagcuccuguuguagaaccccuguucaggucuugccacuuuuaggaacggcugauagaaggggccugugauggauuccuuagcugccuaaauacuagcuugcuuuggccugugcaguccuuauucugguaucuacagaggccaggccugagggcguucacuuaaaaggaaagcacuuccacuaccucucucuuugcacaaccaacuuuggccaacccagucugcuuagaccaucagcauuuacaguccuggcaccccuuguaaauugagaacauggucaggccagaaagaugguuaauaaaaccaacaggauuuauuuaugaguuucuucugauacaagccaaauacaagaugugagaauaaaaugaaguauccucgugcugucguuaccggcagggguggcaacauuccugaaagguuaauugugugccaaccauuuuucugauuagcaaagugguucaggacagagugggacuuucuauaaagugcuaaauucagcuccuggcggggccgcugacaugcuugugcagggaugaugagcgaacggacagaggcaagcaagagaacggacguucucuccccuggugaacucugcacagccaagggccagcaguguaggugccguuagcaguugcuggcucaacugccugaaugcucugaaguaggaggauacagccucacagucacugugggucaccauggccgaacaccucuugccuacuuaccugucugacagugagaugccagauccuuggccaucuuacuauugcuaugugugaaggagaaaagaaaugagauguaggaaaggaaaaagagaagagacugacuucgccccagucaucgagauuuccucaaccacuuuucccccuuccugaaaguugaagguuugcauuuuugcuuagcuucccgugagaccuaacuucuaaggaugauugccagauguuuugaaaacauguuaaugaguucaaagaaugcccagcaccacaucuaauacuauuggcccuaagagguuuugccucaaauugaucugauuuagcucugucagcucugucuuagcucuguucucucugauaagaucuaggaccuguugaaggaaagcgugcauuuuugagucuaucagccaugcaugugaagcuguuacuggaacuaggaauugaggaccagacugacucugucaaucuuuccuggcugggacuugcaaacucuugguuauguuuacucagaauguuaauaauuucggaaauuauuaaaauggaaccaaaauacuuucuuuuuaagaggcuauugagaucacaaaucauuccacaaauauaauaagcuauguaagcugagcgaguccaauacuugacacuuggccugagccagcuggaagcguggccauuuucauaugacauuucaugugugcaacuaaggaggcaugagaaaaacccuuuaaaaaugaggcguuaaaauuuuaauaauugugcuggacaaaauguuuuugcaaaaaaaaaaaaacuuuuuuuuucuccuuucugcuuucaauuuuuuuuuuuuacucccuuugcccagcgucaucgacaguaccaaacccuuugcuuuugcccauaucaucgcccugaggaauccuguucagauuucaagggacccacuuacuugugacuuccuaagcuccuccugcuccuucuccagguagaaccgaugcuuuucccuuucgcccucacuauacuuuguggccauuggaucccaccagaauugggugaggcaauuuuuagaaauacagaucugaaaccccaccccaacacuacugacccagaaugcuuuggggccuguaucaaaagaucucauguacuccauaaauauauauaccuauuauguacccacaaacauuaaaaauuaaaaagaaauuuaauuaaaacuuuuuuuaaaaagaaugcuucuugagcccaggaaugugcacuguaaaguaccacaggugauucagaugucguuggucacaggaucacuaccacaaggacccaggccauucuuccuaaauaccuuugucacgcagucacgugcaugccuuucucuggcuucuuaauuacagacuuguugaaggcaaugaccuguauaguauccauauuucguucaacauuuuuuuuuuuugagauggaguuucacucuuguugcccaggcuggagugcaauggcaugaucuuggcucacugcaaccucugccucccggguucaagcgauucuccugccucacccuccugaguagcugggacuacugggacuacaggugugugccaccacgcccagcuaauuuuuuuguauuuuuaguagagacgggguuucaccauuuuggccaggcuggucucaaacuccugacaucaggggauccgcccaccuuggccucccaaagugcugggauuacaggcaugagccgcugagccuggccuuaacacauuuauugagugccuacuguacaccaggcacuguucugagagcaggagacauggcaaugaacaaaacaggcaggucuucucucuuggaccuuacauucccaggagaaaagucagacaagaaagacaagugugauuaugaaauacuaucucguuagaugauaaguucccuggaggaagauaaagcagggaaggaggagacggugacguccacgaugguggugaagguaacucuaagccuucgcuacagaggugguaaccgagcaaagaguugaagacugugaggaagaaggccaaguagacauuugggagaaagacaagguaaggcucuagagcacaagaaugccaagcucauucuagaaacagauaggcuauuuccaguauggcuggagcagagugagcaagugggagagaggacggaggaggcuggugagaugcaggggaguggggagaucuuguaaaggcucguccgacccugugagaacuuugccuuagccuggcccaguggccuguaaucccagcacuuugggaggccgagaccggcagaucacuugaggucaggaguucgagaccagccuggccaacauagugaaacccugucucuacuaaaaauacaaaaauuagcugggccugguggcgcgcgccuguaaucucagcuacuugggaggcugaggcaggagaauugcuugaacuugggaggcagagguugcagugagcugagaucgugccacugcauuccagccuggugacagagugagacuccaucaaaaaaaaaacaaaaacaaaaacaaaaaaaaccuuugccuuauucucuaagauacuggaauucacaaagccuaugacagugcuuacuccagaauaaacguuccauggauacuugaugaauaaaggaaucaucuccaagguggcaugcaaaggccucuugugguuuagacuuagacuaagacucagagaaauaauuuuagcauagauauuuuaacguaaauauuuuuaacaaagaggcagcuauacucacccagagcucagauucuggagccgggaugccuggauucaaauauuucacauacuggcuauagaaucuuggcagccugucaaugccuuaguguccucauccauaaaaugaagaaaauaauaguaccuacuucauagaacucagaucauuaaauacgucuauacaugaaaguaaacuguaaguguuugauguacuuugagaaucaauaaauauuugcuauuaccauuagcauggauauauuuaagacguaaaaaauucaaacauuuaacauauuuaauauucaauuuuaguuauuucuauauacucaugauugauaaauauaacaacugauauauacuauauuacuauaugauacauaugauguauauauaauuguuacauguccauuuuaggguauacauguuaaaagaaugggaauucauggaguccuagagaagguaaaacagaaaaugaguaaacauaaagaugaugaugauguugguaacagcuacauugguagcuaccguuguaaaaagagaucagaguccucaauauugcuggguauuaguguuccuuggggcuacuacuaaaaauacaaaaauuuaaaaugugaauuacacuuugaagucuaucuuucacuuuagucagacuuuggcuugugcccugcaagccacguuuuagauagcaugagaauaauuucuguccaauucucauuccuauugaauuugugucauagucuccuaauacaaaugagaugacacuuugcauugucaucagacaguuuuaauacagcuagggaaauuucuauuuuuuuauucuuauuuuuuuuucugagccggagucucacucugucgcacaggcuggaauacagugacgccaucucggcucauugcaagcuccgccucccggguucacgccauucuccugccucagccucccaaguagcugggacuacaggcgcccgccaccacgccuggcuaauuuuuuguauuuuuaguagagacaggguuucaccguguuagccaggauggucucgaucuccugaccucgugauccgccugccucggccucccaaagucagcuagggaaauuucuuaauucacaccugggaauuaguuucuacuaggagacucuaauuuaugacucauuugaaugauuugaacaucugugugcagauguuaaaugcuaauguuauuauucauauguaauaauacagaugcaacuaguaauuuuucuagccuauguccaguucuaucuuuaauacucauuuuuaaagaaacuugugaacgacacccaucuucucucuacuuuguacuuacuaauuuuuguaaucacauccaugucugcugguuaacauugauggcucuggagguagaugucuggcuggcuucaaauccugggccauuguuuagugguugugugaccucagguaaaugacucaacuucugugggccccagccucaguuuccuucacuguaaagugaccccuucacuguaaaggggucauaauaccaccuccaacugaaggcuauuuuuaggaugaaaugagauauacauguaaaugagauguacucuuaggacagcacuuggcacaaaguaaaacacuguaaauauugaguauuaacuauuauugguacuucugcaaacuggcuugaggucucucuucccagcauuugcuuuguacuucuguaacuguucaacacgcguguuuucuaacugcauuuacugcauaaguuacuggccauuuuguccgccuccuugccuuccaggcauuauuuggggugcaguccuaacugccuacacuuguaccauuuaaucccuuuucaccuccagcugccccugggcagccaucagucugccaugccccaccugacugucacugcuaguaaaaccguacagcauuaaaaagacgugguggcucacgccuaugaucccagggcuuugggaggcugaggcagaggagcgcuugaggccaggaguuccagaccagccuggguaacauggugagaucccgucucuacaaaaaaaaauaaaaagaaaguagaugggcgugguggugcaagccuguaguucuagccacacaggaggcugaggcaggaggaucccagaguuugagccugcagcaagcuacgugccccugcacuccagccugggcaacagagccagaccaugucuaaaauaaaaaaaaaaauaaguaagauugaucccguacucuacggcccuucacagccagccccucucuuuucucguuugcaggauguucuggaagcuuucccuguccuuguuccugguggcggugcuggugaagguggcggaagcccggaagaaccggccggcgggcgccauccccucgccuuacaaggacggcagcagcaacaacucggagagauggcagcaccagaucaaggaggugcuggccuccagccaggaggcccugguggucaccgagcgcaaguaccucaagagugacuggugcaagacgcagccgcugcggcagacggugagcgaggagggcugccggagccgcaccauccucaaccgcuucugcuacggccagugcaacuccuucuacaucccgcggcacgugaagaaggaggaggaguccuuccaguccugcgccuucugcaagccccagcgcgucaccuccguccucguggagcucgagugccccggccuggacccacccuuccgacucaagaaaauccagaaggugaagcagugccggugcauguccgugaaccugagcgacucggacaagcagugagcgccgggccggacgcagcucagccccgcgcgcgcccggccgcuggguggcgccgccgccgccucugucccugcccuccgagcccacugucacgcugccugguguucccccucagcagcaagcacuucucuuagggcugacgguguccuugucacagacguggaucgcaaguggagcuuuugcugauguguuccugaccgaccccgggucccaccugugcccccuaaaccaggcgguggaucaggcccgaaggaaaaugcuggaaaaccaccaccgccacccagcagucagagaggaccuuucgaggugaugcacuguaaauccggcauugauguuuccaccauguggaaaagcaaggauuucccuggccccgcccugcacuccagcucgccccuuucccgcgcgaagugaaggaugcgucacuuuucugagcggccccucagaccucuccugcuggucccuggaccucuggcugggagcgcucauucuugugacuggcaggcugcccucggucgcugcugugaugaggauaugugcaaccuccauaaauaugucgguggacggggcgucuccuaauaaaccugauaccaagaagacaacuugagccacuuggaucccgaagugggcuucccgggaaaccucgagcagagcaggcuacacaaucccccauccucaaguccccaccgccucuucuuccucacuguccccgcccccuauuuguggacuaaagaugaacucuggugugcaugcuauuauugcugcaauuagaauauuaucacacacaaaggucucuauauuaacgcugguuuuauaagugaccguauauuguaaagagcuguuaaaaaguauuauagaccuauucauguauuauuucacauguuuugacucuggcuugcagcaccauucggaguaaggaugacagcaggcccagaaggugucuuacucagaaaaaaaaaugccuggucagcaauucacugucaugcaccuauuuuuagauugggcagggagaugggaggagucgugauuuuuacuuugaauacuauuucacugacguuacuaagcauugcagcacaauguagaaauuggcuugggauggauagguauagggaagggcauucguugggaaauugaugaccggaaacuagaaagccccuauaauguggaauaugcauauguggggugaaaccguauacuacuuucacugccaugacacuaggcaaaaaauauuuccuguuaaaagaaagagaaaaagagagggauauugaaaaauauaaggaguugagucgcuuugugguauagaagggaguaaggaauaaaagauauagaauaguaaucuaguugaacuguucugcacaaaacaugcuuccuuuucaaagaauagacuucaaaagggacgaacaaacauuaggucaccuuuuguguuuauaaugaauuguugacguuuccaugcuguggucucuugauauacggaaguagacguaacuuauuuuccagcgaaauuauauacuucuucugggcuccuuugcucaguugccccaggaaggcuucccugugaguaaugcuuauggaaucugacaaaugugaaugagcugccauuggugggaaucaguaaacuuugaaaaccuuucacugaugauucccugguaagugcuccugugaggggccacuucccuaguaugugagagagacccucugcaagccgcuguggggacuuagcuuccugauacuagguagugaugguggaucuagagacauucacuugaagagcaaggauuggggugggguggguuggugaaucuaucucaggccacugcacugcaaggugcauuucugucauuucugcaacaccaugagaccugagcaagaaugugcuguggcagagggggucuugguuucauaaauggguauauacagccugaacucaggaggcagaaaucaaaagaaauccuugagggcuggaaccugaggauagagcgaaaauggagagaaggguguucaaggucaggagugauuuuugcauuugguggaaaaccucaagucagacucaguggcagaacaugcagcagaaaagcugugaaggaaggaaauuuacgugauuguaauggaggcuagggguggauugggaggugaguggaggagagucucugaccagcugcagagccaaccccuaucauuuuauuaacauggaacccacacagauaggggagggauuaagcuaagaacuuacagaaugcaaacacgagcacacucucuucgaacccaauuguggguguagcaaugaaagcaauaugauaugcugcagugugaagcuccuucugggguuaucguauguacaaaguuuaccuuauaauggcucaaauuguauuuaauuuuuuuguuuuguuuauaaaugaagaaaagcuauaaguauaauguaauuauuuuauagguauacuauuaaauuauagaacaaauaaagauaaucuaggauuauaugugaucccggugugacgugccauaaaaguggaauuuuugacuuguugcagugagcugugaagcagcacuaugcguucagagaguuuuuguucaaccauggugaguucaaccucuagcuuaugucacaugaucuccuuuggggucuggaaucuucuaagagaaauagaaucaggcauccaaggagcagaagugauggagguggcccucaauccuggucuuuggaagcuuccaagccucuuccacauccccugccagcugaagacagaguauucucacugugcuggcugaaggagaaacacuaaacaaggaaaccuugagaaacugcagcaauggaaguccacuguuagucucuccguuagcaccagggacacacuuguucugaguuuuguucauuuucacauuuacuccucaugaguuccaacauuucuuaauuuaaauauuucuuaguuuauagcaucuccauuuuucuauuaauugacuuaaucugccauuuaagaaaacuccguaaucaauaaaaaauaaaauccacaaucaaacugca

SEQ ID NO: 12981 - RNA, 130858 nt, Homo sapiens
cgaggcgccugcgcacuaggcagucggucuuugccguuaccgcuauguguggggcguguguggaauaacguuauugcccagcggagcugagggccccggagcucgaccgcagcggcagcgacgacaacagcggcgacgacgacgacgacgagguggggggaggacggcgugcgagagacucacgggacgcgacgcgccccgccucccccguccggucccucucuccacgguaagggguaagugaugcgaucggcugcucgguguaggcgccgcagccgcagccaccgccgcggcugcuuuccacauccugcuccucggguuugcggcgaggacucgggcgccgcccgccgcggggcgggggugcggggcuggaccgcgaagggggcgcuucccgggugcuccgcgcggcgccgccacccccacccucugcccgccugggacccggggcuugacgggaccacccuucccaucccccacccgccgccccccggagcuccaguccugcggccccccggcuuucccgagccccuugcugccgccuccgcauccccuaagugcauugaaucauuuucagcuuucgacuggcuuugugcagcccuccccccuccgccguagcaguuugcgaggggugcgggcggagcauuggagggaauggcugcgcugccgcuggggaagggauuuuucccccauuggagcagcuccccgggccaaucccuuuugugugauugguuuuggggugugaggcgguuggcgaggucaggcgagcaaccuuuuggacgcguugggagggcguggaagacgcggugucaugcacccugccuggcgacugcaccccguggaggcucuggcucuguaguaaacccgggggaggagagaguggcuuccugucggcuucauuguccuaggauucagauguaggguuuugguacguuucgcuuccauuuuaugcaagcgaugaaaaaauaacauuugcagcugccuaacacagggcgggaagacgugggauuuguauacuaagucacagaaucucuguucggugguguuucguagaguuuuauuuauuuauuuauuuauuuauuuauuuauuuugaggaauguaaggaagacagggacuaugccugcuggaguccaagcacugccaaggugaucaauauaaaauuacuaggugacguuggagccugggcuagagagggccugacaacgaagcuguugugucagggaaaugaacaagcagaauuguuuuuucauugggcagguaaugcauuuauguuccugagggaauggauacaucuuuccguuuauuuuuuaagcaaguaaaacaaacaaaacaacuggcccaguacauuucuguuaccgaaguuguuaacucauuuuuauucucuuaaugaaaauucagccauuugggaggaauuuggcgaagcagaugauacauuugauugaaaaugcauauuuuaaaaugauuuaauccuuaagcuuacaauguaugcagccguuugcuggcguugcuucuuaaaacacaccagaagagagaauaaagcaggauggggaggagcagguggaggaauaaugggagaggagagagugacauuaugacuauaguaucuggaucuucacugguauaacccuaacuggguaugcuucagagacuuaggaauucagcucuggaaacaguacacugaugaauagcaacuuauguauuuuucuguuauuauuuuuuaaaaaguaaaacuagggcugccuuuagcucuuccuaacuuuguagauaacacggaagagcccaagugcacuugacagaggaagacacuaaaacucagaaaguuaacugacuugucugcccaagccagacaguuaaucgaaggcagagccaaacgaaacucaagguccauucugcagagugaucuuuccugugucccccuagcccuuuuaccuugugaaaauguauggaaagcuucucuaugugcucccugaguaggcugugacuaucacugaacuugauucucaccgugauuaaucuaguucuugccuuugugauguaaaaguaguaauccuccuaaaauggaccuuuacuuucauaaaguaacuuacuacaugaggaaagauguccuaacaugugcuuuucauaaaaacgaaguguugcaguguuuucccuacuaccuaaugguagcuacuuaacgguagguuuuaauauuauuucuugaaaaucaauaguauuuuauaauaguaugaugaucaacucuauaggcuguguuaaaaauaaaauuuccgcauaacaagaaccuaugauguuuauuuugccacaguuaaugaguuguaaucauuaaugaguuauuagugauuacuuuuaacuuaaacuagaauuuacauuuuaagauauauuaacuuuauguuuuuuauuggguugauuuugccauaaagugcuuuuuucuucccuuauaauuuuaaucguuuaauuuuacguugcauuuuaauagacuucuuuaaaggauuuauuauuuaucuuaaauuucaacuuuaaaaaucuguaacuaaauuucaguaugugggauuauauucaaucaugcuuuaaauguauuuuacugguaaauuucauuguguucugagauuauuuuguauggaaauaaucugccuguucccuauuuuaacauuagaauagugaaauuuauacuguaaaccuuagcauacauucugcauauuaaugcuguuaugguacuuuuuaaaauucugugcuucgugauuuauuugauuuguuccaaguaucaguuucuuguuccuuuuuaucuacugaaaaaaagaacuaguuuuauuauuguaucugauugcaauuagauaaugcucaucuaguacuaaauauuguauaugcuuaagcuuuuuugucaaaauguuuuuuauuccacaaaauuguauuccugaaaaauauuuuuucuauacuaauuaauagguaaagacuuuucuuucuuaucugucccaaacacugggauguuaagcaguguacucuucaacuaaguaucugacagacaaccugauauuuaauugcuaacuaaaguaucuguacaguugcaaauuauucuggaaguauaacaaaagagcaguuacgugccauuugaagaaugcuuggugaguagauaguauugacuggagcauucaguguugaucuguuucauuaagaaaugggauacuuuugaugggaagaaauaucuuuauuucauuaauaaccaaaauuucuaaucagauacccuagguuuuuauuuacuuacucaaaaauuucauaaaggaguguucagcagugaguuagccauugugagagauaaaaaacaucugucugguagugugguugauuaaacuggauauauuguccaguuuagcagaaauguuuuagccaaagccagugacauagccaauguguguugcuguuaaagcccacuuuuauaucaaauaaagguggaaaaacaaaacagcaaaagcaaaguuaaagaaaaccucauaaaaucuacuuacauacaaacaggaauugcagaaaguauagaaguggaaaagaaucccaagcaugcauuguugaggucugaaaaacaaaugacacauagcagagaacaagucauuuuuuaaguauauccauaaguaauaaaugauauagaaaauauuacccuuugaaacacaauauuuauugaaucguugaauaauaccuaccaaauuuugaacauuuccuaggugccaggaaguuuaugugugugugguguguguguauuuaauuucugcaacaaacuucuaaauuaagguauuauuuuuacacauugaaaaaauuugaagcauagaguuagugaauaacuuugccucugcguuacacauuccuaagugauagggccuauaauugaaccuuugucuuuuuggcuaaagccaaaauucuuucuacucaucuuuuuuaguaaguuaaaggguaccacuuauuuccuuacucugguucauaaaauuuuagaauucaagggaacuuuagaagucagcucauacaauguaucacccacuacuaauaucucugagauguuauuggguccaacuucuccacaaacccuucccugggcauaggaaagccuguuuagcuuccaaaaaguguaauaggaagaucucacuuaaauugagcuaguagcugcuuuuacuauauaacuucuucccacugguugcaauucagucuuuaggaguaagaugaaguaagguuuuucucaauauauuagcuagauuuucucuugucuaaauguuaggacaccuccaacuucauaugguuuccuuugccaucccucacaucucucagcuggauucaaucaguuuugucagugcuauucuuuguguucugaucuuguuuccauauuuaauucugcaguuauggucugaaugcaaagugcagugaaauugucccuuuccuuauuucaagccauacacuuguguuuaaagucuaaaauuguaucaacucuuuaacaacagucaucucugcuaauucaaagcaaaaagcagagagagagagagaaauguuacauggcuuuucaaguuauauuuauguaauucaagguacuauuuuuugagauuuugcucuccuuuucuaauguucauaaauggccuuuauuaaaugauaguguuaguaacaccuauuaaguaaugauagguuaaguuucuuuugauguuggucaugggguuuuguuuuauuuuaguguuccugauuaaccaauaaaaaguuggcagccuuauguugauucuuaauuuguuuucugaaaaauuggucuggaaaccacugauguagucaacauaaaccaacauuuuuacacuuagcuagauuucucccauuguguauaaacacacaggugauguuuuuaaaccaguauuuuaccauugccuccuauuaaauuucaucuccgugaacguagcuauaguuaaaacuugagaucuucuugaaucaugauucugucauccaagggauuagcuuuccuuccuggcuuuuugacauuuauaaauucaacaagccaaacucuuaugucuccauccuggccauauacuuaauauagccaaggacaaagccaugcacauuuauaaauagaaugaauguuacauaaauaaaagaugcugggaggaaaggugacacaaaaauaaugaaaaccauucggauggguuuuuuuuguuuguuuguuuuuggggccuuuuuguuuguuuuuguuuuuguuuuuuugagacggagucuugcucucucgccaggcuggagugcaguggcucagucucggcuuacuacaacgucugccuccuggauucaagcuauuccccugccucggccucccgaguagccgggacuacaggcacgcccggcuaauuuuuuguauuuuaguaaagacaggguuucaccauguuggccaggaugaucuugaucuccugaccucaugguccacugccuaggccucugaaagugcugggauuacaggugugagccauggcgccuggccuuguuuuguuuuuuaaauuaaagagaaaaccauuauauccuccagcaguaaaggaauuagaugaaguuuacaauauacuggaggauauggauaauucuuuuacgauguaaagucaaguaaggauagaugcuaugaagaaaaauuaaucaagguaaagagacagugguagaggacugcuguuuuacauuuguuuucaaguguucauucagguaguuuucaaauaauauuuugaaaagaaauaauaugaaaaaccuuuucacccuacaucuuaucugcugaguuaccacuuuugccaauccaguaaguagcuauuuuuauuauuucuuauguauucuucaaugaacuuuauuuauuuauuuauuuauuuauuuauuuauuuauuuugagacagagucuuguucugucgcccaggaugggguacaggggcaggaucccagcucauugcagccuugacccgcugggcuuaagcaauacucccaccucagccuguugaguagcugggacuacaagugugcgccaccaugcccagcuaauuuuuuguagagaugaggucucacuauguugccaaggcuggucuugaauuccugagcuuaagugauccucuuuccucagccucccaaaguucuaguauuacaggcaugaaccaccacgccuggccaugaauuuuucuucaccucaagcaaauauaaauacauauuuuguguccccucuaugacacaaaaaaauagccucuuuauccacuaugcuacaccuugagaacuaucuuagagugguuagggaaucccucuuucugaggugacauuuagcagagaacuugcauuagguaaggaagcaucuuguagguaucugaguggagaguauucuacucaggugcggugguucugaggcaggaaugggauaagugaauuuggagaacacuguggcugaaggugagugaggaaaaggugcuuauaggaggaaaugagguugcauagagauuuuauucauugauuuuaagugcuaugagcauucauuggaggauuuugagcaaagccaaaaaauuggguuauauuuuuaaagaauggcucugggaauucuuuaaaacacugggaaccaugagauaagcuaggaaaugauuggaaugaucugguuuaagagacauuaauggcuuagacuagagcgacaguaguggcaauagugaaaguuacuaguuucuggcuuuagagagucaaauguuuuggauauguuaaguuugaagugucuguuaaacgcccaaguggacacaucagguaggcaguuagauauguaagucaagcauucagaggagagguuuggacugaggauaguuaaauguuaagcaucaccaguagacuuaaagggaucucuuggcuagggaguuagacugagaagagauccaagaauugagaauugguacuuuccacauggaaagcugagcaaaagagaaggcgccaucgaggaggauugaaaaguggacaguggggugugaggaaacugaagaguguguugucccacaagccaaguaaaggaaguauuuuuagagauaaggagugaucaguccccuguaucaccuuuaaucaccuaaauacuucauaagaaaucaggcaguauccucuuucuuucugaauggucucugagaaagcaauuuccuuuuuuaaaucugguuuaucaacaugaauguucacaguuauucuccccuggcaacuacuaaaucuaaagcccugaacaaaguuuuacucauaaagaggccaaugcuguuuccuacguggaugaguauggcagcugcugcugccucugauguuugaacaggagaagcgaugcuguuucauaggaagaauuuaucaggaagcuagugauaguccagcuaccucagagguuuauugugguagccaaacgagguagauguaaaaaccaaaugaaagguauaauugcagauaggggucuccuucccuuauugccccaagugugguaccaacuugauaguguuagauuugaagaacuauguuggcaaauaaaaauauuuuucauuuugagucuguaggaauaguuuuuuacuuccuaugcacucuaucccgauaggcaguuucgcacaucauuuuauaauauucuugaggguagagaaaagggcuagaaagaggauaagaacaaccagggcaggcgcgguggcucacgccuguagucccagcacuuugggaggccgaagcggguggaucaccugaggucaggaguucgagaccagccuggccaacauggugaaaccccgucucuacuaaaaauacaaaaauuagucaggcgugguggcgcaggccuguaaucccagcuacucaggaggcugaggaaggagaauugcuugagcccaggagauggagauugcagugagccaagaucacgucacuguacuccagccugggcaacagggugagacuccaucucaaaaaagaaagaaaagaacaaccaggcuuugagauaauagcuuuuuuucccaauccuaaacucauccuuuaauucuaaacagugucuaaauaaagagaauugagguagaaaaguaagcaaguuaaaaggcuuccuuacuuuuuuuuucccuaggccagccaggaagacuuucuucuuuuaacugacuuuuuucuggaaaguguucaacugaguaaugguuugucacauguuacauggaauagaaaaagugcaaauucaaagcuuagggacugguuagggguuuugaacucuaggcagccagcuagaaacugauuugaggaagcaggagggugggggaaaugagucugcuugaugauaauagggguaaagugcaaaauacuuauuuuggugaaaaaggaacaucgcaaauacaggacuuuuugugguaagcuuuuugaggcaauaggacuauaacuucacaauacauagguaucuugcagaccuuauauaauaugauuugcuauggcuggucauuaaauacuucuccuuggauaaaaaaugcauauaaugcauugcaaauugaaggccauuuuauuuuuuauauuacaaaucuaauccuaauacauggcagaaaauuuagaaaacaagauuuucuaccauuaaguacuaucauaaucccacuagccaguaacccuguuauguauucuugucuauucugguuuaauuugguaacauuuuaucaugaaguuaaacuuucuggcucuaacuuuuaauguggcauagaaucugucuucucaaacauguaaucuacuuacacacaauuuaugaaaauuaaauguauuuuuaaaauuguaaacaacaggccgggcccaguggcucaugccuguaaucccagcacuuugggaggccgaagccagcagaucacuugaggucaggaguucaagaccagccuggccaacauggggaaacccugucucuacuaaaaauacaaaaauuagcugagcgugguggugcacaccuguaaucccagcuacucgggaggcugaggcaggagaaucgcuuuaauccaggaggcagauguuguagugagcugagauugcuccacugcacuccagccuggguggcagagcgagacucugucucaaaaaaaaaaaaaaaaaaaaaaaguaaacaacacuguaauggacauuucuaacucugaauuucugugcaaaucaauguuuuucuuugauuucaacaaauuaugcuuaaaauacaaugcagauacaaaugcagaauucuacuaauuaaaccuuuucuaacuuuuuaauaaaauuacccccuccaguuuauaucaguuuauucuucuaccacuggcauaugaaacuguguguuucuucaccccuucaucagugcugaauauuacguaucuuuuuuaaaauuugcuuucuuuuuucuuuuuuuuuuugagacgaggucccgcucuguuacccaggcuagaguggagugguguguucauggcuugcugcagccuuuaccuccugggcucaagggauccucuccgcucagucucccagguagcugggacuguaggcaugggcugccaugcccaucuaaguuuuuuuguuuucuuuucuuuuuuguguuuuuuuuguuuuguuuuuuguuuuuuguuuuuuguuuguuuguuuuguuuucuugagauggagucuugcucugucgcccaggcuggauugaaguggcgagaucucggcucacugcaaccucugccucgcggguucaagcaauucuucugcuucagccuccugaguagcuggaauuacaggcacacaccaccacaccuggcuaauuuuuguauuuuuaguagagacgggguuucaccauguuggucaggcuggucuugaacuccugaccucgugauccgcucaccuuggccucccaaagugcugggauuacaggcgugagccaccgcacuggccaagguuuuuuauuuuuuuauagagacaaggucucauuuuguucccuaggcuggucucaaacuccugggcucuagcaguuuuccugucucagcaucccaaaguggugggguuacaggcaugagccacccaaucuggacaguuuugccacuuugaugaacaacaaccaaaaaaaaaaaccuuauuuaaauuucuuuuaucaauaacacuugacauuuuuuuaaaaugugcuuauuggccauuguauuucugaucugaguugcuuguaugugugccuuuugcacacauacauuauauucacuuguucaucauuauauucacuuguagcagauucuaggaucaccauacuucuguuguaucacccugcuucccucacuuauaacaacuuuuggguaacagauacuguaaaauuuuuucccagauugucauugccuuuuaaauuuguuauuuuuacccaacaaagauuuuaacauguauauagucaaauuucuuauuuccuuuuccuuaugaaauaaucucacuacaugaaauuuuauuaaauacaugccuaucauauuugugauuuaaauuuuuacauacaaguguguuaauugauuuuuuuuuuuagaauguauuuagucauauauagccugcugugucaguuuauuguguaacucuucggaguuuuuacuuucuuuuuuuuuacuuuuugugaaacaggguuucacuuuguccuccaggcuggagugcaguggggggaucuccauucacugcagccucgaucucgugggcucaagccauccucccgccucagucccccaaguaauugggaauacagggcacaugccaccaggcccaguuaauuuuuucguguuuuugguaaagaugggguuucaccguguugcccaggccggucucaaguuccugagcucaagcuaucuaccugccugagacucccaaagugcugugauuacaggcgugagccacggcuccuggcccagaguuuuuacuuucuaaacuauuuguuuuuuaguuuccucuuuucacuagaguuaaauugggagguaaguuuuugagggugugugugugugugugugugugauacaaggagcucucuauuuugggcagggggguuauucuagauuuuuuucuuuuuuuuguaaugaaaauucucaaauguacaggacaguugaauuucacaaugacuacucauauacucaccaucuugauucuacuaggaacacgauagcaguuuuaucacauaccuagccauuuauuuaucauuccauucaucagcauaucuuguauuuugaugcauuucaaaguaaauugcagauauuaguauuuguguguguuuaacuaaaguguucuuaaauuaauugaggcuaauuauguuucaguuuuacauuuuccgaauguacuacugaaauauuuuccaaccaaucacuguuauauuaaaaaaaagacaguuaaaaaaugaacauacugguuuucacuccaguaguguuggugaacuagguguuucuguaaacagguagcuaaauugacacagaugacauugaguuauuccuuuuggggguagggcauuuguguauguguguguguguggugucuacuuuuaaagaggaaugauggacgggcgugguggcuccugccugugaucucaauacuuugggaggcugagguaggcggaucacaaggucaggaguucaagaccagccucgccaucauggugaaacccugucucuacuuuaaaaaaauacaaaaaugagcugggcaugguggugugcaccuguagucccagcuacucgggaggcugaggcaggagaaucacuugaaccugggaggcagagguugcagugagcugagaucgccccacuggacuccagccugggcaacagagcaagacucugucuccaaaaaauaaauaaauaaauaaauaaauaaauaaauaaauaaaucagaaugguaaguugaauuuuguuuuuguuuuuuaagcuaaagagcuauuuagggaagcuuauauuguuucucugaucuagagguucuauccuuuaguggcaaauccaggaguaaauuauucauucuaaauuuuauaucuuacuacauuccacuuccacugucccccuacccuucuuuaccuacaugaggaauucuguguuggucuauuuaguaaaaaaugagagcccuugcuuuauguuuuacccuaugacucuuuccuuccuuccuuucucccucccucucucucacucugucgcccaggcuggagugcaguggcaugaucauagccuacugcagccccaaacuccugggcucaagcgauccuccugucucggccuccuaaagcagauaggcaugagccaccacgccuagccuuuucucuaugauucuaagugguguauaacaaauuccagaauguuaaggaucugcuauagagaaucaacaauucaaaaauuuaggaccgggcgcaguggcuuaugccuguaaagcuagcacuuuggcaggccgaggcaggugaaucaccggaggucgggaguuggagaccagccugaccagcauggagaaaccccgucucuacuaaaaauacaaaauuagcugggcgcaauggcgcaugccuguaauccuggcuaccugggaggcugagguaggagaauugcuugaaccugggaggcggagguugcagugagccgagauugcgccacugcacuccagccugggugauagggcaaaacuccgucuuggagaaaaaaaaaaaggauucaaaauuuauaaauuggagaggcaugaacaaauagaauccaagucggugaaagguaaauaaaguaaaguuuagaacuuggggaggguaccauacccuggggacaaggggaugggacugcuugguaucuggcagaagcaggucuaguguuuauugugaguaacguuuagaacauaacucauuggccgggcgugguggcucacaccugugaucccagcacuuugggaggccgaggcagguagaucauguggucaggagaucgagaccauccuggcuaacacggugaaaccccgucucuacuaaaaauauaaaaaauuagccgggcgugguggcgggcgccuguagucccaguuacucgggaggcugaggcaggagaauggcgugaacccgggagguggagcuuguauugagcagagaucacgccacugcacuccagccugggcgacagagcgagacugucccaaaaaaagaaaaaagaacauaacucaucacuagaaucuggcaccuuuuccuaguggauauugggucgauuccaaauuaacguccucugcccuucaaauauaacaagaugaggguaggaauaguucaucaaagaaugcuguuuugacaaccauuugcuuucaucuacuucucagaugucuguuuuuaccacuaggauuucuaauguuugacuuuccuuucucucuuguucuugggcccaauuuguagucuccuccuccagucugcauucuaaaucaguacauugugcuuuuccugugcucuaauauguuuucuauuucuuucuuuuugaucuuccuagucaacuucauagcccacucccccuacccuccuguauugucaccccaugcaauccaagcugaaggagucuauuugagagauuagaaaauguauacuuuuuuuuuuuuuuuaaugagagggagucucacuauguuguccaggcuggagugcaguggugagaucucggcucucugcaaccucugccucccggguucaagggauucuccugcuucagccacccgauuagcugggauuacaggcgccugccaccacgcccagcuaauuuuuguauuuuuaguagagaugggguuuugccaugcuggccaggcuagucucaaacuccugaccacaagugauccacccgccucggccucccaaagugcugggauuacagacgcgagccaccacucccggccuacauuuucuugauauaguuaagauaaucucuuuauagcucucaucauaucaucaccuucuuuuauauuuuaaaauaccuuuauagaaggugaagcauucuuaucauguuuuaauucacaaagcagucauuuuaguuauaaugacauuuugguaaagaaagggaugucguuaacauuguuuuauaaggcgauuaaauugcuagugucugguuuuucuguuuugcacauucuaguuuuguagucuuaauguggagcacaccuguaguuugcaacacuuggucugaaccgaaucugugauucaaaauauucguauuccuuaguacuucuaaguaauucuugcaaaaaguuguguuucauuaacuuuucauuuuuauguucggaggcacccuccuacacaaaaugaaauuugccuucuacaauucucuguucauuuagauauuauuaaaacuuugaacuuuguuuucauagugugaaaauggaauauuaagcacuuuguuguuugaauucgugcuucuggcugggcacgguggcuuacaccuguaauccuagcacuuuggaaggacgaagcgggaggaucaucugagguuaagaguucaagaccagccuggccaacauggugaaaccucaucucuacuaaaaauacaaaaauuagccaagcaugguggcaggcaccuguaaucccagcuacuugggaggcugaggcaggagaaucacuugaacccaguaggcagagguagcagugagcugagaucgugccauugcacuccagucugggcaacagagcaaaaacucugucucaaaaauaaaugaauaaauaagugcaucuuaaucugugcacagugaaaucugcagaauuucaaaaaaaaaaaaaaaauacagauacccauaccuuaccaguuacauuauaaguucaagucuucagguaugaagccuagacauauugauaaauacauacacacauagaaguguuccuguguguaaaaaucuccgcaagugauuccaggucuaagagccauuagcuuaaggugaucuccuuaacuaaggguugucuucuagggaaauaagguggaacgucuaaccgugauggugaacggcuucacuuucaaagugaggagaugaaucuuggaacggaucauauggauugcuuauugcaauucuagucugauuuauuuuguauuaaauggauuguauucuuuuuuuugagacagaguuucuuguugcccaggcuggagugcaauggcgugaucucagcucacugcaaccuccaccucccagguucaagcaauucuccuaccucagccuccugaguagcugggauuacaggcaugugccaccaugcccaguuaauuucguauuuguaguagaaacaggguuucaccauguuggccagacuggucucaaacuucugacuucaggugauccacccuccucagccucccgaagugcugggauuacagcccggccagauuguauucauauuaccaaguaaucagaaaauucccagugaauuuuaugucagauuucuaguauggcuauuggccuauugauaaaacuucaccagaaaaguuuauauugugccacuauuaccuauuaauauuugcugaacauuuacuaaaguuucaggcauccauacaagguacaagagauaccaggauuacuaaguaauagccacuuuacucaagcaacucaguuuauaagggaaaauagacaaaaaugaauauauuuuguacaaagaaguuuaggaguugcuguagguauaugugaagggcaagauagguggucagaauugagaggcugggaauucuauggguguuuuucugggggaagugauugcuggagaaagcucacuaugaaaggucuugggacagcauagagcuuucauuuucaaauucaguuggacauggaauacaagggaggagcagaguaacauggggagauaacagggcuuuuuacucaaaacugaagaguuugaauucuaucuugaacucuauagggagcuauugaaaauuagggagugaaauuauuacauuuacuuuuauaaauguaauuuugauagcuggauagaggaaggauuuggagagugggaggcuagagacaagggauucagguaaaagaguucugcaguaauuuauugguaagaaccagugggauaagaggaaaggcacaaagaaagauauuuaggauguggaaucaaagggacauaaugacuuaccuaacuaaagcgggagugggagagaaaauaucuggucaguuggugaugccauucgcuaagacggggagaacaggaaaaaaggcacauuucguuagaugaaaggguucuuucuguuuuuuaaaaauuaaaucugaggaguccaggaggaccuugaacuggaaaugacucguaagcagagggaaggucugaucuuguaaaaaagguuuugacuugaaauuauauguguaacauuauaauaagcaauauuggaagcccaggguuuucaaagaagucccaaagagauuauguauagggaaguaaccccguaaaaacagaauuuaaagaaaaaguagacacuuucaaagagauugaggcgugcccacagaagugagaggaaagcagacugauacuuguagaaggcaagaauggucaaagauauugagagguaauuuaagauagcaauacuagagaucauuagauuuaacaggaggacauuuucaaccaugaaccguuagcaccauaguucaaauuccaaaaauuacuuugacuuuggaaauucaaauuuacuacuaauauguggacugaguucuguuauaaaauuacuuucugauuagaugauuugauuuuuucuuuaauacauguauauauaccauacacucuaguacauuugcuaaaagaaaauucaaauauaaugaggaaaauuauacuuuuaaaaaaugaucuaccauuagguuuuggguuacuuccacuuguuggcuauuaauaccaauaaucuuuuaucuguguuagcuucuguuuacccucaaaauugcagaagcucuucucuaaaugaaauauaucacuauucuuuuuuuuuuuuccagggcaguucacuguguugccccagcuagagugcaauggcacagucuuggcucacugcauccuugaccuccugggcccaagcgaucuuccuaucucagccucccuuguagcugggaccacaggugcacgucaccacaccuggcaauuuauuuauuuuuuuuauuuuuuuguagagacagggugucacuuuguugccuagguugguccugaauuccucggcucaagugaucgucccaccucggccucccaguguucaguguucuuuaggcuggcugugccuagcgauucccucccuuaagagaauucuuguauuucaccuucucagaaauaaucaaacuacagaacaauuccauugaacuguuacauaccucauggcauucugguaaagauaaaccuaaucacuuuaaacauccauagccuaagaauuacaguauaugaaagaacagucuugccaauacaaugaauauuuaaaaauuuuagacaaaagauagacccgauuguuuauauaauuuacuacuuuguaugaaagucauaaugaugcugucuuuuuuaagauggagucucguucuguugcccaggcuggagugcaguggugugaucuuggcccacugcgaccuccaccugccaggcucaagcaauucuccugccucaccacccccaguagcuaggauuacaggcacccgccacaaggcccagcuaauuuuuuauauuuuuaguagagacggggguuucaccauauuggccagguuggucucgaacuccugaccucagggugauccacccuccucggccucccaaagugcugggauuacaggcgugagccaccaugccuggccuauagugauacuaucucaauuaaauuaaaauacaaagcacuuuauuuucuuuugauuagauuaaaauuuucuuuuccagcaugcauuauuuuaucagcuauucugcauguuuauauacuauaaguaugagguauuuaacgaaagcgauccuuaagguaaauaauagugucauuuguuaguuugagagcugaacuagcuagagugccacuagccauauaugaauauguaaauuuaaaugaauuaaaauuaaaugaaauuuaaaauucaucuuuuuaguuguauuagcuguauuucaagugcucaauaguuaacacauggcuuguggcuaauguauuggacaggaauauuuccaucaucacagucuguugcacagugcugguauagagauauuuauaaaaauuauaauuuaacaugaagauaaaaagaaaaacugcauaauuuaggcuaguaauuagcaacuuacuguuauacaguaaaguguguuagugauauauucacuaaauacauucuugcuuaaaauagacucugagacguuucaguuuucuacacuuugaaguuucaauucacuuuucauauguuauacugauaaugcaauggaaaugauuuguacccaccucccaaauaguuaauguauagugaaucagaaaagguauugaagaugaacagaaaccauuuuuaaagggcacaagaauuagugauaugcuaaaauuaauugcagacacauggcagagaaauuguuguccugcgugagcuaagaacagugaaucaaagcauuugacuuucaggaucguaacagacccuuaacccagacugcuuuccucccauugucacucccuccuguagacaguuucaggucuuccagacagcuuuguguggcuuuuccugcuccuagugcucuaugaucugacaguuuuuuagauuuauaguuauuuagugaaccuggagauaguuuacuauucuuucagagucuagguuucuaauccaugcuauaccccaguuuacuaaauuucccucguuucucuagauugauccgcugauuuuuggccagcugauuuuugguuuuugguuuuaauaacugauugauucuuucuugucugugaacuucucgaggagagaaucuuggagccugcugguggccaaacaggaggcugagaagauugaaaauaggcugaaauuuacaugaacugucagcauuuauugcccaaacagaguguuagagaacucguuguuaaguuaaaauauauugcauaucaucauacuccaacuguagccaaauccgagacuggcagaaucaccugcaucauuucgagguauauuuaagaaaaauacaaaggagauagugauuugugggaaaagccccauauuugguagcugaaggcccagauuugaaucuaggugguuccuguuuauacugcauuuguaaccuugaauaaggcuuuaacuuuaguuuucuuaagggaaaaauguuucuugaaugcuuguuuugggaguuaaaugaaagaaugcaaguauuaauagaagcaauuagcacaguuacuggcacaaaggagguacuugauaaaugucugaaucuaagucaauugauuuuuugguguaaagcaacaaaauuaugcuuuaaugaggguaguacaguucuacaaaagcaaacaagucagacuuuacguguuucauaaacugacagggaaaaccuagcaagaauuuuuaaugccuagauaauuuauggaaaaguauaacuuguuuuuucuuagguauuuucuuuaagcacuuuauugaauguuuuuuaugaagaaaucuuuaauuaaaucacuggcuugcuagcuuuucccaucaaaucuaaaucuucuguuaaaaauauauaauaaacucagacauagaauauguggugugguauuuggaaugucaucuucacuuauuuuuaugagaauuuuuuuuuuuuuuuaguuuuaaugcuauaucagauuuaaguugcagcuuauauuuuuucuuuaaaccuauuugcuuuaauugccuuucacaaaagaauuaauaauguauauggcagaugauaaagguaaaauuuagaguagucauuccagaauaaucaugaguguaugaaagcagaaauuuucccaguaaugaguuuguucacaugagcaugaaacaaguaucuugguaaguauccaaaaaaagcacagcuguggauuuauccuuuuggaguaacuauaaaacaaggguggagauuuuaaauaaaugaauuuuuuccaagaguauauuucauuaugugugccagaucaaauuaauuauacagcagagcugaauuuuugaauauguucuaagcauaugucaguuucucaaagauauuuccguagaccaccccggccugaagagcaccacccgaguuauccuguccucuuuguuuuuucauguuucuuucuucccacugccccugagguuuucuuauucauuuauguagcuauuuguuuauuuuugcugcugugagauuaggaacuuuuucuaucuugauccauucucuuuccccaguaucuuauagugcuuacuacuugugaaugaagaaacaaacuggguuuuauuuuauaguacucuauaaaaugggguccucauguguaacaguauauaauguuuauguccauuuucucgaacuugaagaauuuuuguagcuaaaaccaauuaugucuauauacacaccuauaugugaaauucuuagaacagugccugauucauauuaaguagucaauaaaugcuaccaauuaugaauaaaaccauuugcuuuuauaauauaugauuugcauuuuacuugauccugaguuacuaugauguauguuuggacuuuauuugauaaugaauccuuaguugaaaugccaccccuaauuauuucuucauuuucagaaauacguggcaucaaaagacagacuucugguguugaggauauauuuucuguuagggacuuuuuaggggugaaaauguaaaauaggauuccugaauuuauacauuuguuuaaaauuguaucuuuuagauacuugguaugaugggguaaaaagacauggcauaauuacagaugccaguugaugcaaugccuuaguguguuuauuucaguugauaagcuuuacugcugguucagauuacaauuuuguaaggugaaguguaucacuuuuaaccccccuuuguuuagauuuucauugauuuuauuaagaaaaccagaucaucuuucuccuacgauuuauucuuucaggaaacaaagcuauguccugggccaaccccauggagaauauugucacccuuucaugccuguugguaccaaaagaaaaguugucacauggaugccuaaguagauaauaucuuauuaaaaugagaaaugcauaagcuagagaaaagcauuuccuacuguguagacgauaguccuaaugugaggccagcuauuucuuucucuacuguguagaccgauaguccuaaugugaggccagcuauuucuuucucugcaauagcaggaguuguggggugagaggagguuuaaucuuuauaaagccaucuggugaugaaucagccagccaauugccagaccauaaggauagacugcccuuaacauguguuuuagcucaaguaauuguauacacugacuaucauuuauagaauaaugauuuuuucucaggcuuaauaaucugaguaaaccaguuucuuuuuaugggugauauggugcacuauuuuguaguucucuuguuauacugucauauaucaagugcacuuacuuauuauugccugucucaacuuaaguauuauaguaauuaacaucauucagaccccucuugccaucauuccucgauuugaaugauaugugaauaggaacaacguuuuaaaauauauauauauauauauauauauauuuuuuuuuugagauggagucuugcucuguugcccagucuggaguacaguggcgugaucuuggcucacuguaagcuccgccuccuggguucacaccauucuccugccucagccuccuaauuagcugggacuacaggcgccugccaccacaaucggcuaauuuuuuguauuuuuaauagagacaggguuucaccauguuagccaggauggucuugaucuccugaccucgugaucugcccgccucggccucccaaagugcugggauuacaggcgugagccaccgcgccuggccugaaauauuuuuaaaaagcaguaaaauguauguaauuuuaaaccuguguagugaagcugugugcucugcucaauagcugcagaguuuuucuuuguuucauguuuauuuagaauguaaaacuuagauauuuacauuuuaguccauuaaaucaugaaaagaacucugauuuagcaggaaagucaguuuuuaaaguuaaugauagcuuuaaauguaaauguaaugauaguuccauguaaauggaacugugaugcugggccaguguucacauccaucugacacccaagugucugagcuuucaacuuuucucagauugcuagugaaaacagcuuuaugugacaaaaagauaaagaauaagaaagagacaaccgaagaggacuauaacuaggauuuuuuaauggcuagauugaauugcugucaaagguuagaugauuaauuucaccuccugccccuggaaauuucuagguuauccucacuucaagacuuguagcagcuccaaagcuacucauucauugaaaaauagcuugucaaaugcucacuguagaugaaacauugggguaggcucaagggauacaaagaugaaaaagugucucuguauuucagcucugugcugguuuagaaugauaccaucccuaccgucaccauccaugucuggaguaaugacaaccuccuguuguucuaguaacacccuagguuuaucucugucauggcaucuacuaccauucccugcaguagugaguuccuugaggcaagauauuuuuguuuguuuuaucuuuauguguccuugauccucagagugucuggauuccgcaggcuucucaauagcuguugaaagaagggaggaauggaggaagacaguuuugcugccuucaaagagcucaucaacuugagguguaaucauaucguuacaguauagaauuauuaauacuaaaaaugauacuuuaaauuguagcauaauguuugaacaaaauauugugggacuacagagaaaaguauggcuaacucugcccugggggaaugggaauaaacuuaccaaaaagcaaaucuguuaguuuuguacuuucucauacucuuugagauuuccuaaaugcugaaauugauaagcacagaagauagagacugauauaauuuuguauuaugucuagucugcuuucaagaacaaguacuacaguauuagaagagacacugaaggccaggcaugggggcucacaccuguaaucucagcacuuugagaggcugaagcggguggauugcuugaacucaugaguucaagaccagccugggaaacauggcaaaaccccaucucuaaaaaaauacaaaaauuagucagguguggugcugcacaccuguaguccccguuacucaagaaggugaggugggagccuggagcuugagcuugggagguggagguugcagugugcugagaucuugccacugaacuccugccugagcaauagagagccagaccuugucucaaaaagaaaaaaaaagaagaagaagaagaagaaaagacagugaggauugcugauguggaaaaauggaagaauuuggggguuugcuuuagguguauuauuaaucacuuuaaaugaagugcuggaauuacaggcaugagccaccgcacccagcauaaagaugguuuuaauucugucauugauguauuugucuucuguauguguuuuuucuuuuauucuuuuauuauugucuuuuuaaaaauugaacuuuuuuguaguguaucauuuugauuucccuuucuuucacuguauauuuuuaauguauuuucuuagugguuaccuuggcgauuccaauuaauaucuuaaacuuauaaaccuaguuugaauauaucaauuuaguuucaagaguauacagauacuuugcuugugcacaucuccauuccucccccguaauauuauaauugucacaaauuacaccuuuauacuuuccaguaacauauuauaauuauugcuuuaugaacuuguuuauuaaaccauaugggaaaaacagaaguuacaaaccauaugaaaaguaugaaaacaguggauuuauauuuagcuuuauagauaccuuuaucagugguuuuaaaaauuuuuuucacaguuuuaaguuacugucuaguguccuuucauugcagcccaaaugucuuucacauuuuuuguagggcacuguacugacaaaaaaaaaaacugugucagcuauuguuuaacuagaaauaucuuaauuucugcuugcuuaaaaaaaauaauaaugaugauaauaauaauaauaaugaugaugaugaugaugaugaugaugaugaugaugaugcuugaaagauaguuuugcuggguauaaaauucuugauugacaguuuuuuuuuuucuucuccuuucccacugcuaucccacugcuuucuagucuccauaguuucugagaagaaaucugcuguuuaucuuacugaggcuccauuguacaugaagagucacuucugucacuguuuucaaaauucuuucuauuucuuuagguucugacaauuugacuguaauguuucuuguguggagcucuuugaguuuaucugcugguaguuuauugagcuucuaggauguguguauugauguauuuuggaaguauuuuuccauuaagacuucaaauacuuuucugucauauuuccuucugggacaccuauauguguauauuaguauguuugaugauauccuacuggugccucaggcucuguucauuuuacuucauuuguuuuucugcuucucauauugaagauaagacagccucacuguucuuaucuucagguucacugaaccuuucuaacuccuccucauaucugcuuuugagccccucuauugaguuuuucuuacuucaguuagucugcuuuuuagcuccagaauauguuugguuccguuucauaauuucugucuuccuacugauauucucauuuuuuucauacacuguuuugcuaauuuuuuuguugaugguuuucuuuagcucauucaacauauuuaagacaguagauaguugauuuaacaccuucaacuaauaacuacaaugggcuuuaacgggagaguuucugucaaaucuuuuuuguuguuucuuuauuuucauuauguuauuuuuugguuuuugagaacuguauuuuguaucuuauuuuuauuuauucauuuguuuugaggcaguguuucacucuguugcccagacugacgugcagggcaugaucauggcucacugcagcuucaaccuccuggaugccaccaugcccagcuauuuuuuuuuuuauuuuucauagauaugaggucucauuauguugcccaggcuggucuugaauuccugggcucaaggaauccuccugccuccaccucccaaaguggagagauuacauaugugggcuaccaugcccggugagaacuagaccuuuuaaacauuauguugugguagaucuggaaauguaauccuuccacucuccagggauugcugaaucuuacuuguugaggguuaaagugaugaucuguuugugacuuuuguaaacuguuuuugcaagguguguaguuuuuguuauaauguggucacugaaguuucuucuguuuccucuguggucagcuauugaccugauaaagauugcuuucaauaucuggccucaaaaaggagaaagaaaaacaaacacacacacauugucuuuauauaauaaauuccuuggaaguuucuuagguccguggguauugaaguagguggccagcuuuuguauugguuucucaguaaucaaaagcaacaaugagaucaugcaauccaguauuuggaagacuaguuccuuuuuguguacccuggcuccaggaagccacacuaggaaugcaggaggcugucuccaggcugcuucuuggagcuguugggauuguggcuguggaaugagugauagcugcuaccaugaaagauggcaauuccaugacauuugucacccucuuuuaccauacgccagaguuccaaaauagucacuucagaucauuucugucaauugcaucuuuagaugcuaucuucuuggccuuuuuuuucccuccuuacaagcaggauaccugaaaugccgaaacguaauguauauauuuuugcagucauuuagaaagcaugagggacugguaauuuaauucagaaagccuauucaaaaacccaugucuauuugacuaauccagaaauucuggaaagaaauauaccugcuaucacaucugguuaagaccuugguuguguucuguacaaguugcaaacccacaggcuccuuucccaccauuuagcggaaccugaguugagucacgugccuuggcuacugaagaaaccaccaaucagguuuuaguuuuauccauguguggguguuaguaauauccaauuaguagaaaaagagugucuuaauacugagggaccagucggaaagcugucugacagggagaaagucucauauaaaaacagacaguagcuuccuguuauaucacauucccacucagcagagaagcuguaaguggacucagggucauuccccagcucaagaaauaaauauuccacaucuugaguauuaauguguuuuguuuguauuuuucagaaacuauguauucuuuuaagucuuauuaaagucaagaugaaauauguaaaaagccauuguuuuuauuuuauuuuauccaacuguauaauuauuguauguuuauauuguacauauuagagcauaugaauaaugcuuauuaacucugggacuuugcuauauuaagaaacuguuucuguuauccguauuuggcugucauguuuuaguuuacuguauguaggcuggauuuauuuucuuuuaacaugucuuaauauuggguuuuguuucaguucccuugaguaaacguguaacuguugaccuguuuauucauguuguguuuuaaaaucguccccugaaaauacaguaugcaaauuauauacuauauuuagaucggagggcuuuuuucuccaguaaaauuuggauucaccuuuauagacuuggccaggaaguauauauucugaaccagggaaagaaaugcuaaaaaccaaauugacaaaguagacagauggaagaccaacaacaucugcauuaagaaguugaguaaaugggagauuuaauaauccacauaaaucaacuauaucaaauaagcugaggagggaguacgaguugauuguuguagcuuuacagaaaauuauuuacuugcuuugaugaaacccauuguuuuuucauguguguauagauaacauaugauauucaagauuuuaccuuaacauaaaguucugcauuuuacaggauuuugguuuaauauauagagauauauuucuuauugcagaauauuucauuuuacuguaguauaguuugccucuaauucaaguguaguagaauauacaguugaaugggaaaauauuuacaaguauuauucuuuugauucauaagaaagaacuugagugcaaacugacauuauucuuauuuuacugaagaagaaacuaagggacaugggauaaauagcuagccuaaggucaugcagaauaaaaagugguggaaccaggauucagacucacaucugucuauaugacuccagggcuuauucccuuaaugaccaagccccauucucuaggauaacuauucucaaagcucucaguccaaaggccuucgguaaaccuuacaaggguccacagggucaaaaccuuuuucguaaugacaucaaagcauuauuugccuuuuuuauuguauugacauuugcccugacauuacaaaaacaauggaaguuuuuggcucuuuagcauagaucaaaguaguggcaccaaauucuccaaggaguaauuguauucaucauugcuguauacuccugaguuuguuuguuuguuuuuuaagccaguuucacuuaagaauguucucgaugaaaugguaaaaguuauuaauuguauuaaaucugacccuugaaucacaucuuuugaauauucuaugugacuaaauagaaguaugcauagagcacuuaugcuguauaccaaagugcugugguuuucugaaggagaaauuguguccuuaugugaguugucugcagaacuagacucuugauuuaauaaaauaccacuuuacuuuaaacaaaugacugagagacacauuuugguuauauacacuuggguguuugacagacaacgugagcuugucacuucaaggaauuuaagugacaggauuuuuuuuuuuugaccaaugauaauauuugagcugucaagaggaaguuagaauuuuagaaaacuugauucugccaucaugagcuuaacagcuucccuguacuuaaaagacuuuuaugguaagauaggugguaauauuaacgagugugauguuuuaaaauaguauaaugaaacacgucaacauuuggaagaucuucauuacucaggaaaucaauauuuucccaaggaccaauacgugguguuacaaaaucccaucaaaauauaagauggauuuucuuuuuuuguuuuuuugagacggaguuucacuccuguugcccaggaugaagugcaguggcgugaucucagcuaacugcaacuucugccucccggguucaagugauucccgugccucacccucccgaguagcugggauuacaggugcacaccaccaugcccagcuaauuuuguauuuuuaguagagucgggguuucuccguguuggucagacuggucuugagcuccugaccucaggugaucugcccgccucggccucccaaagugcugggauuaccggcgugagccacugugccuagccauaagauggauuuuccuauaacauugugugaaaaguucauuaauaugguuucagauuccauauugcaaaaaaccuucaagaaauuacugcuuauauaauuuuuauguaguaucaaagaaauuacaaaauaauuacaauuauuugaaaagccuauuaaauuaccucucccuuuuccaccuguuuauguguaugaagccagguuuucuuuauauaguucaaguuaagcaguauauggcaauggauuaaauucaaagcugauaccaguuuuauuuuuuuaagguagacauuaaagagauuugcaaaauguaaaauagugcuacucuucucacuuauuuuuguuuuggaaaauaugguuacuuuguuauagaaauguuaguaauuuuuaaaugaaauuggguuaauguuaucuuaauaaauaccaguuucauuuuaauauguaaacuauauauauacauacauauauguguauauauauguacaugucuaucucucuauagauauauauauaucuagauauauauaucuagauauauauauaucuauagagagauagacauguacauauauauacacauauauacacacguauauacauauauauacguguauauauauagauauauuuauaucuagauauagauauauauaucuagauauauauaucuagagauagauauauauacguguguauauauaucuagauauauauacguguauauauauagauagauagauagauauguauugcccauguaaacaaaugcucuuuggaguucauuuuuuaaagaguauaaaagggucccaagaacagaauguuucagaauugcuguucuaggaaaacguauuaagacaauaaaguacaugugaggaaaaagaaauugaaauugcauucugugguuuacaccugauagacaaaagagcaauuuauuuggucaacauaguucuuaaucagguaucauauauacuuacugaauucauugugucuuucucaaaccauuuguaccuaagacauuuauugguacaguauugcuauuuuucuaauacuaacaugaugcuaacaugagcauuuacuugaggauuauagaccuuuauaaacugugcuaaaaggcuuucagaaguaugaaaacuauaaaaguuugcuaguugagcacccacuuacugccuuagucucuuccuuuuuaacuggacucuuaguggauuccgugggcuuacuucacugaugagaauuuaguauauaugucauuuccugggaccuguggacaguucauuuaauuaaguauaaauguugaugaacgcaguucuauucuuaggccuuccaguguuuggugaauagccacuaaagcuaaaaauaucugaacguauauuuuucuucauguuucucuucaggaugacguagcuuugccaaagacuuagaagcuaagcagaaaaugagcuuaacauccugguuuuuggugagcaguggaggcacucgccacaggcugccacgagaaaugauuuuuguuggaagagaugacugugagcucauguugcagguaauugugucaagcuucucuauauguguuuauucaaaacuugaaauuaguguaaaaucuuuuucuacuccuuuagaaaacagugcuauuuagauuugaacuuucucuccuuuuagcuccagcuaucauucuaauuaauuuuuugcccccuugaaucaucuaaaaaaaguucuaagucuugaagauucaauuuagaaaaauaaauucucagaauaaagaaguuuauuaguaagcagaaaguuucacauuauaugcuuuuaaaauaagacauugcaaaaaucagcauagcauggaguaaaacugaauuuugaucacugauacuucagugauaauggaaguuaguuucaucacuuuuagagauguucauuaugauaccugccaggaguucaagcauaagugaagauuguugacaauuuuuaaaaguaaauuuuauuguguauauuuaagguauacaacgugauguuaugugauacacacagauaguauaaaaguuacuguaaguuacuccaaguaaaauggauccucaagagugcacagccucaggaagagggucucuauagggguaagaaucagauggaggaggcauagauucuuacagggaaaacacuauaaaacaaguucauccaaccugaggcccaggacggcuuugaaugcggcccagcacaaauucauaaacuugcuuaaaauaucaugagguguuuuuuuugcaauuuuuuuuuuuuuuaguucaucagcuguuguuaguguauuuuaugugugacccaagacaauucuucuuccaguguggcccggggaagccgaaagauuggacacccuugcuauaaaaggacagggacuggagucuuucauucuuaccagaaguuuaaguaacaggaaaaaaagggccuggucaaaauugccuaucuuugcaguuuuaagcucagaucagcuaagguuuucccauuaguaucagaaacgugauuaaguuagcagucuuuguuaggauuuaaauuauguauuucugagagauuuuuauuaaauuuucauugaaauauccaaauggguugugaauaucaaguugucaugcaccuucugguucaguuuaaucuagaggaaaugugaauuugauuauauagaaaugaaaacaguuuaaugcuuaagugguuagauauccauuacauauucuuccuauucccucaguuuuccuugacucggucacuagauguauuauguucuguaaucuuggucuucugcuuaauuccugucaugggugcugaaacacauugauacuuuauauacauuucauaauaacuaaaaacauaggaauuuuuuuuucauuggcugcuuuuuuaaaaaaauaguuacacaaaugggauugucuuauucugugaguacuaaacugaucuucuuugccuugaguuccugacuacucuucuugaauuguuacugucuuuauuaaacaaacaaacgauguauucuugugaucccacauaacaggcccacuccucacucccuaauccccagaguuguaauggcaucucacucgacucaguggacucuguuguucucuuaggucuuaagugugcucugucuuuugcuguagguguuuauguaccgucaguguucaccauaagcaguuggagggcgggguacauuguagauuaaggauauuccagauuucaaacaaguuguucacuuagugaagcagccuguccuaaauuacuuccuccccaaaucacuuuuucucaauaucccucaucuguguuuaucacacuccuucgaaagccaccauucucuggcuccaugaguagccauuugacuccuuuaguccuauaucuaaugguaacauuucacuuugcuuuggaauuugccuuuucucaacucuaauuuagauuuuuuucuuugaauuucaguccauuguccaaaggauuucugcccuuuuccuauguacucuuuuccucagagagagauuauuuaugaggauccauucaguauuuauugagagccuacauguacuugaaaucucacuucucuuaacaacauuuggagguuuuauccuuagacuagaucaacuugauacaucaacaauauggugaaauuauuuugcugaguggugcguuguugcuucuugccaacuuaagaacugaauuuaguauuucauuaguuuaaccagaugaauaaaaauucaaaguaaugaaaacaaaaaugaauuuuaagcaauuuuuagauuuaaugcaggaguuuuuuuaaaucucaaguugguccacccucaagucucuagcaauuaaucacuucaccuuuaaguuguccuacugguugcuguuucuagcggaggcuucugcuccuggcaagcugugauucucucuguauuugcuugucucucuacuuuucagggugguaauuugccuugugaccucaggucucugaaaaacuaagaugaguuuuugguuuucaguuuguucaacauuuuucuuauuaugaagaugggagcgaugacuucagauucuuuccauguuggaccaaaaauuggaagucaugucuguuccccauuuuugauacucucuuugcuuuuaguauaccaggguucacacaguaaccccguaauacauggugaucaaguucagauucacugguucacagacuguuucuucugugacuauaaugauauuuccuuucaauaccaauuuccacaggcuuaucguucugcuuuugggugcuuccaucugcagacaacuuacuaagcucuggagagagacagagagagagaaaacuuuaaaagaaacuuaaaagcaauuuucaaaaaccacaguuugccauuaaaauaccuuucuuuugacuuucagucccuuucccucuuagagcugucccgugaauuccaguuuuagagcccauauuuuaaaugaagauaauuuuguucugaaacaugucauauugugucccuuuuccucuaaaucuuuggacucuuugaauaguuuaugcucauuuuuuguuuugaaagaagaaaauccuacaagguaaauguuuuuuacaauaagauauguaaaacaugguaaaauuauaauucacaugauuucucuauaacaguuuuaaauuuaaaaaaauuaaguuaauacauucagcgaagucagcugauguaaauucuuaauagaacaugugaauuuaguagaaaagaauaucuuuaaaauuuuauguuuuccucuuugggcagugaugcuaaaaagauuuuguuguauaguggcaccguuuuaaucucauuuaauccacacuuacuuugauauuucccuauauuuacuguccuauuaauauuagguaucuagccaaaaugugacugguauuuauucuaguauuuucuuauauuuauuaacugacaacauuccuuucagucucguaguguggauaagcaacacgcugucaucaacuaugaugcgucuacggaugagcauuuagugaaggauuugggcagccucaaugggguaagucaaugguuuauuuuuugucuuguuugaacauuuguuuaauauuguaagaauaaaaaucagauuacauuuccuagcuacauuuucuuuuucuuuacuuuguauguuauuuucaaaugcuuaucagguacauagcacuuuggggaccauccaauagaauaugaaacuagcccauauuccaaagaaacuauaagcagaugaauccagaaggugguugucauugucugugauggcuaaagaagacuucuuuaaggaguuggaaccuaagcuugacuucacuauauggcuguaauuuauaugagggaaaacgguaaaaagucauggcagugagaaugcaaaaaaguacucucagggacagagaaguaaugguuaaguuuagaaaauaaagauggagcuggggccgggcgcgguggcucacgccugucaucccagcccuuugggaggccgaggcgggcggaucacgaggucaggagauccagaccauccuggcuaacacggugaacccccucucuacuaaacaugcaaaaaauuagccgggugugguggcgggcuccuguagucccagcuacucgguagucugaggcaggagaauggcgugaacccgggaggcggagcuuguugugagccgagacagcgccacugcacuccagccugggcgacagaacaagcaagacugcgucucaaaaaaaagaaaagaaaagaaagauggaaaggugccagagaguagacaacuuucucugcuaggguaaaaaaggugaaacaacacaaccauuugccuucacaaauauagcacauuaucuaaccgccauuguucauuauucuuggaauucauacuuugaauauauuuuuguguuacugaagugaauuuuuucuuauuucuucauuuggucugucuacauuuggcauaauauaaguagcuacaaacuaaaaagagugcugaaguauugaauuauuucuuuuauuucaguuucuucauuugcuuaugguucugcuaacacaagcaaauacuguguuguuccuaucugugcugcugaaauucuuaaaaugaauuuaacagaaauaagugcaucccaacugcuucagacuauucaugcuuuucaaauguacaucaaacauuauguacaagaacaugcagaaauuuggcaaauaugguaauacauuuuuuuuaaccaauucugaauuggccugcuacugaaggacuuuuauauuuauucuuugagauaaauacaaauuuuuuguaggcauguuuuccuguugguuuuauucaagccuuuuuuuuucucuguugguuuuauucaagcauuuuuuuuucucaaagcauguagaauuaaguguauguucuucauguuugcccugaaaacucucacauuuagcauuauccaccuuuccagauugaugcuccaucauuacauuuucccuugcucuucuuccaaacaguagucuuccugcuaugcuaugucuuucuucaaauaauuuguuagauuuucuucagucuacucuuucucccaucugccuugccauuuauaaaaguuuuacacauuuuuuaaaauaaagcucaaauucuacuucuuuuugaagagaugaaacaaaggcccguuuacuuaggaauuuuaaccugcugauguugacauguugaaaggauuaaaauuagcagagauaggcaaaguagguagaaacuguuguaacauuaggcaugaauguuagcaauuuugauucucaacuccucuuugcuagaauuucucucuuccuucuccacacauaagccuuuguguccuugaucagccugguauuaaaucuacuuuuauaccucuguagcuaugcugacuuaugagcuccugaauaaguucaugugccuucugcuucugugaccacagugccuagcagagggcucugcacagugcaugaacccaguaaaucuuucuuuaguggaauugaauuaauuuucuacuugaagaauuuauagugaaaaauuuuaacuucuauauguggaacauuuugacaauguuauauugucuuuaagucuagaaaguuucaucuugacaacagaugaacagugguagucuguaugucuuuacauuguuauuuuggaaaauaagcagcgggaauuacaucagcauuuuagucuuuuaaaagccuaugcucaaauauggaaauuacuugguauugguuccaaaaauaaucaggugaaacaugacauuuuucuagguuggccuuucuuauaauuugauuauacucaauaauauugugaaagauacuaacucauggagagcgacaucugcauuuuaagcuugaaaucaggaccaggauuugaaacucagaucuguuauuuaucagcaguguaaccugggacaaaucacuuaaucucucugaaauucaguuuccucauauauacuaccuuccaaaguguguaaacauguaaugaguugaaguuuaugaaagcaaagaugcaaugcagaaucuugcuucagcuauuaaaugaugaaauaauuccugcucuguaguauuguuaugaggauuaaauguaacaguacauuugagugugcgcuuaguauagaacuuuaaagcauuacauaaaugauaaauauacuguuacccaaaugacagccuaagaaacaugccacaaaggucuuuagcagccaaaaaaugucaaaagucuaugaacuaccaacuaucaugcauuuuagucauaagagaacuuguagacuauuauucgcagccuauuuacucuuauuauccauauuauucuagaacuuuaaguaucagguuaaaaguaguacuuuuggagguaggaggacacaguguagugguuaugaacccagcuuugaugucaccuuggacaaauuaccuaaguucucuauuccucaauuuuuuaaaaaauagaaauaauaaaaugguacucacagguugugugagcguguuguauguguuguaaagauauaaauaagcuaauaauuuuaaacaacaguacauaguaagcauucaguaaauguaaguuauuuuuauuaugguaagaaaagcagcaaagacaaguuuagcaaccuguagccuauauacuuuucaaagaauucacuguuacuguuuagaaaaaucacuuaccaacuaaauucaacuuaaaagugaucauuuccacuccuguccccuuucacccuagcccagaauacacucccaagggaccuagaucuacaauuuacagaauugccaccagaaaugagguuguucugccugagaaagcuacagucgguuccguugcugauauuuuaacgggccauuuuccugcaaacccauugaagguucucuuucuuugggaaccccuguuugccuucaguucccccugccuccuccacuggggcccuugccccucugguagccaccauggccucugcccuaccccuccugugccauugcaagccugccauuuguuacuggacugcccccaucagcagucuguguuccagacacacuguguccccuuugcacacuagaguuccugccagcaucagaccugugugguauagaguagagaauggucuucacuaaagguugaaaggaaagguuagggaaggagaggaggcuuuuguagcuggcagagagauugaggugguugugcucuguucacuuucccagaucaucaauacaauguaugcuggcuauaugauuuuauacuaucaauugugucauguaguuguauguaaauuaaauagguauuuauuuaaguuugguuugcuucugugggguuagugguuugaauggaggaauuucgggagcugguuuagcuugggcaccuaaucuugauguggaacgcucauaggauuuguaguucagagaccugauuucgaaucccaacauugccacuucuggacuccaagaucuugaugauuacuucauucucuuugccucauuuuccucaccaccaggucucuaccugguguguugaaauggcacugacaaagaaacaaaacucauuuuuuuucccguaucuaaguuauuaaaauuugaucuaguuaaaugauuuuuccucuggcucuuugaaauuuucucuuucccauugguaauuuuagaccuucaggagacuauuuccucacagauguuuucacuugcauuuuuugugaacugaaauuuugugucuggcucauauuuccuaagccuuuuuagacuuuagggaauaguucugucauaaauggcagcauguuaaaauuauauguuucucgaucucugaaagugccuaguacacauguucaacacacaacaggugcuuaauauuuaagagaguuaugcaaucuuaaacuuaaauggaucuucuaggucaucacaggccuuuugaguaaaugugguguuuuagguuauuagagacaaguuucaaauaaaauuggcucagaauuucagaacuguagcacuccucuucaauacuguaucuaguuaucuuuugccuaccagacauuaguaaauuaacauuuucuuucauucuuuugcaucauuuuccucaguucuucuguuuuguaauuagagucaugcaucccauaacggcagaccacauacacggcagugguaccauaagauuauaauggagcugaagaauuccuaucuguguuacaauugcauacaauauucaguauaguaacaggcuguauagauuuguagccuaggagcaauaggauauacaauacagccuggguguguaguaggcuauacuaucuagguuuguguaaguacuguaaacucuauaauguucauacagugaaguaaaucgcuuagugauguguuucucagaauguugccccauuguuaagcaaugcaugacuguauccuccgaauacuuuaguaaacucaagacauaaguuuuaaaacacugaagucuucauuuuggaaaugaaccugaaguuagaguuuauaagucucugaagccuuugaauuuucuuuguauuacaauuucaaccuuucuuuaaaacauguuggaagcuugugauuuaggauuacucauaaaucauucuaggauauaaucuagagucuuaaugguauuccccuaucucuauauauaugcuugaaacuaagauuguaacuuuuucugauuucuuuuguagacuuaaaacuuauuuuauggcauauuacaaagagcuauuuaugcauagaaauaugagaguuuaauaaccuaaucccuuuaaguauuuuacuguaacuaccucaucauggaagggcagucuucucaaauaagcuaucauggccaucucaaaucuaauaaaauagaagaugauaaaagcaaaaaaccaaacaccagauguucucacuuauagguuggaauugaacaaugagaacacauggacacaggaaggggaacaucacacucuggggccuguuguggggucggggggaggggggcagggauagcauuaggagauauaccuaaugcuaaaugacgaguuaaugggugcagcacaccagcauggcacauguauacauauguaacuaaccugcacauugugcacauguacccuaaaacuuaaaguauaauaauaauaaaauuuaaaaaaggaaagaauaaaguaauuuuuuaaauuucaguuuaucaaagaaaaacuuguuggguguuuauuugaugucugcauaggcaguuaaccauaaccuuuguucuguguucuauaaauuuagcaaauucuaggcccuuaacucucaguaugccaguaaagauagucaucaccauuuaccaucuguaucuaguaucaggggaaccuacccccgauaauucaacguuauuucacauagguucuuuuguauuucccuaagugucagcuggucugagaaauaaagggaaagaguacaaaagagagaaauuuuaaagcuggguauccaggggagacaucacgucagcagguuccgugaugccccgcaagcugcaaaaccagcaaguuuuuauuagugaucuucagaaggggagggaguguaugaauagggugugggucacagagaugacaugcuucacaagguaauaaaauaucacaaggcaaauggaggcagggcgagaucacaggacccaggugaaauuaaaaaugcuaaugaaguaucaugucccacugggcacgcauugucauugauaacaucuuaucaggagacaggguuugagagcagacaaccagucugaccaaaauuuauuaggugggaauuuccucguccuaauaagccugggagugcuacgggagacuggggcuuauuucaucccuuaucuccaaccguaaaagacagacauucccagaguggccauuucagagaccucccacuaggaacgcauucucuuucucagggcuguuccuugcugagaaaaggaauucagcgauauuucuccuauucgcuuuugaaagaagagaaauauggcucuguucugccuggcucucaggcagccagaccuaaugguuaucucccuuguucccugaacaucgcuguuauccuguucuuuuuucaaggugcccagauuucauauuguuuaaacaauuugugcaguuaacacaaucaucacaggguccugaggcgacauacauccucagcuuacgaagaugacgggauuaagagauuaaagacaggcauaggaaaucacaagaguauugacuggggaagugauaaaauguccaugaaaucuucacaauuuauguucagagauuucaguaaagacaggcauaagaaauuauaaaaguauuaauuuggggaacuaauaaauguccaugaaaucuucacaauuuauguucuucugccauggcuucagcuggucccuccauucagggucacugacuuccggcaauaauccaguggacccuuuuuuaaaaaaaauauuguacaaauaauuuacaaaaguaaaaauaaaaggguaauuaaaacaacuugaaauuuuaauaaaaaauuagacaugacaaacucaaauuuuuauuccauauuuuccugguguuuaaagguauauacuacccaaaaugggcaguguuguuugaaugcaacuaacugcucaucaguugacauguauucaccuggaacauauauccaucuuauaaauguugauuccagaucucaaguacuguaugucuuuaguuaauucuaguguauuauuucuggugcuucuuguucuugcauggucaaaacacaguguuuuaaaaauuuuggcugggcgcaguagcucaccccuguaaucuuagcccuuugggaggcugaggcaggugaaucaccuaaggucaggaguucaagaccagcuuggcuaaccuggugaaaccccaucgcuacuaaaaauacaaaaauuagccaggcguggcggcaggugccuguaaucccagcuacuugagaggcugaggcaggagaaucgcuugaaccugggaggcagaaguuguagugagcugagaucacgccauuacacuccagccugggcaacaagagcaagacuccaucucaaaaaaaaaaaaaaaaaaaaaacuuuacagcuuauaauuuuguuaauaggauagccaucuuuuuuccuccauaaagugcaaaacacuuauuauuuuuagauuuauaaacaacaauuagaagcucaauccaauaauuuuaugucuacaucaucucuuccagucaccuuuguauagauacuuguguugagaauauguccacuuacauacuauaucaaauaaguauuggaacacagaugugaaaaaagaaggcugucaauauuucuuuuaaaauaugacacuucuuuuaaaaugaggcuggcgaugguggcuuacaccuguaaucccagcacuuugggaggccaaugcaggaggauugcuugaggccaggaauucaagaccagccugggugacauagugagaccccaucuacaaaaaauuuaaaaauuagcagggugugguggcacaagccucuagucccagcuacugaggaggcugaggugggagaaucaccugagccugggaggucgaggcuucagaaugagaugugguccaugccacugcacuccaucuugggugacagagcgagacccugucucagaaccccaaaaacaaaacccccacaaaacccaaaaucauucagauucuuuuugaaaaauacuacgugauucuuacugaaugacuaacuagaugaaaauuucuuuuuuuuucauggacacauucuuucucauugauucuugcauuagagaaaaugugucuaugacugucuucauuugaagacacagagucugauaauuuugcuuaugcuaucagcuuuaucaacauuaucauaguguagaaucccacugucucuuguauuuaucuuauaauuaugaaauaucuuccuguuuucuucucuuugccuuuaugaauguuaaaucagaaauucuggauuuucaacugugcucuuuaauaggugaaaaaagaaaccccaaaauguauaaagauuuuaucuccagaugucuuuuauaccuucuuggaaagaugaggaauauuuuggccacugcaguaagauaacuaaagaaugaugaaauagugauuuauuucacuauugcaucaugcucguaggucugugcuuuucacuacaguagccacuaaccaugugugccuguugagcccuugaaauguggaguagucuaaauuuuaaagacauaguaccaaaaaaagaaaaaaaaaagaauaugaaauaccuuguuaguuuuuauauugguacuuuacugaaacgguacuauuuuggauauaucaggugaaauguauaauauuaaaacuaaucucaccucuaucuuguuuccuuuuuuaugugcccacuagaaaauauaauuuggccaggcaugguggcucacaccuauaaucccaggauuuugggaggccaaagugggcauaucauuugagcccaggaguuugcgaucagccugggcaacauagggagaccuugucucuacaaaaaauacacaaaaauuagcugggcaugguagcaugcaccuguaguccagcuacucaggaggcugagguaggaaaaucaccugagcccaggaaaucaaggcugcagugcaccaugaucgcaccaccgcgacccugaaagaaagagagagagagagaagaaagaaaauauaauaguaaauguggcuuacaauauuuuuuuguugguuauugcuucuguuauucuuuugucuuauuauuuggaucacuuuuagcguuguuuggaauaauugaugaguaaauauuaaauaguugcuaggaugauaaaauggcagaauuucaacauaucagaaaaauaagaucacugaaaccuuauaauguaugugauuccuaaagggauccaaaggacccauaugacaacugcaaaauaaauugaguuuuauucuauuuucuuaaaguaaauuuucuucuucuucuuuauaauaauuccaaaaauaaaaguaaugaaaugucaaugcuuacacauagacagaauuucucaaaaagcuaaaauuggguugagcaaacccugaugguauauuaacaguuaaauauuuuacccuuugcgguuugccagcuuuagauuaggagcuuuucuuggcaccauuuuuaggaacuauucuaagugccuaaauucaucuuggcagcacuggguucuuuguguguuaccaguaagagagauaaaaggcuuaguauaaaaucauuuaucagccuacaggcugcauggcacaucuuaugauacucaggcuguauuagccaccguaugauaugugcuuuuaacucucagauuugagaauuugcuuaucugaaauguaagaauuaauaccucauacguaaccuaacaucuuuuuuuguuuccuuguagacuuuugugaaugauguaaggauuccggaacagacuuauaucaccuugaaacuugaagauaagcugagauuuggauaugauauccuuaaaugguuuuauguacuuauuaaauuuauucaaauauguuuacucugguuuaaguuaacauuuuuaaaacacaauucacaauauagauaugccagaauuucuauuuauugggugcauuccuauacuaaaauacauauauauuuuuaguuauuaugccuguuccuaaaaguaaucauggaaaaguugguggacucagcuuuuuuuuucccucucucucucuauuuauguaguuucagcaucagucucacugaagugcuauugcauauauaauuugagcaucaaagaauguaacuggggagaggacaggggaauguuuaauuuuaguccagccuagggauugcuuucagguggaacaugaugcaugaaucagccuccugggaugaauguaagaauuuaaaccuacuuuuccuuccaucccucccguuaacuguuuuaugcaucacagcuauauugccuauuaaauucaaacuuuucaauauccugugucuucuaagaccuacgcucucugauuaauccacauuaugcauuuaguguguauuuaaaauucuuauguuuaaaauuaggaaucuaauaauugaacaaggacaugacuguauuaaacugcauggggcagcgugaagaaucucuagugaagggaaggagcaugauugcagaagaagaaagacauuuccauucauaguaggcaagaagcuuuguaaaaaggauuuauguacauuuaauuaaaauacagcuauuccacauaaugcugaagguuguuuuuuuuuuuuuugaguuuuaguuuuuuugaauuacuacuuuuauugggacuuugguaauaaagaauguauuaagcauagcaauuuggauggacuuuugucaccguagcagaaaaagcauagucucagcuaaauagaguagaugcuuaaaguaaauguauuaacacuauaaaauuguuccuugacauuuacgagaaauaguccaggugcuguggcucacaccuguaaucccagcacuucgggaggcugaggugggcaggucacgaggucaggaguucgagaccagccugaccaauguggugaaaccccgucucuacuaaaaauacaaaaaaauguuuuaaauaaccagucaugguggcacgcaucuguaaucccagcuacuccagaggcugaggcaggagaaucgcuugaacccaggaggcagagguugcagugagccaagaucacacuacugcacuguagccuggcaacagagagagacuccaucucaaaaaaaaaaaaaaaaaaaaaaaaauuacgaaaaauaauauuacaauuuuuuaaauuuuaaaucuaaaauuaaaguuuuguagcauacuuuauaauguucacacuugcagagccaaaggaauauacaaaaagccaaaccauuaaauaguaauacuuguauauauuuuaagucuuuaaaaaaaaugcuucaugcaaaauaauuaagaauuagcauuaaagccuuaaugaaugggugucauuuucuaccagccuaaguuucaucaagaacaaauacaaguauauuuugaauuuagauaccuccuuuaauccauuuggcaucaacuguuucaaaucaugagaaaaauacuaggaaauuuaaguuuuaguaaaacucugucaaguuaacuuugaauuuuauaucaagaagaaacuauugagaaaaaaaccucaugcuuuuacacaauaguauacuauuuucuuaacagcaaacagacauuuuucucuuacguaccagcucauaauaugucugucuaaaauuguugggacggauguuuugucccaaagacuuucucagaguugugcacuuaguguugagccauaacuacugucuggaugcccagaggaggcacauauaauuuuauuauuuuaaaauagcaucuguuagccagccacgguggcucaugccuguaaucccagcacguggggaggcugaggcaggcggaucaugaggucaggagauugagaccauccuggcuaacacagugaaaccccaucucuacuaaaaauacaaaaaaauuagccaggcaugguggcgggcgccuguacucccagcaacucaggaggcuccuaccucccaccucaguaggagaauggugugaacccgggaggcggagcuugcagugagccgagaucgugccacuguacuccagccugggcaacagagccagacuccgucucaaaaaaaaaaaaccaucuguuauaguggcagaaauuauauuauauacguaauuuuaaaagcagguuuuauauauuuacuuguuucuguauuuagcuaugcuagauugaagacauuuuuguacuuuauucuaauuaaaauuaaucuuaauaggcagucuauaaacugcuauacuuuggagaggaaaacuauuuugauuaaaaagcuacagcaggcugggcgcaguggcucacaccuguaaucccagcacuuugggaggccaaagugggcagaucaguugaggucaggaguucaagaccagccuggccaacauggcgaaaucucaucucuaccaaaaaauacaaaaacuagccuggcaugguggcagguacauguaaucccagcuacucaggaggcugaggcagggagaauuguuugaaccugggaggcggagguugcagugagccaagaucgugccacugcacuccagccugggugacagagcaagacuccgucuaaaauaaauaaauaaaugaaauaaaauaaaaugcuacaucaauagaaggagcaauuuaacauggaucaagacuagaauuaggcaacauaagucuuuuuuguaacuggagaaauaagugauuuggaaaagcacauacucagugaaauauacaagcuuuuaaaaugaccguaaacucauaaggaguacuaaaaugcugcaguaaucaagaaaaacuucaaaaagugguaauaaaucuucagguagccaaaaaugaggcugauaaggaaaaguuuauucauuuccuaauuauuuauuaaaugucuccuaugugccaggcauagucccagugguuugggaaauauaacugugaauaaaauagaucauaaucacuguucuccuguagccuacacuuuagugggguugaagggacugacagcacacacuagaagugaggguauuagaggaugguaaguucuauggaaaaaagugaaagugggaggcagagagcuaguguugguaagugggaaguuagaguuuuaaaaagaauauucacgaagaccucaaugagaagccagcacuggggcaaagauguggagaaaguaaagaaguuagccauauggauauauggagauauuguccugcagacagaugaggguauaguacaaaggacuugaagcagagacauguuugacauauuggaggaauagcauuuaaaagccagugugguuggagccagcaaagaacaugaguauauuaggagucagaauauaucaguucucguaggacauuauaaggauuuugacuuuuauucugagugaaauggguagucuuuggaggcguuuuuguuuuuguuuuuuuuuaaucggagugauaaaugacauacaucuaaaaagauccucuggcuacucuuguucaaagaaaacuaaggguggagugggcagggguaugaaaagagagaccaguuaggaggcuauugcaguaguucaggugaacgguaaaggagguuuggaccagggugauauaucuggaaguagaaaugaaaggauucuguguauauuuugaagauguagccaauaaaguuuucugauuagacuggauguagaguaagagaaagagucaaggaugaaccagaauuuaggccugagcaauaugaaaaaggaaggcauccuuuuaauaacugauagagaauucuguagguagagcaaguuuuguggagaaaaugggaagaaucaucucaaaauacuagcuuuagacuuaaccaaguuuucacauuuuucuguuuucuauuugauuucuguuaccuuuauucuaaacuuuuuucuagguaggagcugaggucauucaguugagaccuuucuuuucuaauacugguguuuagagcuauaaauuuucccccaauuacuacuuuaauguuucuaauuuccuuuuuuauuuucuucuuugagucacagauuauaaguuuguuuaguuuccagauauuuggggaguuuuccagauauauuucuguuacugauuucuaauuccauuuugcucagagaacauacuuuguaugucucaaauccuuuucaauuuauugagacuuguucuguggcccagaauauguucuaucuugguaaauguuccauauguaccuaaaaaggauaugcguucugcuauuuggggguuggaauguucuauaaauguuaguuaggccagguuggcuugguggguguucaggucugcuguauuuuacugauuuauugucuucuuacucuuucaauuauuaagaaagggguauugaaaucucaggcuauaauuauggguucgcccccuccuccuugcagaacuuuuugcuuugucauuugcagcucuuuuauuaguugcauagacaaccuggauuauuaugcuaucuugaugaauuaucccccucuaucauuaugcaaugaccugcuuuauccauaauaagauucuuugcucugaaaucuaguuugucuuaauauuauaguuguuccagcuuucuguugucuacuuauauuuuuaauuuuuacccuguuugucuuuaccuguaaaguaggcagcauauaguuguucuuacuuuuuuaucugauacgauaauuuuuacuuuuauuuggugauguaggccauucacauuuauugugauaauugaugugguuaguuuuaaaucuaucaucuugaaauuuguguccuguuugacccauuaguuuuauguuuucucuuucccuguuucugauuucauuugaguuaucugaauaguuuuuauuauuucauuuuaucuccuuuguuggcuuauuugccguaauuuuuuguuguuguuuuagugguaccuuuaggacuuauaauuugucuuuaauuucaaguuuuaucuucaaguaacauuauaccacuuuacauauuguacaagaacauuacaacaguauacuuucgucuugaccuuugugcuaugaugucauguauuuuauuuuuaugugugucacaaaccccauacuacauuguuauuaguaaaaagucaauugucauuuaaagagguuuaaauaauuuuuaaaaucuuaaaauacauauuuuaaaauacauauuuuuauacccauuguacuuaugucugaaacccacgaaccuuccauuucugguauucuucaucccuuuguacagauccauauuuucacauaaugucaguuuguuucuaccugauggacuuccuucaacauuucuuguacuauggcuuugcuggugaugaauucugucagcuuuuauaugucuagaaaaguauuucaucuuaguuauugaaagauaauauuggccgggcaugguggcccacgccuauaaucccagcacuuugggaggcugaaggcaagcggaucaugaaguugggaguuugagaucagccucgcaaacauggggaaacccugucucuauuaaaaauacaaaaauuagcugggcgugguggcacacaccuguaaucccagcuacuccggaugcugaggcaggagaaucucuugaacccagaaggcggagguugcaaugagccaagaucguaccucugcacuccagccugggcaaaagagagacuccaucucaaaaaagaaaaaaaguuacuguugcuggggauagaauucgaaauuggcuuuuucuuauuuuuagcacuuuaaagauguugcuccacuguauucucacauuauuuuccuuugucccuggcuuugaacuguuugauuaugaugugucuugguguagcuuucuucuucuuucuuuuuucuuccuucuuucuucuuucuuuuuucuuccuucuuucuucuucuuucuuuuuguuuguuguuuuuuuguuccucccuugggguuuguugaccuucuaaaauccuguggcuuuauaguuucaauccaauuuggaaaaaaucuccauuauuuauuuuaaaauuuguuuaucucuucuggguugauuuccauugauuaauuuuuacacucauaguaauuuuuuauuagauggcaggcauugugaauuuuacuuugcugaguguuaugcauauuuuaguauuuauauaaguauuuuugagcauucuucuggaauacaaguuacuuggaaacaguuuuaucacuuugagucuuuccuuuaagauuuguuaggcuucuaagauuguucugggcuaauuauucccaacuacugaggcaagaccuuucuguauguucuacuguggggggucaguaaacucauugaccaaaucugguccucaggcuguuuuguuggaacaucgcuaugcccaaucuauuaacauauuucuguggccacuuuugcucuaccgcugcagaguugaguagcugaagcagagaucacguggccugaaaaaccugaaagauuuacuaucuggcccuuuacagaaaaaguuugcugacuugugcucuacccagugacucaugaaucaugcaugagguuuuacagucuagcuguugagaguagguacuauuccuggcccuaugugugggcacuggguacuauuaucucuaauauuuuccagagacugaaaaucucuggaauucucuuucugugcaggcuugucuucaguacucaguccugggaauuccaguaauguugauuugcuuggacucuugacuucauuuccaucacaacucagggagucugccaggcucugucuggauuauucuuccucacagugugaccuagaaacuuucacagggcagugaguuggggcagugauuggacucuugcuuuguugcccuucucugggagaucauugucuuuuguugccugaugccaauugucuuguaaaacauuguaucauguguuuuacccaucuuuuaguuguuuaauguaggagaauaaauccaauucuuuuuacuccaucuuauccagaagauugagaaguugauuuggggcauguugaauguaaaguugaauccaggggugaaguagaagcuaaagauaugaauguggggauuuuuauuauauaaauaauauuuaaaaccauaagacugaaugagaucauuaagggaaugaauauagauugauaagagguucaaggacugacaccugguacauuccaauauuaagagaugggugagauuaggaaccaguaaaagagacuaaggagaaaccacuaaugugcuaggaggaaaagcagaguauaguaugguuuccacauuuugugggaaauuauuuacacauuacuuaaauaucuugaaucacaagauccacccgccaaucauuuuaaucauguaagucaucauaaguaagaacccaguaccuucuauuuuaaaauugugauuuauguauuuucccaaagaaguuguauauuccugcauaauggcccacaaaaugauuggguuagucauauuagaaaccagguuaaagaaaacuccaauacaucauaucauagcaucuaaaacuauaauuaaucuguacuuccagcacuauauauaccacuguuugguaggcugucaagauaacggcugcugaaugaucaaggggaaguuaaauguaagcaaaaauuaagaacuuucauucagagaaguuaagauuuuuccuuaucuaugugguugauauccauaacaaaacaugagcauauuaauauuuuucaaauuucaaaaauagaggacauuucucaaagcuuaaaagaacuaaauuuuaaaaauuaauggaaaugagcuuuuuuggaugaaaaaaugaagugauagagaaguuuaaaucaguuguuugaaaacuauguuuuuaaagaacaggaucuucuacaaguuggaaagauaaucaucuccuaaaauaaaaugauaccuuuuuuugaagguauaggcaaaauuaagcagauagauaaaauuuuccccuuagaaaguuuccugcuguuaacuuucuuuuaaacccuuauugucuccuaggaccuaccuuacuaauucucuguggacucuaauuuaucauaauuguauguuuuauuaucaauuguuguuaaaugagggaaaauuuccauauuuguaaugaaaaggaaacauuuuuggguaaccuuaagaauuucuagggauagccuuauuauauguuuuuuuaaaucacauguaugaaauauauuaauuuugaaaaauauguuuuucugaucuuuccuuguaugaaauaauuuuauucagguuuucuuaauuaucugacaugauuuuugaaagauauguuuacagugauaucugacacuucauauuuuaggucauaccccuuggaauaacuaacgcuguuuaaaguuucgcucuguuuuuuauuuugucauuaaaauaaaagagugggaggaaccguaucuaagaacacauuacuaguauucaggggaguuuccacaguccuacuuuuagauaaacauuucuugaauaaauugacuuaggucaguacagggggauggcuuagaauagcaaucauaguuuuauauaaagaaguggagaaauaaccugucaaauuaugauuuuuuaauaagcaagaauucaaacuuuuuauaacuuacugauaucaugcguuauucuaccucuguuugucauuuuucuugauuagcaaguuaaaaauagcuacauaggccugcaccacuaagaagaugguagccuuggagggaaaagcuggggcuagagcagucuccagaucucacaguuacaccagaguucccagaugaauuaaugacccaaacaagaggcuucuugaggucuucuucguuuccacacacacaaacauuuuuggaagguaaaauguuugaaccugagaaggauggcuccucucaagcucuccaugaccugaagagugucuagguuuaaagaggauaccccagacgagcccugggaaguugccuucaggcacucccaggagguaagcuugaagcacccgaaaacccucacaacaggcugaaaucacuuguguuuuccauggaaaaaaugguaaugacuguccauuuuuaaugccuuuuuucauagaaaaaguaggaaugcuaugaauuuucucuagcuguuuaugaguuuuuugcggauaaaacaaaguuacuagacaguauuauuauuauauuuaaagcaaaguuuuuaccauaauauugcuucagggaacucacaucuguaaccacaucagauagaaagcaauuuucagaaaagaaugaaaaacuucaauaauaucugcaguagucaugcccuaguguuuuucuauauuauauauauguguuuauauaauucauauuauauaaauaugcgaauguauguauacuuauuaaauucuagguuuuuucuuauaauagcuuaaucacauuuuuugucuuuuuaaagaaauuucaauagcuuuagggauacaagugauuuuuuggauacauggaugaauugugcaagggugaagucugggauuuuaguguacccaccaccugaguaguauacacuguaccucaauagguaguuuuucaucccucaccccgccuuccggcuuccccacuucugauuauccaguguucauuauaccacucuguaugccuuuguguacccauagcuuaggucccacuuggaagugaggacaugugguauuuggguuuuugauuccugaguuacuuuacuuagaguaauagccuucaguuccauacaaguugcugcaaaagacacuauuucauucuuuuuuauggcugaguaguauuccaugguguauauauaccacauuuucuuaaaccacuuaucaguugaugggcauuuagauugauuccauauguuugcaauuuagacauuaucuuuuauuaaauauacuuaguuaugagauguguauuuccauauguaccagcaaauauauaccaguguaugaaugugacaaaaaggaaaauuuuaauauuucaaagcuauaggaaaaagcaauguagauuaauaggagagcccuggccugggauucaguugacuagacucuuguuuugguuucuguccguccauuacccagguucuuuauuuaugaaacaggagggacuaauggaauugaacagaauauuucccaaaacucuucauauuuacaauucugaauuuuuauuauuuuaacaaguagaaaccuagaauaaauacucacaaguuuccuacuucccuuaugcuugggaagucaucuuuuucccccaaguagucaugauaguuacagcuuucuacccucgaagucaugagugcucugaacugguaaggaauagaauuuaguacaugguuauaaaaguccucucauuacagaguuaaguaauggugggaaaugugaccucuacucuuuagugaauagaucuuuuuaauauacagaggcaguguucuuuuugguuuaauaaugaaggcauucauuguaucuagcacuugguucuaaucucaucuugguauaguauccauuguuugauaauguaauacgaccuugauugcaauucauggggaacagucaugguugugguugcuguaaggacccuaauuauagcauuucuuuugcacuugcaaaaugaacuucauuuuuaucaaugcuuaugaaguuugaguaaucaaauucuuuuaggaauugcuguugguuaaucauugaugagauauuuccuuacauuuuugugauuagcucucaauauaauuugaugcauguacuuuuucuuuguaguuaucucauauuauuguuagugaaaauugaaaaugucucugugcucugauaaauuacccaguuguuugcuucuugagggccaccauuacuuaaaauuagaaaacuugcuggaucuuaagauuuuuaguauuuuaaaaugaaaauguuuacauuggugaccauauuuuaauauuuaacuauucaggggaaauauaauaauucugcuguaguuaccuguugaaauagaacaauuucuaaauuacauuugaugacgauuuuuagcucaauuaucagaaauuugagguuauauucuuccuuagccccguuuacauacaaaucuuuucacuguaguacaaggagaaaugagggucccugaagaagcucuuaagguaacaguuuuuacuuaacuucuuuugcaaaucuacucuucacuaugguugauuuuacuucuugauguuucacuuccauuuuuaaauguuuuauagcaugagaaguuuaccauucagcuucaguugucccaaaaaucuucagaaucagaauuauccaaaucugcaagugccaaaagcauagauucaaagguagcagacgcugcuacugaagugcagcacaaaacuacugaagcacugaaauccgaggaaaaagccauggguaagcuggccucucucgaaagaccaucuuuauacuugaucuugaagacacugcaugcuuuguucucagaaaguuggcuauguccauauaaaaauaauuuauaauagugauaauuucagaguguguuuuaaugcuaccagugcuuucauuaggaaacauuauaaaacacauaauuauauauagcaguuauauauaggugugcuuaauauguuuaaauguuuaagagaaguaaauauggucauccuucaguauccgugggggacugguuucaggacucccaugaauaccagaauucacgaugcucaaguuccuuauguaaaauggcauaguauuugcacauaacuugaacacauccuccuguauacuuuaaaucaucucuagaucacuuauaauaccuaauacaaugcauacaccucacuucauuuguuuaauaguacuuggcauaaggcaaauuuaagucuugcauuuuggaauguaguggaauuuuuucccccaaaacauuuuucaucugcagcuaauugaacccauggaugcagaaccuacagauucagaggguuaacuguguaguuuaccuuauaauauuuuuauuauuucauguuugucugcauuuucuucugcagcauaacaacgaaaacgaauuaaaagaaaaauuuuuuaaaucaaauguggcuguaucaccauauaauaauuuacaauucuaggcacguuauaaaaugccuuacauaaauaaucccauucaaacagaaacaaguuuuuaaaugaauaggcauuacuacauuugcucaaacaaaaaaauguuaguucuguuaagaacuaguuuuuguguccuugggcuggaaaaaaauuggaaaauagcuacucaugugaaaauuuacuuuagcuuugucuuuuacauuuagucuuaaugagccauuucugaucagacugguuuuguucuucccuaguugauuauugucuaguuucaacaaacuuguucuucugaggucacuuucugucuaaauucaaguaaaaugccauuuguuacaagcaguucaguuauauagcaaacaacucauaacaccuuaacaaaaagcuauugagauauguagcacguuguguuacuuagauaccacccaguggaaaucuuauuuauuuagucauguccaacauuguauaagaucuuccacaaauaccgaguuaauucaguauagaguacauuuuagcuaucaagacuauacuuugcuuuuuaauuuaauuaaucaagcaggcaguucuagcauucugcgaaaguguauucuuuucuguuucaucugcuuuagacagauuuuucccaccucuuuccagauauuucugcuaugccccgugguacuccauuauaugggcagccgucaugguggggggaugaugagguggaugaaaaaagagcuuucaagacaaauggcaaaccugaagaaaaaaaccaugaagcuggaacaucagguaaaaaaaucucagucacugugacauuaaguggauauuuugggaaguaucuguaaucuaagcaaacagcugucuaccaugaaaagagaugaucuaguauucuauacuuugauuuuuuaaaauugaugaauguuuuaauggccuuguuauuuuaauguaaaauuuaaaauuaugugugauuauaaguaaaguauuaauuuuaauaucuuuauaaagcacuucuauuuaaaauauuuuuuacaguuuaaaggagauguuaagauuuggaaaguagauuaaugauauaacuaggcauuuuaaguuuauaaaaauaauuauuaaaauauaucaauuagaccaaaauuguaggcauuaauuuugcguuuuuauuagauccccagaauauaaucauauuuuuaaaauaaauuaauuuauucuuugagaugggaucacacuguguugcccaggcuagucuugaacuccuggacucaagccaucuucccacuucagccucccgaggagcugagauuauggcacacaccaucucauguccagcuuaaucauauuuuuaaaugaacauuucccacuuuguucagaaaugugauaugaaauuacaaauucuucaaaaccucagugugcucauuguaaugagaaauggcagcaacaagauuaguugaguuuggcagccagaaugaaaaaauaguucugggucagauucucagauuaauagucaaggaacacauuuuugauauuucugauauuguuaauggagugguucaguccguaaaccagaaaaucaagacuuccaggaaaugaauggaggugucaguugccacauaaggaccuugcaaagacaugagaacagaaagauggagcagccaguuuuugagauaacagcagacaaggauccagaacuggaggaauuaaguacaggcaccugggcucaguauggaagacuaagucuggcucugaaccaaggauaaauuccaugagaacucuucucacuuuucuacuuuucacccuaauucuacaagauaaauaggacauuuuucuuagcuggacaauaagaacauugguucuuuagguaugcucuaauggauacaagucuagaaaagcgagcguuaucaacuucaucuuacagugcccaaggcugaacuugucaacuuugcaaauaaauucccaucccagcuuuauuguuucugucaccagcaguuuucuucaugcccaugcacagaaacaguauuacuuagcacgcuuucagauguaaauaacaaaugcugccugagacuaaacagggaagaaauuuacuggcucacauaacugaaccccaugaggguuguuuacuucagcaucucaacaaugucgucaucagcuagcuagcuucucuccgucucucagucuugcucuucauagugguugcagacugaggaguuuacccucacucucauaggcugccugccaguagcaggaagggguacaugcuacuuugaucacauccaacaggaaagcgaaaacguuacuuccggaagaccuuccagaauuuggaagaacuuugccaaaaguucuuaacaucucucaucucauuggccucucacagguucaggagagggucaccugcuuauuucugaaccaaucccuggcaaggcaaguuagauuauccuuaaaccagucuugcucaccuugaagcugugugugauguuaguuuuccccuaagccacaugaucuaugucaggaaagaguggaugccagagauuuuuggaguccuuugaggaggaaagaacagggaaaggauauugaaagaaaaccaaggaugucugcuuuauuuguaaauuuugaguguucccuucccuucaccuugucugucuaauccuuaggucuguugccuuuccccacgcugcccgccguccugagucaugauugggcuaccaaccugguuucaacccuccugcaguuuauuuuguauaacacaucuaaacugaucuuuauuuucuuuguucaagaaacuacaaugacugucuuuugccugccaaauagauuuuuaaacuaaguuguucaugucagaguuuucuaauuuugucccaguuuccauggucagccuuacgucccauuaccaguuguuugaguggucucucccaaugcaucccccauaaauuaugcuaauuccugccugcucuuuucccacagacauaaauacacacauacauuaaaugacaaagagauacauucuaaaugaugucuguauauuuaucgucaguacguuacaguuucauucauuauguugugugugugccuccuccccacagcuaaacuauacaugucuuauucaaguaccgcauaauauacuaucacugugcccuagagccaccuaguacugagagggggaaagauuuaccaauuaggugauuaagaaaacauagcugaauauaauuaucaccaaacucugaaaaucaguaugauaguaauuuuuaucuugccguuaaaauuuuagcccuccccugucacacacaaaacagcuuuugaaaucugaagcgcguaacuucuaacauacagugaaguguauauguaauuuuuguacagaaggcacaaccaugauuuacaguaauagcuaacacuucaguaggguuuacuuuauccaacauucuucugagugcuuuguaugcauuuauuuaaucaucacagcaauaccuaaagguacaguuacggugauuuuguagauaaagaaacugaggcauacugaaauuaauuuacuugucaaagucacccaacuacaaauaauggagcugggauuugaacuuagauugccugacuccugaguccacgcucuuaaccauaagaaguuuuaauauuucagccaucauuacucuuguaaacacaaucacucuaaaaggauauacuucauaggguacaaagauuuaaacaaauacuccaaaaucaaauagccauaaaaauugaucccuccuagcucagcauaauaaaauaaauuucaaaugugaagcauccagcaauacuuucaucuauaugaauguaacugaauucucagcuuguguacucuuucugcuagaugaccaaaagccgucucaugaucuugggguucuuuuugaguaauaauucagugauuuaugucuugugucaaauuccuuaaagugcccugucagauacagcugauuaguaauagccuuaagagacucucacuugcuuucuuauguuaguaugaggauauuacuguuucagauuuaucauuugcagcuuuuuaaaauauaggaugaggaaaauaguuuacugucuuguaauaauuuaugaagccagcagaaauuguagaaucagauuugaaauguauaucaaguguucuuuaauguggucauuuugaaauuaagguauuuuuaaaaacuuaaacuuuuuuuuuaaguuucaaauuguggaauauacgugauuaguuuaauaauuuauccuguagcauacucuuagugaaagcaaaaagugauuugcuucuucguuauuaauuuuuagaguugcauuccagaaaggauaauagaguguuugcuaccuaguaauuuuuaacguuccucucuguggguucauauauauccagaaacucccgaagacuugccauauagcuuaaaaagcccugguuuaagcaaauacuuacuuuagagcaauuucguucuccagaaauugugugacuauuuuuaaucguauuaagacguaaaguuuguccucaauuuauuuacagcuaugcuuuucuaccuccuaacuuggucucaacaauuaauuuagguuauaauuaaaggccuuuaacuguugcacacauuuugaaauggcaugugcaacugggaaucauagauuuuuggcucucucauguugauuuuuaauccagcgaaacuaaauuuggaaauuuucaagucguagcuccuuuuaagcaaaaggagcuucccagucuucuuaauuugacaugcuugaacagacuagguuagauggaugucuuaagcagaaugagcuguuauaauuauaguccuugucaucucaaauaaguuuaauauuucauugaauuuaguacagaagaaugaaaagaacauuuauucuggaugaaguauaaguaucccuuauaacauauuguguuaagguaacacagucauaaaauaccuuaagaacauaagcagauuaucaccaauugcuuuucugauugagauauauggaauuaauuauggcauaaucaaucauuaaauaauuuuuuaaaaucuaguaauugagauuaauaauauaauauuagucuaaacaaguauuuacucuauuauuuaguuucauuugguauaacaaaaugaguuuugaagauagaugaauguuaaauuucuaaauuccagaauauguucuguuaguguucugagggaggaaagguguuuuauuuuucuguguugauuagaagaccccuuauaguuuucuauuagguacuucucaaguguaguuggaccacacuucaucuguuuuuaucaucuuuagggaaaugaauccuuccacauaaugaauuuuccagaugauugaacuuuacuuuuacaguugauaguuuuuuugaaguuuaaccauuuccuaaguuucuauuaaauuaauuacccauauuaccaccuucuuaagcagagaaguuucaguauaauuuaaaacuuuuucuuaugacucaaaaucaucaaucaucaauaucaguauuacuauuauauauaucaauagcaauagcaauauugauauaaucaauaaucaaauauauuaguaauauaauaauacugauacugccuuacaguaauguccucaggagacuguaguauauaagacuguuugcccuauauacugaaugguacuggacuaucauguuuuuggggccauuugucugcucuuguuuuucaucuugucucuaccacuuggugcaauuugucuguccuuaauccucacuuuuguacccugcccaagguuugcuacaugugaucugaguaaauaguaaaaaccucucggugaagaucuuaacuguuaguaauguuuaugaauauucaaggauaggcauugucauaucugucuuggguuuuuuagaguuggguuuugguauuagcuuuuugucuuccugauucucagcuguuuuugaagguggagggagaagcauuuauuuguguaccugcuuuguucuggguaacuuacaugaucucacuuaauacucaucucacuaaaucuucacaacaaucuuaugggaagauacuguuuucucacuuuaugaugaggaaaaugaggacuacagacugauuagggauaagauuuaucugauuucagaucuugucugggcuuugcaugaaaccaggcugccugguuaugaucaucagaucauagucugcugccuuuccacucuauugugcuacuugaccugguuagguacuugauuucuagaugaauuaguuauuaacuuguauaagucucaaguuucuagcuuugagugaaugcgaguuugaaguaguacuaacaugggaauggugaccuucaaaacaggugaccuugauaagugcuauaucccuggccagcuuuuuuguguugcuucauagcugagccacaucaguuuuauuuagcucucuguauaguggaucaguuuuauuuggcucucuguguagugguauuagaaacuaccaucuugacguuguucugucaccugaaggaugagcaaagcaaaaacaaacuauauguauauaucuauauggggggagggagagaggacagguuuaugaaccaguuguacuguauggacuugaucaaguacaguacauugugcauaguaaaaaaaaaucaaugucugaaaaaauagaaaaauaacauuaaugaacuauuaauauaugagaagcaguuaauacauuuuauucuaauggaaauuuuaacuaacaugacuucagaguaaacacucacaaguccagcugaacauuuuauuuuuaagaaaaagacaaauuaacucuuuaaucaaacauuuuuuuaaacuuaggucaugucauauaaauguaugauuauuucucugauaauguagaguuuuuccaauacuuuucuuucauguucagugauaggaaagcugaguagauuuuaaaagggauaauuuuucacagugaaaauuacaauauauucuuucauauuauauguucucuuugccuuguguuuagauuuuuuugacaauuuauuauuauuauauuuauuguggaaauggagcuuguugucuuccgugcccuaucccacacauuugauuaugaaagagagauguuacuauaucauucuucuguaaccuaaaagcagucagguuuuauauuauuucauauucagacugcugucaagaaaccaauuauaguaccugacagaucccacuaaaauuuaauuuuugaaaagauguuucaaaagaccaaacgcuucacuuaauuagaaaauguuuggaaacaaccuagucucccuguauugccuuguuuuccuaauaaauugucuguaagugauuuuucuauuaaucuguuuaaaagcagaauuuauuuuugagcuuuagggaaauaugucucauuucaacuugcucuucauuuugauaauggacaugcuuugcuucuucaacaacaggacaauagcaucuuuaauuuuuuuauuuugcauuugcguaccgaaaacguuuuaguugucauuuuuauuuauguauuuuauucauaaaugcaucuguuucuauacuuuuguauuagauucugaggcaacagaagaauagugauaguguuccagaguugcuugcuccuucugccaacucauguuaaucugagguuuacaauucagcuuuccuccaaggaauuuugacacuuuugcauauucugcuguauggaaauguaaacuuccagaguuauugucuggaaacugaauuuccuauuuuaaccuuauuucguucacacugcugcuuggauugcaaaccacauguuuuagucuuuauaaaauguuuguaucuucuugcaaggaucgcacuucagcaauaucuuugucauucugaaaguaauguuuccgaauguaauggugaagaaugguaaguggaaucauuacuuccagaagaucacuuacauauuuacuucauguuuguauucucauuugagcaccuauucuccuuuggagcacuacauguguucauauauauuucagauaucucaucuuggcgacuugagaagggaguucaugguuuuucugucacuuuuuauauauacauugaacaugcaucuccaucuacauuuuauuuuaauucuuuuggaccuugaugaauucuagauccagguuggaaaaaauauggaccuagccaugcaagauccauuucuuaacugcuuugcucucauuugccauugcugcugcuuaucuuccauccccuauugguaaucaaaucgcauguuuauaaucaagauucuuucuucucugugacauuuguucugugauauaaaugccauugguuuucauccagacugugaucugccuucugguucucacggaguaguacacauggccauuaccagacucccucaagugccagaagcaaucaaauauuuugaauuuucucuuauuuuucucauuagggugcggcauagaugccaagcaaguugaggaacaaucugcagcugcaaaugaagaaguacuuuuuccuuucuguagggaaccaaguuauuuugaaaucccuacaaaagaauuccagcaaccaucacaaauaacagaaagcacuauucaugaaaucccaacaaaagacacgccaaguucccauauaacaggugcagggcaugcuucauuuaccauugaauuugaugacaguaccccagggaagguaacuauuagagaccaugugacaaaguuuacuucugaucagcgccacaaguccaagaagucuucuccuggaacucaagacuugcuggggauucaaacaggaaugauggcacccgaaaacaaaguugcugacuggcuagcacaaaacaacccuccucaaaugcuaugggaaagaacagaagaggauucuaaaagcauuaaaagugauguuccaguguacuugaaaagguugaaagguaaagugauuugaucauucagaacuuccuacuuuacgauaaagaaaaucuggucuucauuuacuagacuacuaguagauacuuacaugguagaaaacauucugcuuuuuucaaagguuauauuuagucuuaaaacuaaacaggaagcuacacugcccauguccaauuuccucauucaaaauagucuuccuucauuuucuugacaaaaccagauugguuuuaugagcuuauauuuaugcuauaaaacauguuucuuuuucuucuagaaauauaagauuuauuaaguuuaccaguagaguucccuagaagaugaguuccaucauuuucuugauuuaaggaaaagauauauucaauucuguucucuauugagaucaauaucuagauucugaaagaaauuuuaagucauuuggucugagccaaaaguucuacuuugguaaugcagucacaucauugauggagcgcuucaaaguauucucagugguuacucauaaaacaaagauuuuugguuuagaaauauuugguaggaucuauuaauccaguuuuaaaauuuuuuuuaauauuaggacuucaugaaaauuagaguugaauguucauuuuugaaauaguuauauauacuuuauuuguguagaacuuagccaaaauuaguacaauuuguauguuuguacacugauguaucagcugaucaguuuuuucucauugguuuugccaauuaaauuuauuuuagaauugaguauagauuuauguuacccuaucuuuuauuuaauaagcuaucuauaaggaaaacgauuuugaacaaauugugauuacacguuuagcugaccauucuguuacuauauuaggaguuuuuguacuccuaacacuucaucuaguacuugagcaugugauagguacuaauuugaaaacaaugggcgauuucucugucaaugacaagacugucccugauuuaaucuguaccuuauguccuggcauucugaucaaguaaugaagaaauaguauuuguauacuuauuucugauuugcuucuaagacauuuccggacagugagaugaugugauuaccuaauuauuuguuggagccuaucacaauauuuaauuauaguuaucagcaguuaccuggcauauguauuuuugagacaugauugugacauuuuacuucuagacaauacguaauugagacauuuuguuucuguagguuaacacucacaaacacauaggcuguuuauaugaauuggauaaauaauauugaucuccuaguacaguauaagagguagcugaaccuugagaauuuagaaauaacuuagacuuuuuaaaaccacucuuaauaaacaaaaacugagguaaaauauccuuuuaaaagguaaucauuuuaaaaauaccuuuauuaaacccauuuauaacuuagucauuauaacuauuuucuauauugacuauuauuauuacuacuauuuuuuuuuuuuuuuuuuggagacagagucucgcuuugucacucaggcuggagugcaguggcgcgaucucggcucacugcaagcuccgccuccuggguucacgcgauucuccugccucagccucccgaguagcuggaacuacaggcgcccaccaccacacccggcuaauuuuuuuuauuuuuaguagagacgggguuucaccguguuagccaggauggucuugaucuccugaccucgugauccacccaccuuagccucccaaagugcugggguuacaggcgugagccaccgcgccuggccuguaucgacuauuauuuuuaagccauuauuuuaaaacguucuguccucacaagcccauuugugggccuaauuccaaauagagggauuaauguccacauguauacuauaucuguauuuuaaugauuagaucuuuuaagcccuuacuagaaauuauguaaucauauuacuguuguccuucaaaguugauuuauagguagacauacauuccaguauggugccagugugagaacucuucuuuuggauuugccuucagaccauuuuacaagccauugaagauaauguuuuugugaauauaacucauuuuuugauccaagauagacucauuuuacuuuucuggacauguguauaaaugacaugugacuuucuccaaaagucagagcuuccaucauuagauaacaauuuuccaugauuuaggauauaaaaaguauauagccagacucuaaauaaauguaauuauagcaaauaauaaaaauuuuacaaaaauuagguuuucagcaacuguuuagaucaaagaauugaaaguaggcaaaacaaaacuaaaacaaaaaacuuugcuccuacaagaguaaaaugcaggugcuuugcgacaguuuggaaaauaaagcccauacacuuuaacccuuuaggagaguugccacuguuuuaggccacaccacugacuuguuacagcuaaccuacccuaaaaauauuaaaaggacuucaacauauuuaggcaugguuaaugaugagcaaaggaaagaaaagaacuuggugaggacuguuuccuagugacuuuuuuaaugaguagaaacagaaaauugcagcugugaugagauguugacuuguauaacccugacaaaauacaagagggaaugguaauuuuccaaaaaagaaaaugacuaauuuauaagaaaaguuuugaacuacaaguuauaggaaagauauuugaaagggccugacaccacuaagugccaaauuuuaucuauuggaaucaauuaaauucugugaagaugguauuuucauuaaaaucuuucuguaugugcgugaucuguuauucuuaugguacagcaaauauuggaauuuaguuauuuucagcuuuuagaaacuggauuccuuuucaauagagccauuacaacaaugaaauagguuguaaaaucuaguguuuuuaaugaagucuauauuugaacuaaggaguuuguuugggcuugccuuucaucugcuaucuguuauuccuagcuuaauuaccugaggcagggauuucauuaauuaaucccauuuuuucuuuucagauugcauuuugaguagucaacaauuugaagaaagaucuucagauuuguugucauauaugauuuuuauaguauuaaucacuauuacuuugauagacaugaucuccaaaucaccuucauuuugaucuuacucccuuuguuucccuugccuauuacuuuuccaagacaugacccuuuucugugcauuccgcaguucucucuucugugucuucucauuccuuuuaugcaccacauuuuuauaacuaguguuucuguguuaaaucauugggaccaguuaguaaucucuaaauucauuaggaacaaccuauaaacauuaacacucaacuucccuagacauaggucauuugcuucucccacccccaagucuuucgugucugaucauuauuuuguuugguaccauauuauucaguggguguucacauuaaaauuuguagcccagguaaauuuaaaaaucagauuuaguccuggaagcauuagaauguaccucguugacuaaauucauucauagcuaaagaaguuuaaaacuaauuuaagcucugauuugugauuccauuuaaaacaugcacagaauaacuugacuuucuaauaauuucaugcuauaauaauacaauaucauuugauuauuuuuaucauauacuuauuauuuagguaaugagaauuuuaaaucaggaaaaaaauaauuuuugugucaucacauccaaaaccuaacagaaccauuaaggguaacuaguggcuuuuacuugcucuaaaauagaaaaaccuuuguuaaagaggugaucuuucaaaauuccgauauauucuaaccugauaugcuuccuggggaaaauagcugguuauauugagcaccaugcuguuugcccagugguccuuagaucuagguggagauuucauagaugacccuuugcauugauagaccucucagcaugcuuucuuuaacucugaagccacuagaguuuggagugcaaaugcaguuuucaaaaauucucauagcuggaaagauauguggaaaaaauuuugcaauaauuaauggggacuacaaauuugaaucuuuuuaauaaaaaggaaaaauaugcugagcuucugaaaguacugaacaucagugaagcuuaagauucaucacauuuuuaccauacuuauguucucauuuccuguguaacaguaagcauuucagugacauuacccuuuuucuugucuuuuuucaucucuaaugcuagagucaaauuuuuuauugcuaaauaagauguauaauuugaaggcagaauuaauguuuauugauguuaggaauacaaauaucgcagagauagagcaucaauuaucuauuaagacauugaugaaacauuauaaaguuaaaauuuggagaaaggcgauccuauucaguuguuuauaaaggaccucauuguuaguugauaaaauuugaauguaaccauugcaauugagcaaguuugccgagccuguuacugaagagaacauaugacuuuggauugaaaaggaggaggggagcaaaacaaauagcacuuuuguauaugcuucuaaauuucuacaugggacuuuuuccuucucuauuguguguuuucuuuuuguauccaggaaauaaacaugaugaugguacgcaaagugauucagagaacgcuggggcucacaggcgcuguagcaaacgugcaacucuugaggaacacuuaagacgccaccauucagaacacaaaaagcuacagaagguccaggcuacugaaaagcaucaagaccaagcuguuguaagucaaacugcuuuuaugauugcauucuuugaugaagacaaucccagaaaaagaaggucguauucuuuuacucaaagugcgggaaucuugugucaggaaacuacauauucaacaccacauacaaaacuugagaaagcaaagucuccaacagcagaugccaaagugguuucuuugucuuuacagacuagcucugcgcaucacagaggggggcaugguguuccacaugggaaauuguuaaaacagaaaucagaggagccaucggugucaauacccuuccuacaaacugcauuauuaagaaguucagggagucuugggcacagaccaagccaggagauggauaaaauguuaaaaaaucaagcaacuucugcuacuucugaaaaggauaaugaugaugaccaaagugacaaggguacuuauaccauugaguuagagaaucccaacagugaggaaguggaagcaagaaaaaugauugacaagguaaauaauugaaauuugagugugaucuuaguuguugugugguguauuugacugguggaaauuauuggagagucagcaugagauguugucaugcagucagugguaugugaauuuuaggguuuuguuagggaacugcaagacuuaacaguaagaccaacaugcuuugugauuuuauuugcugauauucugaauuuaccugaguuucauacauaaagcucuguacauuuaaaagguuuggaccuuuuaaauuuguguaaauuaaagauagguuuuaaaaauaguaugcuuuggacauucuugcuuugcauuugcuuaaaaaauaaaaagaaacaaccaacaaacauugcuauaacucuguuaacauaaauguagauauuagccaauaauaguuaaccacagauuuccuaccugcugauuucauguuggaagaugaaaauacuuauuuuagcuuuguucuuuguccguauguuuucuuaauuucuauucacugcugucauuggugguagaagagaaguauaugaaaacaaaaucaguuguuuaugauuuaguuuacuaguuuaaccacguauaugaccagucgugauaguuaccuacauuucaaguguauucuuugauauuauugguuagcguguguaaggauuguugcaugguuuaaaaagcaauuuuucucaguuuugccaauggucgugaaagguugacuuuagaaucagcuaucaagguugccguugaaaguaauggcaaaaaccgcagugacuuuugcaccaaccucauauuaccucuugcaaaacagcaguauccguuuggcuaaacguuaaucuuuuguuugaauucuuguuacucaaauccacuccacggguuagcagcauaaauauuacuuggaagcuuguuagaaaugcagcuucucaggcccauccuauauauaccaagucaaaaucuacauuagaaaugagaucuccaguugacuaaugugcacauuaacauuugagaugcacuuauuuagaugaugaguuucuggaauggccucuucagggaggagggcaagauaagauaacccuuugggaugcaggaaaaauauuagaacuuaauguuuacuuuuauuuucauauuuuuaauuuuuauuuuggauuguguucuauaguguauaaaaucucuuacuacacuguaagagaguacguauaauuucuaaacauacauuuauugugaaguacaugcuucagguuuaccacugagcugcucaacuccaaacuuuuagagacccauugucugggaaauaggugagcaauauuauaguuguuaauaugaaaaguauaguguuuaagaaacaucugauguuucuuaaugacugaucauaauggcugauguuuucccauuaaaagauuauuuugcagugaaggauuuuauauguauauauauauagagagagagagagagugcaauuuaagaacauggacccuuguaagcagacagaucugggauuaaauauaaacuuugcaugugcuugugugugcccuuggguaaaguuaccucuuuaagccucaguuucuuuuaucucugaaacagaggcgauaucacuagauuauaaaaagaauucaauaaaacauguaaaaggcuuaucacaauaccuaucuuauuauauugcuuuauaaguguugcuuuaucauuacuguuauuaggaguuuccacauuugaaucucuacauaaaguacugacaaaucccagaauguucuuucagcacugaaaggguuaaauauaaaaccacaauggaagugacagugugaggggcuagcuuggccaggacagcagaaagccaagaaagaagucauuguagcagaugaaacucuucaggaaacugcuggauagagaggguggccacaaaaccuguuuuacaccuguugccuacaauuaucauaagcaucauuuuuuauucucagaguccauuuugacagcaaauuauauggucacacuguggauagagaaacccaagacuuuagagcaggagucauuuaaaggaguaaugguagugugugacuguguacauaguucaaagucauucuuaguuuguauaaaccagaaaaugaagcugagaccauauugcugggaagaacaaagcucacuacauuaucuugugacuaccaaagaaaaagagcuaagauuccauuagcuugaauccacauaaagcuuaaagccaaauucgggcuaauuaaagucaggcucugggaaaacaaaagcauaaaagcaguaaucaugucugaguaagaugaaguaaccuguggguaugaagaaaacaaagaccaacaacagccagaaggaaggcagaaaaagcacuuugggaggauaggaguagauacaggcaucauaucaaguugccuggaugaguguugucauccaguuucuccauuuugagguuugggugugugggauugaaguuggggccaucagcuguuguuugucugaauuuaaauguucuuugguccuggaaacguucauguggucuaacucuucuuuucacgucaucauuugagauguguucuauuucauugauucauuuauuuagcaacuuuaauucaacauuaacuaugugccaggcuuugugucuacgagaaggugauucacaaugaaaagacugagcucuuucucucaggaaauggcuguguacuggaauagauauacacagacaaaaaccaagacuuuaaaaauaaagcuguuggaggaaagcuaccaauagcuuccaagaggagaucucaggucuucagaggacauuccuuccucagagaagucuuuagucauucaguuaaaaaaaaaaaaaaguagucacugucaucaacuuguuucauuuuaaucauaagcuuuauuacugcuucaccaguucacuguuuauucauuugccucccuacucccauuggaaagagacacaaacaaauguaaacuccaugacuguaggaaccuagugccagcauauaaaauguccucaauaaauauugccagcugagcuagucgugaaacauacguaauuaaucccauaacaggcaugcuagguagaguuuuccagaaauauggaacagccuauucgaaagcacaggagcacacaugacuuguucagaggaccacaguuacuuuugaagagaugagauuggacucgauauugaaguucauuauauaucauacugaggacuuuaaugccgaaggcaguggggaaucauugaaaacauuuaaguagggcaaugacauggucgagucacugucagaagugugaaguauggauugaacauuggaaaugccagaagcacagaaggcaaucuaaaagcugcugucauguccaguagucaauuaguuaaugacuagaucuuagguaagaggccugggcuaaaaauacagaucugggaauuauuagacaauagagggcagcugucuuaguauguuuuguguugcuauaucugagacuggguagcuuaucaagaaaagagguuuguuuagcucacaauucugcaggcugggaaauucuagagcauagcuccacauauggcuggcuuauguuaagggcuacaugcugggucaaaacaugguagagaaagucagaggggaaguggacauaugcaaaaaggcaaaacaagaggggcugccucacuuuauaacagucuacugugaagggaacaaauccauucccauaagaacaagaacucacaagauagcauuaauauauucaugagagaucugccuuuuugacccaaacaccucccauuaggccucaccucccaacacugucacacuggcaauuaaacuucuacaugaguuuuggcagggacaaaccacauccaaaccauagcaguaauugaauacaaaauaagagaugagauuaaucagagaaaauguauagggugagagcaaauaaaguaugaaaaucucagcaacaccaacauugauggacaaaggagaagggggaacaaaggaaacugaaaaauauguaacaggaauaagagaaaaccaaaggaauauguagcaucuuggaauaaaaagcagagcaaagagaagucaguaagcaacaguaucacaugacacacugauguuaacuaugaugagcacagaaugccuuuucaguuuuucuccaaaauacauuguaauucuugggcuaaagaagaugagcaaaccguguauuugcaucuuaccuugggaagaguugcauagcauuaaaauaggauuucuuuaaagagaugaccaagcuaaacugcuguauccuuauuuuucugugcugguaguaguuaaaagauagugaacuaccuacccucuuuuucugucgccaaguuaugagauuacagcauuuggguuuguauuuuggggcugucucucucaauagaucaccuuauuuuaugcauguccucaaauucaccuuuaaaauguuaacacaaauaccugauauugauaaagaccucuuaaguuuuacaucuaaguuuacauggaaauacacuauaagaaagugcuguugacugccuagauuaaaggcauuuaucucucauacuaguaauuaucucucccaacccucucucccuuggccucuccgauaacuaccuucccaucacaguaccaguuucuucucuccacucuuccaucaaaagagauaaccacugaggcaagaggaagaccuugucaggguuacuuccuaaccuccuaagcuaaauaggagaaacuugugguaagaacagaaagcuaaacauuaaaggaacaagaaaaaaugaucauuguggagggcuugaggaacuauccucuuaaaagaaauauuucuccucauaaauuucauaccauagaccaacucugccagauacuuuucuuguccugaguuuugauucuuguucauugugucaauauaucuccccuacaaagccucuuacuagcgucuuuucuucccucauagggccuggucacugcugguucuauaagcaacaguugguagggaagaaucuagagccaggagaccuauaacaaaacuagaaacaugggaggaagaacauuuacagcagugagucaaacagcucaagaaagucagugcugcggaucuggacccuguaaaaauauuccaaacccugaaagucacagcaagauuuaagaugagauccaaguaagagccagggaaacgaugauaaaccagaaucaaaaucuauguagaagaaggcaggauguccaaaguccacucagauagagaauuagaugugcaugggaacucaaggaguaggagaucaagugagagccuuggacaauaggagaagacuuugacgacagucagcauuuuuauuuuugacugagcaauuuuuucuguauugagaauuuuuucuuuuuaauuucuaccaggagagcuuacuuuugguuucucugauuaguucuccucaacccuucuuaaccucugcugccuccuuccuggguauaagaaacccucuccugcuguguuaauuuccaaagcuucacgagggaacccucaccuuuuauucagccagacgccuaacauaauagguuuguccucauuuuccuuucucucuuauuguaugaaauucuauuuauuuuccucuuugaggaaauugugcccucaaucuaauaagcucuuccuugucuuuuuggcaugccuagcuucucauaauucauuuuauuuauuccuuccaucuuuuuauuguggaaaauauauauaagaaaauuuaucgucuuagcaauuuuuaaauguagcguuuaguguuauuaaauacguuuaaaauguugcacaaccaucaccgccauccaucucuguaacuuuuugucuugaaaaauggaaacucuauacccaucucauaauucacuuugaaguggcuuuuacucaccacucuauuuaaaguaguugcgucauucacuucuuauaucucuccaucagauugccauguuguguuuucuuuauagaacucacuuccgucugguuuauuuucuguuuguucacucuaagauuuuguuauuugucuuguucacaucguaucccuugugucuagaacagugucuggcauguaauagacacucaauaaauaucuuuugaaugugaaugaaugagaaagaaaaauuugugaccugcuuuuucauuuguuagcauuuguguaugauucguuguagauuggcuaacuuauuucaaugaauuuauagauuaauuaaauccaaccaugcccccacaaagaaauuuuucugcauuuuuauaugcugaaacuaguuuauaucuugauuccaaaauaacuuguuaaaauauauaguuuaaaaccuuguauauauuauaaacuuagcuuuguaauauuaaguaugaaagcagcaaagauagauagucucagaagaagaagaaauguauaaauuuuggggagaugcugugauaaauagacuagacuuaccuuugaguuccuagcgauaccuaccugacagcuuccagcuggaaaaucugcuuggcaaggaaaggggaauaugauuauugaugaacuuccagcuuauagggacuguaagaggggauacaugaccagggaaugaaccauaaaagggagagaaauuggacauuuaaauuuuagaggaauuagaugagaucuaaguauaauuugaagauaugaaagaaagagcaaaucgagaaagauguaggaagugaugggagggaagagauuauggauguaagacuucuaaguaauggggagaaucaaggacacaagguagguuaagagggaagacaaagauuuaagaacauguuuucacccagacaggagagcaaaggaagaagacagaggcugagcgcaguggcucacgccuguaaucccagcacuuugggaggccaaggcgggugaucacgaggucaggagauugacaccauccuggcuaacacggugaaacccccucucuacuaaaaauacaaaaaaaacagcagggcauggggcaugagccugcaaucccagcuacucgggaggcugaggcaggagaaucgcuugaacccgggaggcggagguugcagugagccaagauugugccacugcacuccagccugggugacagagcaagacccaucucaaaaaaaaaaaaagaagaagaagauagagucccauuuaaagaaaauaugagguaaaauucauauaauaugaaauugacuauuuuagccauuuaaaguauacaauucaguggcuuuuaguacauucacaggguuguacaaccaucagcacuaucuuaauuucagggcauuuucaucacugcaaaaccaaaucucaugaucauuaagcagucacuucccauuccuuccucucccagccuccuggcagccacuaaucuacuuuuugucucuauggauuugcuuauucuagacauuuuguauaaauggaaucauacuauauguggucuuuugugaccggcuacuuucacuuggaauaauguuuucaagguucacauguguuguaaccuguaucaguacuucacuccuuuuuuuuuuuuuuuuuuuuuuuuuuugaggcagagucucgcucuguugcccaggcuggagugcaguggcgugaucucggcucacguuaugcgauucuccugucucagccucgcuaguagcugggacuacaagcacuugccaccacgcccgguuaauuuuuguauuuuuaguauagaugggguuuugccauguuggccaggcuggucucaaacuccugaccucaggugauccacccgccuucggccucccaaagugcuggaauuacaggcacgagccaccacucccugcccauuccuuuuuauggcugaauaaauaucuuauugcgugcauaaaccacauuuuauucauccauccauccacagauggauaauuguguucuuucuuccuuuggcuguuguaacacugcugugaaugugcaugcacauauauuuauuuguggaccaggauaaauuauaaaaugucucuccugacucccuuucugugcucuucuaauaauuuugucugaauuuuaaauuuaaaaguugauuacaaauaugugauaaaaaucacaguguuaaauauucacaauaacuuauuccauggaauuuuaagggauuuuucuuuuuaaaaguaaaauuagauuuucauagacaauuacaaaaauaaauuccccucuuaaaucauccugauuuaguuccuugacacuaguggcuagaauucugcauaauucuuaauucuuaaagugucaaauuauuuucaugggccaugggaaccucuacuauugauuugauccaacagagacccugcucuccuuacccaagaagucuuugcucauugaggaggaagauguucugguuaucugagguugaaacuugaguacauuuuuacuuggacaccuugaugugauugauauacuaaugcaauacuguuuuucaguuguuacuuuaaaauaagauuguagaaguuagauguuuaaucugccauuauauuuuucauuucugugggaauaugaauucugaauuccuacugauuuggauauuuuuuaaacuaauaaauuagcacuauugcuauugaauuaucauuuugcucuacauuguauuacuauaguuuuaugccuacaucuuaccccacggcgcuucucuucuuucacaauggucucuauuuucugucacaaucagcaagcuucccguaucugauguuacuaaauguaaauuuugaccucucugcaaauauucaauagguaggauauuuaucugcaugaaaguugacccuguaucccccauccucaccauucugauuucagaauuggacacugugcaucuuugcacagacugagcuuuucaauaauaaugacuaugaucauaauaugcuagugaaaaaaaucagucaaacuuuucauagguuugguuuguauuguacgaguuuguuaucuggagaauguuuagucucuuuaaacuuaaaacuaaaaucuaaaaauaucguuugguucuuauggauauuugguuuuaauuacagaauauuccugcaugguucuuucaggugacagccucuucuuuuuauaagcuccuuuaucagacguaaccuccucaaaagcaaagacugucauacagauuuuguaauccccugcaguggcuagccaaguagccuguggagaguaagugccauuccucaguaacagguuguuaaaauuguuuacaguagccacugagcuuuggauuugaaaucccaaagugaaaugccaaauauacaaauguauucagaagaaaagauuguuucaugauuguuggagugggauagggagggagguacugccuucuuaccccagaccuaaaggccauggcagagggguuguggcucacuccacagagauguaucuacucggaucgggggaacuguaggagagaauaugugaaagccacuuccuacgcccaguacgaaugaguugucuuuaaacaucugccaggcccagacagcucuccaugcaagugcaaguucacaaaggaguuuucaccuccuguccuauuccgccuuccuuugauccuacucuggaagaauuagaaacuggcaaacuuggggugcaagcauaaaaauuaggugucucaucuccuuccccacuguggacuucuagccuacagaaguuccuagcugaaugaaagaccuagauuuuguacuaucucauguuugggauuuggauugagaccagaccagagaagagaaucaugagccuagaggugagauacuauguuggaaauaccuuugaggccgggcguuguggcucacgccuguaaucccagcacuuugggaggcugaggcaggcagaugaugaggucaggagauggagaccauccuggcuaacacggugaaaccccgucucugcuaaaaauacaaaaaauuagccaggcguaguggcgggcgccuguagucccagcuacucgggaggcugaggcaggagaauggcgugaacccgggaggcggagcuugcagugagccgagaucgcgccacugcacuccggccugggcgacaaagcgagacucugucucaaaaaaaaacaaaaaagaaauacuguugagccuuccagcaggugggaugacaguaagcaacagucuagauaguugguaauugaagugaagccuugcauguuccuaggugaaaucaccugggaauagaaucuaaaaugaaaggugagagaaccuagcauacuuggucuugguuuugaggagcucucaaguucuguacaauuaucagcucuuuuuucagacuguagguaccuuuuauaagugugaaaaguacacuaacuuuaaguauauagacaguauaaacuuuauauauuuguuuucacauaaaaguugucacagguggauguguuucuacuuagaggcagaaacgcauagauauggauuucaaucugggcugguagucauugcuaucauuaauuuuucaaaacgcuaucaaaacagaugugaaauuugaaggcuucuuuccccacacuguaguaggucaggcccuaccacuuguuuggagaagaaauaauuguuacuuaauaauguauguauagcugucucugaugcuuuaaaaggaaucugucgaacgucaucgaaguauuuucuguccggcuucagcuccccuuccucacaggauuaguucguguguuuuuuguugucauuucaaaguggugucagaagugauuuagagagguucaugauauuuuauuugaaacugcuggugcuuagauguuugaggaaaucaaguuuuuaguguggauuagaaugaaauauucaucagaaaaucacucaagauaauuucuaaauuacaugucaaagagaugcaaaaaugcaaguacucaugugguuauuuuaacuuucaaaccugaguuagauuuuuguuaguaauuauaaaauaaguaaauaaacuucaguaaaauuggaguucagugacuugaguuaggagugauuaacuuuuuuaaagacggacacaaauaacuugaauagcuauaauuugcuuucuuuacaaguggggguuaaagguagaggacacagguuauacucugguuuuuucacugcuguuaaacuuaacgcuaauguuaagcaaaacgaagcaguuuuuguuuuuucccuucuguacauugugcuuccauguauuaaaauucauauuugauuuaaaauaaacaauacauaauuugcucuuaaagcaaagauaauuuaaauauugaggaguucaagagaauauuaaaucauaauucuugacaauuauaguuauguuagaauuaaauauuaaguaauaagaccaucuagugguaaaauuuucaaguuuuagugaaugagaaagucugauaccuguuucacuaaauaugaacuuuagagcuuaucagauagcuguacuauaagaccauuaaaacuuuaugucuagaaaauaguuuagccugagguagcuucuccuuauagaaaaugaaggcucucugguuauauccuaaagauccugucugcaaauugcucauucaaaugcaugauauuuuucuagauuguaauaaucagagccacaaacaauaacuauaaagaauaaaaauugggaacacaguggagauuuaauagcagaauagaauguuaauauuuauaugccuaaaauuuuuccaaucuauucugugacauccagggccuauuaugugccaggaaaugaguaagacucagguccugcccauaaaagaaaagcacgccauuguuugucuuuguauuuagaacuuuucagaaguguuggacauugacaacuugcuuuuugaaacaauuaaucuuaaauaggccuggaaucugcauuucaaacaaaggucuuuaagggauuguuaggcaaauacaguuugagaauuaugcuaucuacuaugucgcaauuauacaauaaaauggcaucuuagaaaauuucaugccuaaauguaacucagauguguaaaugguaaacauuugcuagggaaggaacagauaaaaucagccacauguuuaugguuuuucaacaagugucacaaaaauaauagagcaaagaagcugaaaagaaacugaagagauacuuuuuucuaacucuuugcauuguuguacuguuuaacaacauuauuaaaucuuuuuuuuuuuuuuuuugaaacagggucucacuuuuucgcccaggcuggaaugcaguggcgugaucucagcucacuguaaccuccgccuccuggguucaagcuauuuucuugccucagccucccaaguagcugggacuauaggcacauggcaccaugcccagcuaauuuuuguauuuuuaguagaaacgggguuucaccauguuggccaggcugguccggaacuccugaccucaagugaucugcucgccucggccucccaaagugcugggauuacaggugugugccaccacgccugaccuauuaaaucuuuuaacaaauaaaauaugucuugaauauuuuuuuuuaaucgaacaggacauuugcuaaauguuaaaaaaaggauaguuacuuucggccaggcauguuggcucaugccuguaaucccagcaguuugggaggccgaggcgggcagaucaccugaggucgggaguucgagaccagccugaccaacauggaaaaacccugucucuacuacaaauacaaaauuagccgggcaugguugcgcaugccuguaaucccagccacucgggaagcugaggcaggaaaaccucuugaacccgggaggcggagguugcggugagccgagaucacgccacuguacuccagccugggcaacaagagugaaacuccgucucaaaaaaaaaaaaggauaauuacuuucacauaagcugugacugccugcuuucguuucuagcuaucacaauuagcuguuacugucauucaagaaguuuuccuuaguuuugaaauuaacuauuaaaauuaauuuggaauauuuuuauuugccucugaaguuaauuauacuauucacauauuaaucuuguguucagacuuuucguuuucauuuauaaaauaauuuuucccucuagguguuuggaguagaugacaaucaggauuauaauaggccuguuaucaacgaaaaacauaaagaucuaauaaaagauugggcucucaguucugcugcagcaguaauggaagaaagaaaaccacugacuacaucuggauuucaccacucagagguauacaucucuucuguguaccuauuugaaugcauaaaguauaaauucuuuuuuuuuucuugucugagacagaguuucacucuguugcccaggcuggagugcaauggcaggaucucggcucacugcagccucugccgucugaguucaagugauucuccugcuucagcgucccaaguagcugugauuacaggcgugcaccgccaugcccggcuaauuucauauuuuuaguagagaugguuucaccauguuggucaggcuggucucgaacuccugaccucaagugauccacccgccucagccucccauggugcgaggauuacaggcaugagucaccgcacuuggccugaauucuuaucauuuguaaauuacauuauuuuaagcaauuaauguaucuccuuguaaaaugcuucuaaaaacuaaauuuuuauaaauuuauuuucuaaugaaagccuaaagcaauuuugcaguaauucaacuuuaauuuuuauuagguguuagaaauauucauuugucaaugaggaaaauauuagguuucaguaagcaguuaaugagcuauaugcucaugguucugauuggcauuaugagauaaaacaagaaacauauccugcuuauacuuucuuagaaguauauguuuccuguauaucauaccaggaaacauguacgagggcacugccugauagauacaguuuauauaacucaguaacugcaaauacaguacagcccgggauauaauuagaauaauaugaaauuaauuaaggauugcuugguuaagauaauuacagagucaguaugcauaguagagcuagaaagaucugacccagagcugccacuuuuagcucaaagcuuuugaaucagucacuucucccuuaucuucuguuuucucaucuacacaaauggcauuuuugauaaaauauuuacagagaauuuaaugaaguauauaaagcauccagcauaguacuugccugagauuuaugcacuuaacaaauguuuuuuaccuuuaucagaaaugauauuagaauuucauaccacauugaugugucaaaaagaaauguaaaaaaguaucuaaggcauaaguauuaauuauuauuuauucagauaauaagagcuaaccuucaauggaagcuuucguucucugacucaugcuauauugucucucaggaaaugagcuaauuuguaauauacaaauauaaauuaauagaaaauaggaaauaaaagaagaaaaaauauaaaagaagaaaaucaagguauaaauaaagaaaauauaaauaaaauguuacauuuguaugaaguauaaauaagauuuguuucuuacauacagguaaauagaccuauauguuuguuuguuuauuaauguuaaaauuguuucuuuauauggccuauuuccugaaaacugucaaagcaauuacuguauuuuagugcucauuauuucccugugauugggagaauuuuuauucugguuucuguuuuaugagauacuuaauuuacuuauugaaagcaggugauaauuauuugaggcaauaugaugccauucugaguaacccaggaaugguuuugguaaaugugaauuuaaauagacucucuucuuucuucucuauuccuucaaccccugccaagcaaaagcuauagcccugguagguuccuuuguaggaauuaccuaacauuaccuaacaggacauuuagaacacucuucacagaaugguuuuacauacgcgugugucagugacgcucauacuguugguauucuuagcaugguccacauggcucugguaccaccuucacugcucagaaaugugggcagguaacagaaaaccuuggaugggauuaaggaugcagcaggcuuugguauccuuaggaggcuucacuguaugugugucauucucuauacuuacuauucuguuuuuuugagacggagucucccucugucacccaggcuggagugcaguggugccaucucggcucacugcaaccucugccucccggguucacgcgauuccccugccucagccucacaaguagcugggacuacaggugcaugccaccacgcccggcuaauuuuuguguuuuucguagagacgagguuucgccauguuggccaggcuggucucgaacuccugaccucaggugauccacccgccuuggucucccaaaaugcugggauuacaggcgugagcaaccacaccuggccuguacuuacuauucuuaccuacuauucuugaaaucuuauagugauuuaucuauuugaagucuucacuucuucaguguuuagcuugucauuauuaauguauuaaaucuggcacuuuuuuuuuucuuuuugagacgaagucucgcucuguugccagacuggagugcaguggcacgaucucagcucacugcaaccuccaccuccuggguucaagcaauucuccugccucagccucccaaguagcugggauuacagucauaugccaccaugcccagcuaauuuuuuauuuuuaguagagacaggguuucaccauguuggccaggguggucucgaucuccugaccucauuauccaccugccucggccucccaaagaacugggauuacaggcaucaaccaccacacccggcccaaaucugacacucuuaauaaaauauuuguugugacuaguugguaauaaaguuuccaucguagcuuuccacucccuaguugucauuacaguuuucauaugaagccuuggcuugucuuggauuuucauugagaggugucauuuuuaguaacauaguuuuuuucagagaagaucuuuauuuucuagagaauuuuuauuuuauauaagagaagauguaaucaaugauaauauagcaaggugagguuuaauuauggguuuguauggcaaguuaaugugacuaaaugaaauugucuuucaugagacucagauaugaccaggcugcaugauuuuguuuucuuauuuuucuccuuuaggaaggcacaucuucaucuggaagcaaacguuggguuucacagugggcuaguuuggcugccaaucauacaaggcaugaucaagaagaaaggauaauggaauuuucugcaccucuuccuuuagagaaugguauucucuuucucucuuucauucuuuaucccuuuuuucuucucuuucuccauuucucucucuuucucuuacucuucucugcuuuuuugugaaucauauaucaguuguuauuauaaaaaacaagccaaaucuauauaguaagaaguaaguuaaaccuaaauaaacauauucacauauucucaugcugauaaaugaauucauuuuauaaguaaaaggcugauuuuuauuagauauuguauauuuugagggauuuuaagcaggggacaaauucaaagugauaaaacucuuuuuugagaaauuuuguggacuucguaaguugagacuuccuaaggacagguggacagacaccagcuuggauuuaauauuucauuccgaggcacuuuucauuuuaguuguaaauuucugcuguugaaaauaagaaugguuuuuaaauuuugucuuuacuuuuaaaugaaaauucuuccuacucuuucugauaugcugauaucuuaagauaugauuuugacuaaugaugcagcuauuauucaaguauaaacuuaacugaagauaaggaaauaauuuuuagaugaagcauauauagguguguguauauauuacauagaaagaugaagcacauauauauuauauauauauaaguuaaaauuuaaaaauaagcugaagacagguccaaacgauuucauucauaaauacaacagauauuuauugagugccuacuucaugugguacauuuagugaaaaagaaguuaauaaucuuacaaaucuauguaguaugacuuuuauuaccuuuuauauuucugugaacagaaauauaaaggcuuuuuaaacaaaaugaaguuguguaccuucaaggauuucauuauuacuuuuuguucauuaguuuucuaauuaacaauaagacccugaaaggaggaugaggagaugauggucaaaagguacaaaaucucacuuagacagguggaagaagcuuuuuuuuuuccugaggucugcugcacagcauggugaauauaguuaauaauauaguauuguacauuuuagauguucucaucacaaaaaguguuaacucuuugaggugaugaauaugcuaaguagcuugauuuaauuauuucacauuguauuuauggucaacauuuuauacaccauaaacauauacaaauauaaauugucaacuuacaauaaacaauuaaaaaacuuauccaaguugaaaaauaaauacucacuuacaguuaaaaagcaaaaagacccucaaugagauuuuguauguggcuuuuaucuguuuucuuaauuucauuccgguugaaaauggaaauuuguuuugucucaggcuuguggcaccccaaaaaucuguuuuaagaauuuuguaaguauuagaaguauuugaggaagcuacauagcaguguacuagaaaagcuacgucauuuauuuauauuagaaucuagaaguuauugauaguaugaccaaaaauucuuuugagggaacagagucauuugguucguauaaacuguguuuaggaaacaaagaaaccagacagaaggcuagauaacuuuaccaaagaauccguuauaaaauuauuaaguauuaucugugaaaagcaaaguucuacccuuguuauaaaaaauaauagaccacuuagcuuucaugaucucauuucuaugucaucauauuuaaaugaacuuauuuacauaagcugauaaaucuacuuaaauaauaaaacguuuuuguuaagcauauugaauguauaugaggagggggcaguaugagaaauacuggaaaaauacaaaaggguaaaguagccauuacauucuagaugcuucaguuagcacuaaggagauaagauauaugaaagaagaaacaaaacaagauauaacaugauuaaugacuaaaguuaaaucuaucaguucaguauggauuuuccuccaucacauccauuguauugauaugauauuuaaauacuaaacuuuuaggauuguaaagaggaaaaaaaagacccacagaagcuauaucuaguaucuuuucuccauuuaucccuaaaagauuaggaagcuuuauauguuaauuuauauuucccugaaaagauguuucccuuuucucagaaauacauuccauuuuuaauagucaggaaaauccuuaaauauucucaaauucucucagguggaaaaaucaaaauauauauuuucucauuggcuucuacuugaaaaaaaagaaagggauuuuguauuuccauauguggcauuaauaaccagaagacuauaauuuaaaaauuccucaauuuauaaaauuuugcuauguccuaacuaugaaaagucugcuguuacauacuuacaauuuuuaaaauucuuuuaaucggcuauagauuuuuuuaaaauguuguuaaaaguucugcauuuuucacuuuacuuaggaaauccaaaauuaucauucuuucaaguagauaauacuuuuuaaaaacuaguuauguuguucuucucuacuauguaguugaaaauauagaaaauaaacaauguuuauuugacauucucuguauaaaucuacaauagauucugguuuuuugagcaaaccucaaggauggaaaguuacaaaagugagaaugaacacagugaacuucccuucuauaaaacacauuaagaggaaagaagagcaauauauuuagguuuaagaucagaugacccuuuuauaccauuaugacuauaguuaauaacaaugccuuggguauuugaaauagcugaaaguagaucuuaaauguucucaccacaaaaaagauaaguacgugagguaauggauauauuaauuagcuugacuuagccauuccauaaugguauacauauaucaaaacaucauguuauacaccacaaauauauauaauuuuugucaauucauaaauagaaaauuaaauauaugaaaggagaaaaaugaucagaugacucuaauuuucaucucauacaauuggccuuccugacuucucuaggaauugcuuauuugugcagcuugaaauuguacuuaaacuacuucgucacaaugcuggcucguuuguuuuguauacuuaagucauuuuuaacuuacaucucaaaauguaauguaauauagcuggcccucucuagccauagguuuuguauuaguggguuuugcaucugugaauucaacugaggauugaaaauauuugagaggggaaaaagaaaugauugcguccccacugaacguguguagucuuuauuuuuuuguacuuauucacuaagcaauacaguauaacaacuauuuacauagcuuuuacauuguauuagguauuauaaguaaucuagacaugauuuaaaguauaugggagggugugaguagguuauauacaaauauuauaccacuuuauauaagguacucaagcauccuugggauuugguauccugggggaauaaggggccuggaaccagucuucauggauacugacagacaacuguaugaugcuccuuuuauuuuuauuuuauuugucuuaaucaauuccuucuuugugguuuuuauuucauagagacagagaucagugagucuggcaugacagugagaaguacuggcucugcaacuuccuuggcuagccagggagagagaaggagacgaacucuuccccagcuuccaaaugaagaaaagucucuugagagccacagagcaaagguuguaacacagaggucagagauaggagaaaaacaagacacagaacuucaggagaaagaaacaccuacacagguauaccagaaagauaaacaagaugcugacagacccuugaguaaaaugaacagggcaguaaauggagagacucucaaaacugguggagauaauaaaacccuacuucacuuaggcagcucugcuccuggaaaagagaaaagugaaacugauaaggaaacuucuuugguaaagcaaacauuagcaaaacuucaacaacaagaacaaagggaggaggcucaguggacaccuacuaaauugucuuccaaaaauguuucaggucagacagauaaauguagggaggaaacuuuuaaacaagaaucacaaccuccagaaaaaaauucaggacauucuacaagcaaaggagacagaguggcacaaagugagagcaagagaagaaaagcugaggaaauucugaaaagucagacuccaaagggaggagacaagaaggaauccuccaagucauuagugcgacaagggagcuucacuauagaaaaacccagcccaaacauacccauagaacuuauuccccauauaaauaaacagacuuccucuacuccuucuucuuuagcauuaacaucugcaaguagaauacgagaaagaagugagucuuuggauccugauucuaguauggacacaacccuuauucuaaaagacacagaagcaguaauggcuuuucuagaagcuaaacuacgugaagauaauaaaacugaugaaggaccagauacucccaguuauaauagagacaauucuauuucaccagaaucugauguagauacagcuaguacaaucagucugguuacuggagaaacugaaagaaagucaacccaaaagcgaaagaguuucacuagccucuauaaagauagguguuccacagguucuccuuccaaagauguuacaaaaucaucaucuucaggugcuagggaaaaaauggaaaagaaaacaaaaagucguuccacagauguggguucaagagcagauggucguaaauuuguucaguccagugggagaauaagacagcccucaguagacuuaacagaugaugaccaaaccucuaguguaccucauucugccaucucugauauuaugucaucugaucaagaaacuuacucuuguaaaccucauggacggacuccacuuaccucagcugaugagcauguacauuccaaacuggaaggaaguaaaguaacgaaaucuaagacuucuccggugguaucugguucaucuaguaaaucaaccacccuuccaaggccacgaccuaccaggacuucccucuugcgcagagcacgacuuggugaagcuucagacagugaacuugcugaugcugacaaagcaucuguugcuucugaaguauccacaacaaguucuacaucaaaaccucccacaggaaggcguaacaucucucggauugauuuauuggcucagccucguagaacacgacuuggcucacugucagcucguagugacucugaagcaacaauuucuagaaguagugccucuucgaggaccgcagaagccaucauuagaaguggagccagacuaguaccaucagauaaauuuucuccuagaauuagagcuaacaguaucucucgacucucagacuccaaggucaaaaguaugaccucagcucauggcucugcuucagguaaauuggauccagauuucuaauagcauuagcauguuguauauuugggggcuccuuuuuuuuuuuaaaaaaaaaaguaagguucuaguugucuucccaagauacucauucaaaacaaaaguuaugauauacggggcagcggcgguggggggucuauaaaacaguuuuauuuagcauaguaaauggaaaaucagaaguuauacauacuuccaauuagaguccuggcgcaaaauagugauuucaaaacuaggaauucauugagcugauuuaggaguuuuaauuuuccaguuggugcuauauuuggaugugugugucaaaauuaaauuaucuggaaguaucugguuuaaaguauaggaauuaacauugugcuucuaaaagcauguguuuaaccuuuaaauauccucacauaauucaaagcccuuaagaacuugaagaaaagcaguauaugcuuuauuacuccuuucagaguuaaaugaaauaaucaauguuuucuuuuuuuucccuacccauuuugaaaugucucacauacuuuaccuauacuuuuuaaaguuaaaucuguuuauaguuggagcaggugaaaacuaaccuuaauuuauuucaguggaagaagauggauucauggggaaucacucagcguauauuggccaaacugggcuguagaaauuuaacugguuaugagcauuaucucacaaagugcuguuauaucauuuaacucuaguaauuagguguaauugaauauaauaacuacaaaaacuacuuacuuuccaccagaauuuaacugaugcuguuauauuuguuugcuuaugugcuuuguauucagagcugaggccauugagauacaugugugaccaaagaguaaugagguggauauuuguuuguguccuauaugcauguucucauuacuucauaaugagccucauauguggacguggcugcaaaggccagugugggaggccagcuguuacaacggacaugaagaugugugauuauuuucaguaggcagacaucuaaguaagcccuaagucuugaguuaagaguggaggggaaguugauaugaaauuucaucuuuuuauuuuugauugguuuacaucuaccacaccaucuccuacaagacccuaaaggaacaguacuuugcauaugauacuuuuuucacuuuucuuccucuuuucacugcugcuuuccuccacuccauucaccuguaucucuuugcuggucaguggguuugguaaugauggucacugucuaugguagaaauggacguagggugaagccagauagcauauaaucaugauuccaaaaaaaauagacaacauuuuccuuauuaccccaguccucauuuccacacuugaagcuuugguuggugguucacaaauuuauugccaaauauuuuaaaacuaacuacuacauuuugguuuauuuucauucuguuuuugguuauggcucuacuucaauucacauuucaucugugcugcauuuccugaugaaauuucuucugcuguacuccuuguuuuaucaccucaucuccauuaagauauguauguauuuuccugucuuaacauaauuucuauguuaccagauagcuuggaguaccucuuaacacaugaugugguuuuauuccucgauauuuaggauaaggcuugagaugcaagcuaaauaugauuacuucagcaagucuaagaaacaacuguaagaugcuauauauaaagacagauuucauuuucugcuucuuugaauacagaacuugauaaauacucaguuuucuguguccaaaaauaaccuugaauuguguaugaaauucccuaggacacauugauguauaugauuuuagucuuuucauacuuacuagcaguauauuaaauaauuagaaucauggaauuuaaaaguuagaaggguuauucucuuaagggaaccaaggccaagagaggaaauaaccugcccugggcacauggcaguggcaggggcagaauaagaaucaaagacuuuuaauccccagccuguuuuucuaccguaucuauucuagcucuaagaaauaguuucaguguuuacuuguaugcaagcuuccagaagacagcuagaaucuacuggauuauuaucaggaguauaugcaaggucaauauacaauauaaagguuuugguauuguuuacuaaaaucuuugcaguucugauguuuuacccaguuuauauucucuauuccaccuuaugaguguaaagccauauuguaaucuaggauuguauauucagauucucucaagauacccacuuauaguauuagaccuuaucuaggacaguggccaggaucuuuccuucagugagaacauacuauaauagcuguauggaaaagguggucaaacaaacaaaccuaccuguuugauuuugcuaauuuggugccuuugauauuauaacauuucuuuuuaagauaauuauaauauuuugaauggaaaaagaaaagcaaaauuuuaacuuuugaaacaugauuuaaaagaauguuaaaucaugccgaucaguguugcugugcacaguauaaacuuuaaagaccuuggaaauaaucugaaccuagcacuugugauauugucccaauuggauauguaaaaauaauuccauaauguuuccaauuccauauuuuagaugaugucucuaaaauauuuuuaggccagcacaguguuucaugccuguaaucccaguauuuuaggggaggccaaaguuagaggauuacuugagcccaggaguucaaggcugcagugagcugugaucacacuacugcauuccagccuuggacaagugagacccugucuccauuaaaaaaaaguuuuuuuuaaagaaauguaugugauaaaaauagaagauuggaaaucucagauuuagcaauaugaagagaagaguucuguauguuucucugauguaauuugcaauuugcuucuaggaguuuaacuaguuuuuuuuuccccaaaacauucuuucagugcuucuuuuuuuuuuuuuugagacggacucuugcucuuguugcccaggcuggaguguaauggcacaaucucggcuuacugcaaccucugccuccuggauucaagugauucuccugccucagccucccaaguagcugggauuacaggcgugugccaccaugcccgccuaauuuuuguauuuuuaguagaggagaggcuucaccauauugggcaggcuggucgguccucccgugucagccucccagagugcuggcauuacaggcaugagccacugcgcccagucuccuucagugauucuugauaucaaguuguaacugaaauauccagauuuauuuuggcaagauauauuuaaauuuaaagaccuugaauuaucaaaauaaagcacuugguuuucauuauguuuuaagugcacauuuuagaaaauaaaaacauuauguuaauauccuuagaauuuuuugagacuguuugcagucccuuuuuaauucuaaucuucaaaauuuauaggcaguagaaauuaaauguuagacaugcauggcuugaguuaacucuuucuccaggucaaaggacaaaacagagcauugucagcaguuuuucuccccagcugaucuuauugcugaaugcucauaaauauacauucaaaacauguuugugguaauuuuccacuaaaauauucugauauuguaugaagaugcaauguguguuuucugaagcguguuugcaaaaucuauaguuguauguuuuaaugccaacaaagaaauuggaacauucacagaaauaugauacuaacaacucuuuuuuuccuuuuuaagucucuagacaucauaaaugauaguauguuuuuguagugaauauaguaguuuaguacuacaacacaagagggaauguugccuauuuuauaauuaaaaaauaaauuuuguaaugaaugcuguagcucuagcuacaagcuuaaucaagcccaucuuggaacuuucauuuuaauauauaugcugucuaggccuuuacuaacgaauaagucucuuagagauaggcauuucagacaccuuccaaugccuuaguaauaucaacccaucaaaugagccuaauaauauauuaagaaaaucaaauuuauuuuuauaaauuguuacuuaagcugaauaaaauucaagagaaagaaauaaauuuuuucuucaacacagguagauaucagaaaaacuaucauuacaugagaaauuuaggaugucuuuuuaaaacaacuuggcugggcacagcgucucaugacuauaauccuaggacuuugggaggcugaggcagaugguuuaccugaugucaggaguucgagaucagccuggccaacauggugaaacuccgucucuacuaaaacuacaaaaauuagccagacaugguggcaggugccuguaauuccagcuacucuggaggcugaggcaggagaauugcuugaaccugggagguggagauugcagugagccaagauggcgccauugcccuccagccugggugacagagggagacuccaucucaaaaacacacacacacacacacacacacacacacacacacacaaaaccggaaacaaaaauguagaauguauacaacacuuggaauaacagagaauucguuuugaacucugggaguccauagaccuggcuuauacuuugauuucagcaagguaagaccucucugggccuguuucuucucuuuaaauggaagaauuuagacucaugucaaaggccauucuucuaaaauuuuaugaaauaaguagauggggggaaauuuaaaauauuuuaacuugaaguuuauuugguguuaauuagcaggugauagggaauuuucuuuagaagaaaaaagguuagguagcugcuauaguuuggaagcaaauguuaagaaagaaaguuuugaaauaaauucuuugagaaauaacagguuagagggccuagcauugaacucccuuucccagucccuucuccaccaguagccaucauuucacucagucucagcucugcucuuugucguuacgcagacuguguccagaguuaacuggagcuuuucuucauagcaucccaugugugauauguuuuccacuggcaaagggagcucuuaauuacuuaaugauuuuuaaucacauuuuuauuucucugcuguaugcugauuauccaguuuccuccucaauuuuaaagaacauaccuaaagauguuaccuuuuacuuuuuaaaauaugcuguauucguuugauuuuuuucuuuuuguuuuguuuuuguuuuugagauggagucuggcucugucaccaggccacagugcaguggugcgaucucagcucacugcacccuccgacuccaggguucacguaauucuccucucuuagccucccgaguagcugggauuacaggcgcgcccuaccacgccuggcuaauuuuuguauuuuuaguagagaugggguuucaccauguuggccaggagggucccgaucucuugaccuugugauccucccaccucagccucccaaagugcugggauuacaggcguuaguuagccacugugcccggccccugauugcuuuuaaaagauauuauuaguagcuuuacuauucuuacugacuucuagguagaccagccuaugaaaagagauggaaaguuugugaaaaggaaguuuuucucguacuuuuuuccucaaaauguaauugcauuuugauccuaagcucagacuauuaaaaguugauucuagcauggcucuacuuauaugugaucaccugacauuuaacguauauuaauagcacuugguacucaauuucuccuucugcuuucauguagucugccacgaaauguaucagccaucgaugccauucuuucuaaguuaccucaaaauuaacugucugaguuuuaucauacuuacguuuucauauguucugcaguuauuaaagcucuuuguuaauugcuuuucuuuucucucuaguuuccaaucauauguauagugaccauaguugccucaucaaaaaucagaacauuugauguaacaaaugauuuuuuucuuauuuaugaacacuauuguaagauagcacaagaaacacacauuuagcauuuaaugaaauguuuuuuugaaacguacaaauuuguuuacacuauuucugauuuugccugccguauuucuuaauuuuuuucuaaaccucuuuacucuuguucuaaacuuuuccuaaaauugguuucaagucucaggaucacuucaacucacagaaguuuuuuuaucuagaaaugagcacauuaucaccaugguaaaaguauuaucuauguuaauaaauuaucuuacaguguuaaaaucagaaauuauauuuaagcuccucaaaaaaggucuaugacuaauuaccuaguauaugcauuugcauacacuuuuacagagagccaugaacuuucugcauauguucauucugucauaccuaugaaugaaucuaguuccaaacaucaggaucuguaaauaggggugugaauaaggacgaaucgauaggcucuaauuuauggcauauuccucguuguagaguucucuguuucuuaagccaguucugguggcaauauaugccaguuuuaucugagagcaaccucagccuuagagauccccagcugaaaauguaguuuuuggaggaaaagacauaaaaggcauaaaauuagaguggaggaauuucuggauucugugcagcuuagggucaguuucuauuaaaaaggaagaagaugcuaagguuuuuucacuuuaaacaccaauaacauuuaaugcuuuucacuagguuucggaaaaguaaauguuuacauccaggaauucuuacauuuuuuucaaaaauauuuguuaaacauuugcuagccaacacucagcuaagugcuagguauacauuauuggauuaaacagacaugguuccugcccuuguuagguuuaccaggaauuagccauuaucucucuuuuuaccucuauuuaugcuucacaaauuauuuguauguuugauucucauauuaacaguaguaaagugucugccuugucuucugauuuuuuaaaugugugagcaauaccauuuuuuaaugucuuuacuaacuguaaauaagaaagugauugccacuuucuuuaaugugacucuucacaguaucuccugugccuucagugucaaugguugugacaaaagcuuguacaguuuugcuuuuuguagauuuuaugccauugucuauuuucaccauaugcuuucagugucaaagcagcagagaguuguacugaagaugcuuuguuguguuuuuuuaccacguaaaaagauuuuuuccaaccauagcguaacaggauguugaaugacagagguaauguuuuuuuuucugccauaaaggcauaauuuccacagccggaauuaugcacaucuguauguugggaaaagagaguuuuuaccaucuccauguugaaaguccauguggcaugaggaaaucuuuucccuuguuuuuauuuuuguugucguugauguuguuacugucuuuuuuuuuuugaaaaauucauauuuucacucaaguaagaaauauuugcaauugaaaaguacuccaguuaaacaucgauggauagagcuugcuuaguuguuuaucauuagcgaaauuuuucaucugaauguuuacucaccacacuauggaaaacauggucuuccaauuguuuuugauucuucauuguuuuuaauucaccgaaguguaauguuucuaucucuaaggaguaguagacuuaugguuuuugugagguauguguacgucaguuauugaaaauugugccgugugugcgcucucaugguguuuugaagucaugacuuuuauuuuaccuccuuuaaaugauaacauaauaauucuuuuuuuaauaauuaaacuaauuuaguaaauucaagauggaggcgcuuuccuacugauuaugcuuccaccucagaagaugaauuuggaucaaaccguaauuccccuaaacauacccgucuacguacuucuccagcccugaaaaccacucgcuugcagagcgcuggaucagcaaugccuacuaguucuucauucaaacaccggauuaaagagcaggaagacuacauccgagauuggacugcucaucgagaagagauagccagguugguuuucaggacuuaucuuuaagaauucaaaauuucuaugaacauuacaacuugguaacaaaguuuagcuuguacuugauuuuuacuaauagucuaagaacugaaauccacagauaacugugaacuccguuuagucaguaguauuacucucuauccagcuuuuuuucuuuuuuuucuaugccuauaccacuaacauauuguagaauuaauuuauuuugaccuuuucugucucccccccucccuuuuuaagaauuucuuuuaaagauggugauaaguaagugaaacuuugaaagguaggcaguaucagaucuacauaauuaagaacugcaggcaauuuauggauuacuuuccuuuaaacuuccaaagauguaauaguauaccuuuuagagauguggcuacugcucucuggagagaauuaggguaagcagauuuucacucauacuuuaugagcucauuaaguaugggcaguucaaccguuuaguaaguaaaacaaaauaugacuauuuugaagauuaaaucuguuuauaguaaccuuuagauuauguacaaaaaaaauuuaugcugcagauaugauuuuuaauuaauaacuuauggaaauuaauaacuuacuauggcugaacuuugaagagagauuauacucaagcagauacuauaguaguuaaaauauaaggauuuuuuguuuaaaguuugugagauguuagauuuuacugcaguauaccauauguuaccuaaacauuuucacuguauacauacuaagcuuacuucugucuuuaagaccuuaaucuucaaguuguauacuugaggacauuauuaaagaguuuauacauaauauuucauagaugcuuuuaaaaaacaagaaacuuuuacucuauguuaauguucaucuuuuuuguucuuuauuucauugacuucugugaauuguguuuuuucuggcucauugguuugauguaauguuuaguuuuuuauuuuuaaagacuauucacuugucaucgcuuuuauucuuggagagaacaugccuuucuaaucucaucgugcugcuuaaaacauuuuugcuuuaucauacaaauagcuuuuuaggagaguaauuaaugaagcauuuuaagccaguuguucuaguuagaggaaaggcauauauguacuuugggauccauggaucauuaugggccaacaaaaugcuuguagugagagcaucuugacacauuuuuuuguacuuccaggcgcugcuagcaacaacaggucuuacucuugucucaucauuuuuccccuucccuugaaaaagauguccagcuacacaagauccaguggugccuguaugucuagaugccuccuggcaggaggccuccucucucaagcucccucuaccccaaacuagaaagacuaaaaaccuucuucugagccaaauacacuucccuacccccaaauaaaaaaacaguuguaauacaaagagaagagggaauaagggcuauacacuguauuuucacuugguuccauuuugcuaugugcauaguguuacuauuaucaauguguacuuuuuauuaucuauggcaggacuuuaagaacaggcuauuuaaccuacagugauguucaugccuuaucccucuaguuugucaguagcacuaugcuaauaaaacuugccuuugggauuuuaauuuuucaaguuauacuuucuagcuauauaucucaaagccagagaagugguuuuuuuguuuguuuuauguggagaaaaaaggagggugguggaaggaaggaaagauacaaaauauggaaggaaauguggauauuuaauguuucuauagagcagugauaaguuugcuuagggugagaaaauguauuuucaaauggcuaugaaucacaaacuaaguagaauaugagaaauaauuuuauuuauuuaaaugaacuacugucaccuaaaagacuccugugcugagagcaauauuugaagaguaauagauaaagacacuuuuauuugaaaaagauaauagugauuuuuaauuuauuacaaaaauguuuuaugcuuuagcauacucuuucuguuuagaauuuaggacuauuucacuugaucagcacuuuguuaaucuguacauaguaacuguuuaccugcauuuaaauuuaaagcacaaaagcaagcuccauuuagaauaugaaguguauaagcgagauauggcauauuuggucuucaguuugaugagggaagguuucuuucagguaucccugaugcauaugcuuugguagcuccugccucaguuucucuguuaugaaaacagauauugacuuccaucgaguaggaauguaagacaugaugcagguuuuuaugaauauuaggguaaacagagcuacaauaccagcuuuacagauaaccaaaugaaauacauucaaccuaaaaauuauacuggaagauuaucuacaguaacaccucgaagauaguacagguuugguuucagaccgcuauaguaaggcaaauaucucaaagcaagucacacaguuuuuuuuuccuagugcauguaaaaauuauguucacacuauacugugugcaguaacacugcuucuuaaaaaaaguauauaccuaaacaaguaaauauuuuauuaguaaaaaacaguagugaucaucugagccuucaguaagucaucagcuuuuuguuggcauagggucuuacaucccugcugaugacuguggacuuauucaagggcagugguugcugaaggcugggaugacuguggcgauuucuuaauuaaaagaagacaacagugaagucugccacguugauugacucuuccuuucaugaaagauuuccuuguagcaaugugaugcuguuugauagcauuuuacccagaguagaacuucuuucaaaacugcagucaguccucccagacccugccgcuggcuuaucgacugaguuuauguaauauucugaauccuuuguugucaucucaacagugcucacaacagcuucaccaguagauucuauugcaagauaccacuuucuuuucccauccauaagaagcaacuucucaucuguuaauguuuuaucacgagauugcagcaauccagucccauauucaggcuucacuucuaacucuagucuuucuaguucuguuucuguuuccaccauaucugcagugacuuccuccacugaagucuugaacccucaaagucauccaugaggguuggaaucaguuucuuccaaacuccgguuaaucuugauauuuuuaccuccuccaugaaucacagaaguccuuaauggcauguagaauggugaauccuuuccaaaagauuuucaguuuacuuuguccagaucuauuagaggaaucauuaccuaugacagcuaugucuugcaaaauguuauuucuuaaauaaaggaauacauuuucugcuuagaagacaaaacgggccaggcacggugguucacgccuguaaucccagcacuuugggaggccgaggcaggcagaucacgaggucaggagauagagaccauccuggcuaacacggugaaaccccgucucuacuagaaauagaaaaaauuagcugggcauggugguacgugccuguagucccagcuacucgggaggcugaggcaggagaauuguuugaauccgggaggcagagguugcagugagccgagauugugccgcugcacuccagccugggugacagagcgagacucuaucucaaaaaaaaaaaaaaaaaaaaaaaaaaaauggcugggcgcgguggcucacgccuggaaucccagcacuuugggagguugaggcggguggaucacgaggucaggagauugagacgaucuuggcuaacauggugaaaccccaucucuacuaaaaauacaaaaaauuagccgggcgugguggcgggcgccuguagucucagcuacccuggaggcugaggcaagagaauggcgugaacccaggaggcggagcuugcagugacccgagauggcgccacugcacuccagccugggcgacagagcgagacuccgucucaaaaaaaaaaaaaaaaaucaaaauggcuccuugauccaugggcugcagaauggauguuagcagguaugaaagcaacauuaaucaccguguacaucuccaucagagcucuuagguaaccagguacauuguccaugagcaguaauauuuugcaaauaaucauuuuuuucugagcaguaugucucuacaguggucuuaaaauauuuaguaaaccacacuguaaauaugccauaauccaggcuuuauuguuccauuuguagagcacaagcagaguagauuuagcauaauucuuaagggcccuaugacuuuuggaauggaaaaugagcauuggcuuccaacauaaagucaccagcuacauuaaccccuaacaagagagucagccuguccuuugaagcuuugaagcugggcauugccuucucucuggcucugaaaguccuagauggcaucuucuuccaauagaaggcuguuuuaucaacauugaaaaucaguuguuauuauaaccaucuuaaucaauuaucuuagcuagaucuucuggauaaguugcuacagcuucuauaucagcacuugcugcuucucugugcacuuucauguuagggggaugguuucguuccuuaagccucaugaaccaaccucugcaaacuuuucuucugcaguuuccucaccucugucagcauucacagaauugaagagaguucagauuuugcucuggauuaguuuggcuuaagggaauguuguggcugguuugaucuucuauccagaccacucagaccuuguccauaucagcauuaggcuguuuugcuuucuuaucauuccuguguucacuagaguagcacuuuuaauuuacuucaagaacuuuuccuuugcauucacaacuuggcuguauggcacaagaggccuagcuuuugaugauugccagaauaguaagacagaauuuaaaaugguuccaugguugaucagaugggagauuagugggaguagggaacacaaaaggcaugggaaaagaagauagguuguauuuuggucauacugacaccaacaugccuaaaggauagcccugugaaaaaagcuagcagacaguugaacugcggcugugaaacaggaagccgugagggcuagacucaucguuguagucauucguaaagaguaaauacuuggagcuauuguaguagaugguaucaccacggaauggugagggagcugcaaaugcggcugaacucugagauaaccucagugacagggaugugguguagcugaauggugaagaauauggacucuggacucagaccauauucuuggucugagauucaaacccaacucgaccacaaggucugugugaccuaggaugaguuaauuaaauguguucuagugaucucaucgguaaaauggacguaauggugccaaccugagagagucgacaaguugaugcacauacuuaaccuagugcuugacauauagucaguagucaauaaauguuauauuuaagagggauacagagaaaaccgugguuuaugauuauaguuagaacuuuauuuggagcuuuuaauuuuguguagaucucacacguuuaaauuuaugagaauccagauauaauuggaauuucagaaucagcauuacauucuacaguuuauaaaaugcugggcuuaccuuauuugugcuuaagaaucccagccaaugcuuuguucaaauuuccguccaaacuuauuuauuaaaaaauuuuuuguccuccuaguaaaaacagugguauauaaguaguuuguuuuuuaauauuaaagugaucguuaaauagcugugucagcugggcgggguggcucacgccuguaaucccagcacuugggaggccaaggcaggcggaucaccugaggucaggaguuggagaccagccugggcaacauggugaaaccccaucucuacuaaaaauacaaaaauuagccgggugugauggcaugcaccuguaaucccagcuacucggguggcugaggcaggagaaucguugaaacuugggaagcggagguugcagugagccgagaucacgccacugcacuccagccagggugacagagcgagauucugucuaaaaaauagauguaucacggaacaccuaucagucucguucccugauuuguuggccccaaaugaaacucacuuggcauuguaagacaaaaagcuuuuauuauuacuaagucuuuuacacauaauuuuauuagugaaauucaaguaaaaagaauacugaucaaauauauuugaaaacauuuuaaaauagaacugugguuuauguuuuucaaagccuaaaauauguacaguuaaaguuaugaaugagugauaaucuuaacaguaaaaaaccaaauuacuuguaauuuuacuacauuauuaaaagcuuugugcuuuuauuguuuuguugguaggaaccaauuuaauuuaguugucagaauucaaugguguggguuuucuuauugucuguaagguaauauaaugcuuuucuguguauugcaauucagcuaacaagucuucaauuauaauauaauugaaggauauacuacauuuuggguuguaauuggaggugagcuuugauaauaccaaaauguuuuuuguuuuggagaaaauauuauggauauaaaaacuacccuaaucaagcaauaaggcauaucugccaagucaguuugaagacaucauuuguggauugauaauaucucaagucuaggcccuguuauuuuguugggcuaggucagauccaaacagcaagaguagggaaauaaaccaccugcccacagguucagaugacagugauucuucaguuucucuguaguuuuccacauuuccuagaacuucauuauuccuuccucauagucuguaccuaagucucuaaaaauacucuggcuaucucaggucuuguuuauugaguaaauacuuugcugucagauggcgucagaccaucuucuuuuaaccugccgauuuugucucugguggagauagcauagguuugcuaaaaccuuuaaaguuauccucuuaauuacaucuuuauuugugacugccucugcuuaucugaagcauauucaucagucuaguuucgagacuagaaucuuucuacauuuuaccaaauguaacuuaucuguagcgauaaacauuucauucacaauaaugggaggugccuuuaaaaaaauuaaaucucuaucucuuuugauggcuagaaguagacuccauguacuuuauucaaacugcuuuucuaaucaggccacucauuaaauugcucuugcugcccaaaagaaaccuccaauuucaacucauuauuaucccauccuaaaucuuuuguggcucaguguaacucuuucccaguucuccauacuuuuguugcauaaagaaugggguuugccaaauuuuuuucauuaaggucuucuauuauugaaucaaaaugccacuaacaucuaacaaauuaacugacaguuuccacugauggaagagaaagaucuuuccuuaucauuaggaaacuuuuuuuugugaaccuucuuuauaguugguauguaagucaaauauaugaguuaaucaauacaugaauuaaacuuugagccucuugccuggacuucuuauucuuuauuguacugugagaucauggaaucauucauaacuauugcuuuguaaauacuaaauaaauuuuuaaaauuauguuauuuuauuuugagacagagucucacugucacccaggcugaaguguaguggcgcgaucucagcucacugcaaccucugccucccagguucaagcaauucuugugccucagcguccugaguagcugggauuacggguguacaccaccaugccuugcuaauuuuuuuuguauuuuuaguagagaugggguuucaccauguuggccaggcuggucucaaacuccugagcucaggugauccgcccaccucggccucccaaagugcuaggauuacaggcaugagccaccgcgcccagcugauacugauaccaaauaaauuuuguugaauaaaugaugccuagagucuucccaaauuugucuaugucuccuuuguuuuuuguuguuguuguuuuguuggauuuuuuuugagacagagucucacauucuguugcccaggcuggaguauaguggcaugaucucggcucacugcaaccuccaccucccaaguucaaaggauucuccugccucagccucccgaguagcugggacuacaggcgcaugccaccaugccuggcuaauuuuuuguaaaaguagagacaggguuucaccauguuggccagacuauucuugaacuccugaccucaagugauccaccugccucagccucccaaagugcugagauuacaggcgugagccacugugcccagccucuuuuguuuuuuaaaagauaccuagcucguuaucaguaggcccugaauaguuuaaaugcuuaagauuccaaauugaaaauuuuuaagucaaacucuaaaaauuuuuacguagaaguuccuugucuuagccccauuuuuaccuagcuacaguuaauuuuuuugggaaaaaaauuaggaugugagaaauuguauuucuguuuuaucauaauagcauuauucacuguauaagauacagucauccaguaaugaaacauuucaaggauccauauauggaagucaguauugcuuguuuauauucacaccugcauauguugauuucauuauacaauauuuuaccucauuuugaaagucaugguuuaagauacagaacucaugugaaucacauuucuaggaaaccuuaagugaauuucuuaagaucugcuugagcuguuuacagugguaacacaucuguaugaaaggcaugucaagaagaacugaagaugagauguggcuucacaacaagccaaaggcuguauuaaaauuaugugcugucuaauaaaaaagaaagaagauauccaguuaaguggcagaauagcauaaaugugguuauguucauugcuuuuaacagcugagaaaaauaaucuugaauaaugggccaaaaccaggaaaaggcuucaggggaaaauguaguuacaaguauuuacaaggcauguacauuuuuuaaaauuauagccuuaucacauuaaagccacaucuggguacuuuuuuauauacuaauaaaaauacuguauuuuuauuuguaggcaguguaguaauaagaauacugucuuuuauuuggagauagcauuuccaaguauguauuugacuuugcuaagcauucaugcuucguagccaaugauacugagcauuccaucuggagugccucuagaugggggauucacaauuggucuuuacugguuaggggggauucacaauuggucuuuacugguuaggggggauucacaauuggucuucacugguuagggaacaucuagaacuuuuugcucaugcacaaaguaaaaaccuuacaugugcuguuauauaagucccguuggugccugcauucguguacuuuuuaacuugacuucuuaccgccucugugugcuaguauagggucucuuacaaguguacuuuuuccugcauuguauaagcaaugagaauuuuaaaugaagugaaguuaauuugcuaauaucucggguuuuuuuuuuuuuuucuucccaugccuuguaaaccuugaaccacuauacuuguucuauuugaggugcaggggagagcaugagugaguaaucacuuagaaggaaaaauacaagcuaaaccaaauacuuaaugaaacaaaauuuguuuuuacccauggaaauaaaaaacauuuuuuagccacaugcuuaugaauuuuuacuuuauaccugccuuugaaauuuuggggccugauacaggauccuugacucuuuaaaaauaauauggcucuucauuauuuggcugacuggcuuuuauaccauuagaaggaauugggaaggagaggggucgcuaaucucuucugcguucuucgcgaaucucauucccgugaccucuguucagauuaaaagucucccuggugcauccuauuauaaaucauacuuuuuuaugaaucgcugaccauauuugucaccauuggggaggcaaauaaaccuaaaacacagagccuguguuccaaacgaguucauaauuuauacaaggauuaaaagcuaauucauaucauucuuacaccuuuacauccucacagcuuagcucccacuuacaagugagaacaugugguguuugauuuuccauuccugaauuacuucacuuagaauaauugacguuagacuuuuuuuuccuuauauuuucuuuuuccaguuuuccugaguaccuuucauuugauauccccucuuuccucuuacaaaacuuuuuuugcuuacuaaacucuucuagauaguguggaaaccaugagcuuuucuggaaugacccuuaaaugucucuccuuaaacucauuuuacauuuuaacacuucuggucauuuacaaacuagacuaaauuauuucuugaaagcugagucauuacaguuaugaucucuuagcccauguuaaaguaacaggagguuugacuugcggucauaagcuuugguuuuaggauucuaaagcuaguauacuucauuaauagcccaccaguugcuuuuuuccaguaauaucaaaggaaacuuaauuccagagguucauguguguauccucuggaaaguuuuacauguaaaaacguuugaaaaugaaugugcuaucaaaaaauagggcaaauuuuuggcugggcguaguggcucacgccuguaaucccagcucuuugggagaccaaggcgggcggaucacaaggucaagagaucgagaccauccuggccaacauggugaaaccucauugcuacuaaaaauaccaaaauuagccgggcgugguggugcacgccuguaauccuggcuacucgguagucugaggcaggagaaucacuugaauccaggaggcagagguugcagugagcugagauugcaccacugcacuccaaccuggcaacagagugagaguccaccucaaaaaauaauaauaaggcaaauuuuuaaauagcuaauuuaaaacaauguuuuguuggcaguuuaaaucaaugaagucugauaguuuguuucuacuauaguuguaauaauauauaaucuugcaaagauuguguguuuaauuggguauacacauaacuagaacucuaauuuuuaauauauccuuuaaucuuccaauauacccaaauguacaauuauuuuuuccaguauacaacccuucagugaaaaaaaaguguuaugacugagauaauuuacauaggaaaauuauaaacuuuaugacuuaaaguacauuucucauguuaucucaccauuuuuucuuaaguaaugcauacuuauuucuacagaauuguugaaauugagucagugguucugacacuugggaaaacauaaagacuaggacuaaugcuagagaacugaacccuucuguuuuguuccuucagcacuauuuucuuauccauauuuuguaauaaaauggaauuaaaugugaaaauaucuauuagguuuucaaaucaacaauauauguuguauauacguuaagaauugcucauuuuaauacauauuuuacuauaucacauguggagauugcuguuguccauguuuuuucuaauuaauuuauacuguuuuccacaaauauuagaaacuucauuguacagaucgucugcauaaaaaauccuuaaugaaaaauagaguuuuggauacaaugaugcuuaucuguauuuuaucucauuaagcuugguuauucuguuucuuauucuaguucauuuauuuuggggaauugcaaggauuugcuauauuauauaagggaacacuuuaaacacauuucaaaagaaucacaucaacaguuaauauguuuuaaaaaauuauauauggagcaaucaugugagauguagcaugacauagugaaaagaucuaguuauggcacuuaacuaugugugaccuuggccaaaaaaauggucgcaugucuucuccugugccucauuuuccucaucuguagaacaagaugauuaauacuucucuuacagagugguugugggaauuaaaugaguugaggacuaugaagcugcuuuauaauguacucaucauauuauaauggugccuucuguguauucuaagcuucauggggacaaggacccugucugcuucuucauugcuguagucuuuaggacuuagcacagugccuggcacaucauaagcaaucaguaaauauuuguugguguuuuuccugccucuuuguguugauaaauaaaugaggaauuaacugacguuuuuacaaaguuuauauauugaccauaaauugguucuguugguccauaaacuucaacuuaguucccuuuuuaaaucuaaauuuuuauguaauuacuaaugugcuugaaagucuuucaaacucacauuuugcauaaguuuaaaaaauguuacuuuaagccaggcaugugucuguaaucuuagcuauuugggaggcugagucggaggauugcuugaacucaggaguucgagaccagccugggcaauauaaccagaccuccuaggcucuuuuuuuuuuuuuucuuuuuaaguuacuuuguauuuccuuuggauuuugaaguugcagaaacuuucauauauacuuuuaauaauauucugucauuccaaaaccuucccuguggaaauagccacaucgaguuuaugggcaguagaugcagcuuggaaaacguuaaugucuuauugaaaugaaauguuucucaaaaaacaagaauaucagugguagguuuuguaaguuugucccucuuaaaaaaaacucuaaaagaaaaaucucuauuuucaccuuugauuaucacagguaacaguuauuuaguucuucaguccauguagguaaaaaugcaaauggcuuuauggaaaugaguacuaaagcuuggauccaguccugccuuagcuacaucuaaaggugugaucaugagcaagccauucagguucucugagauugugauaaagucagaugaauccuaccucaaaagaacuuugugggccucaagugacauaacauguacuagaaagugcugugcauaguguaaagugcucuacgaaagagugcaggguucuuaauuucuugguacuguagaccccuuugcccauuuugugaagcuuguagggcccuucucagguguaaacauaaaagaauuacaaagaaauccaauuauauugaaauucaguuaucaaaauauuugaaaguaagaguaauuuaugguucuuuauuaacauuaaauaaaauguuauuauuguguguuuaaugacuucaguaguuuugaagcagugaugaccauaaaugauguuuaaauauacccguagcaacuguaaugugaucucuauugaugacaaaaaucaccaguauugcuaauaccacugugauuuguugccuguauuuauaauugaaagaaaugcuaagcgucacuuagagguuagugaauacauuguaauuguuuuuucucauuuaaguucaugaacugcuugaauucuauccauuauuccccaaguuuaagaccccugugauguauuaaugcuagucauuaacacaguguguguuaagggcauagcucuacucaagggcuuuuaaaguacauuuuucaaggugauaucuuguagguuauuuggaguuuaguuucauuaaucuuaauuuuggaauuaagguuuaagacugauuaucaaaauaguuaauaguuaauuugggguacaaauauuuaauuagauauacaacuuacaugacugauuaucucauaaaugauuguuuuuagagcuguuuauuuaaaagggauuaaacuucuuuucuaaaauuauuaccaggaucagccaagaucuugcucucauugcucgggagaucaacgauguagcaggagagauagauucagugacuucaucaggcacugccccuaguaccacaguaagcacugcugccaccaccccuggcucugccauagacacuagagaagagguaggagaucuucauggagaaaugcauaagguucuuucuuuucuuuauuucuuuugcuuuuagcuuuuugcuuaguuuauuucaguuauguccacccucccuguuugcaugaagcucugcauuuuccaacuuugcuuuaacaguuuauuuuauguuuuuguaacaaaacuagugaaggcuaacauuuggucuacuauuaacacgaagcuggaaaauucuuuagaaacagcauuuugccugcuaauucuugguccauagcuucacuugaaacaugaauauaaaugguauuuugaaaagcaacccaaaauuugauaaaugaugguauaaaguuucuauaaaguuugacuaugaaaaugcuccaauuaaaaauauuuuuaucacuaguuaacuagaagauacucugauaacaaagagaaaaauccuacaguuucacugcuuuaauaauucuguugauaaauacaaacacauacacauaaagauauuuugaaaaauugaaauacauauguaauauacacacauauaaauacauauucagaacauuuucauaaagucuggaaugcaaguuaccauguauagacuauuacccauccaauaucagggccucuuacaguauaacuccaggaggcaccauuugcauaacauugcuccagacagcaccuuuaacauguaauacaaaauuaaugguacucuuuggccauguuggcugcuuugauuuggggcagaaauguaagcaaaggauuggcauuuaaaagaaugaacuucuguguuuggagguuggcaaacuggccuugcugccaguuuuaauacagaccaaagaacuaggaaugguuuuuacauuuuugaauggcaggaaaaaacaucuaaagaauacuaauucgcaacaugaaaauuacaugaaauucaaauuuugguauucauaaauaaaguuuuauuagaacacagccacacuuauuuaacuaucaucuauggcuguuucuuugcuacaggggcagaacugaguaguugagacagagauuguauggcugcaaagccugagguuuuauuaucugucucuuuauaaauaaaaguuugccagccccugguauugauuauucugcuucuucaauuuuacaagauaauccuaaauaguaggcaaaaauggcuagccuuuuugacaaauuuaauugugguaaacugugcuaauaauauuuucuucauuugcuuuuugucacauucuuuaaucugauucuuuaauggucacuuuuuuguuuguuuuccuucaauguguuguuuaacuuaauaaaugauacuucaucaaucuguguagaguuuuguuaccacauugaucaaauguaacuguaaaugaaaucauccuuauugaugaaaaccuuaaggaucguccugguggcaagacauacacaauucuucugguacauuuaaaauguugaagauauuauuuucucagcuuucuaacuaaauuuuaccuaacaugauuauacauucacucagacccaguaaaauuacuuaaacauuucauugaauaaacuuuauuuucuuuuuguuuuauuucagaauauuguacuagguugagucccucuucaguaaacccgaguuacuuaguauuguaugucugugauuugcacuauagauggcaguauaucauuucuauuagaauguguaacuucuauagcauuguuaaaaguuuauuugacuaagaucaaaauauuuauuuuguggauuaaaaaauauuuuccuuuuguaaacuuaauuggaauuugcaauuuauguaucuugugaagaaauuugacaccuggauuuggggaggaaaaaacaagauaggaaacuaaaagaaaaagaaacauuauuuuacacugguaaggcaaugugaguaaaaugaacucauuguccaucuacauggcucagcuuuuuuucuauuuaccaucuguuuuccauuuggagaaaaucuuauccauggaagaauuaaauuuaacauaguuauauauuuuggauuuugaaaauaaaaccuguguagaugaaucucgauuuuauaaaggaaauacauuugaagugcuuauaaaaagaaagaguaauugguuuauugaagauguugugccucuguuacuacuugagaauggaauaacuucugucuaaucauaaaaauuguaaugccaauauugguacuuuuucaaauuacuguguucucauaaagguuugcuuucgucccauuaguugguugaucguguuuuugaugaaagccucaacuuccgaaagauuccuccauuaguucauuccaaaacaccagaaggaaacaacggucgaucuggugauccaagaccucaagcagcagagccucccgaucacuuaacaauuacaaggcggagaaccuggagcagggaugaaguaaguaaacuauaaauuuuaacauguggcagaagcagcauauuccauaaguaagaaaaggaggaaccauucagugaguagggcuggggaaaaagugauucuccuuaaugaaugcaaugaaauuucaccaugacaucacaucauauacaaauaauuaugucacuuagagguuagcgaaaauaauacuguaauuguuuuuucucauuuaaguucaugaauaugaauuuaguucuuaaauucauucucuaaaugaauuuaguucuuaaugcaugaaaaacuguaaaacuuuuacuuaaaaaauacagacaaauaucuuucaauauuguacuagggagugauuucuuaagagaaacacaaacuuuuggccuuagaaaauugagacauuugaguauauuaaaauuaaggacuuuuucuuuauuaaaaaauaaagaagguagaaauacaaguuacaaacuuuugcaaaacauacagccuaugaaggauuaguauacaguauauauaaaaaacucccuccaaucaauuaaaaaacacaauagaaaaaucugcaaagacgugaacaacauuucaccaaagagaaaauaccgaggcgggcagaucaccugaggucaggaguuucagaccagccuggccaacauggugaaacuccgucucuacuacaaauaagaaaauuagccgggcgugguggcaugugccuguaaucccagcuacucaggaggcugaggcaggagaaucacuugaacccgggaggcagagguugcagugagcugaacccacaccacugcacuccagccugggugacagagugagacucugucuccaaaaaaaaaaaaagaaaaagaaaauacuuaaggccuacaaaacaugaagagaaguuuaacuuaacaagcauucagagaaacgcaugucaagacuacagugagauuauaaucauucaauuguugacauguuaaagucuuaaaauguuaaguauuggaggaaagguagcuacauaggcuuucuuaugugugguugguggagguuaaguuggugccgcagcucuggaaaacaguuugacacuaucuccuaaaguugaaaauaaagacaucacaugaucuagcaauuuucuugcuaguauauguacaagaaaaacccuuucccauugacaguagaaguuacauuuauaguaacauuguugacaguaucaaaaacuuggaaacuguuuacaucagcugaaaagugaauguauaaacugguauauucccaaauugaacaauaauagaguaauaaaaaacucaaagauauaaaggaguuucuucauaaaagaaugguuauuucaaauacuacuguggaaagaggugauuuaugaacaacacacagaggugguauaggcuuaagggcuggguagaggaauaauguagaaagaaacaguugaccagaagagauugaucauagauuaauaucuguggaucccuggauuuaggaauaagaucuugagauuauuauguaagaauauguauguuucucaugguacugaguagaaaaagaucuaccugguagaaaaguaugcaacuagcccgaaaguuacaacugaaguauacuaaaacguuuuacagcauacuugaucuguccuggccuaauaguugauuuguucuugguaucaggaaaagagccuauucucuaaacuuacucauaaucauucugucccgaugucuaggaagacaaauuucuccaaacauaauaaaaaacuauguggaagaaguguauguuuuuaaagagaauggaaacaucuagauugauaguuaucucaagguugauaucaggaauuuauuuaauacuuugugacaacaaacuaaacuucaugagcaaagaaaagagaaauauccuauucuguguugcaauguuuccuuagacucuccugcccuuucucaugccuuccuaauuuguauaugucuuccauccuuauuugauuguuuucuuaaggcccacaaaaaccauuuugcuuauuuauccuuuccuugacaauguuauuuuucacaaccuaaauaaacuuuuauuacccacuaaauucaaauccuugucauucugaaguuaguucacguuuuuccaugaucacuuccuuauuuaugccacucaucaaugaacucucuuucauuagaauucuuuuuuuuuuuuuuuuuuaauuuugagagggagucucgcuuugucaccaggccggagggcaguggugcuaucuccgcccacugcaaccucugccucccagguucaagcaauuccccugccuuagccucccgaguagcugggacuacaggcacgcaccagcacgccccgcuaauuuuuguauuuuuaguagagaugggguuucaccauguuggccaggauggucucgaucuccugaccucgugauccacccaccccagccucccaaagugcugggauuacaggcgugagccacugcgcccggccucauuagaauucuugcagcacugagucccaaaauuuaugugaacgucucuuguuuuguaggccuuaggcuuuaugauaaaacauguaaucguauucccuguauauuaccgucaccucucccaguggucuuuaaaccuuuuugccuucuagggccuuauuuucuguuuucuuucaggcucuggauauaguacugacaauauaaggaguucauuuugaaacccacagcuagacucaaguuuugaccuuuuucuaccaugcuucguuagcuuugccuuucaugauuuggccuagggcuuggcaaacuucagcccauaggccaaauccaaccugucacuuguuuuguaaaaguuuuguuacaacacggcuauguccacaugcauaauuugcucauuauuuauggcugcuuucacucugcaaaggcagaguugaggaauuguggcagagacccuaugucccucaaagacuaaaaccuucacccucuggcucuuuacagagguuggugaccccugguuuugcccaugcaucucaacugggguaauaccaacacucaguacaaaaacuuacuauuuuguguaaauuuuucaaaauguguguuucccacuagacucuuugcugaagaacaaggauuguacucuucuugauuucuguauucacauuacuuagacccugugucccucaaagaccaaaaccuucacccucuggcucuuuacagagauuggugaccccugguuuugcccacgcaucucaacuggaguaauaccaacacccaguauaaaaacuuacuauuuugcguaaauuuuucaaaauguaucuuucccacuagacucuuugcuggagaacaaggauuguacucuucuugauuucuguauucacauuacuuggugaaagaauaaauaauaaauuuaguacucuaaguuauuuguaucuucucuuuuauaauucaguuggaaguaagagagacaggaucacaauauuaauugaagauaaacugaggauaaaauggauuguguuuggaaacugauaugaccaaaauaauacggaaacuuugacaaguuauuuaauaauaagaacuccuuuguuaauaguguuucuuucacuuucucauuuuaguuacauauuaauuauauucuucacugguuuauaauuaaaauaagcauaaauacuaacugccccuaacuauagugacuugugacuagugaucucaguaguuauacaauacagggguaauauuuuaauaucuacuuuuuucuuuggcuguuucaggucaugggagauaaucugcugcugucauccgucuuucaguucucuaagaagauaagacaaucuauagauaagacagcuggaaagaucagguacauguacauauagcuuuaacuuuaauaucaccucacuuugcuuuuugcuuuuucucaagguuaaaaauguaucaucagaaugaauauguuuaccuuuggaaaaauuugucccaaaguaaauaucuauccaguacuacuuuauaacuuuaaauuuauuaguaauucaaaacauaaauagacuuacagauuuuauucaacaguacuucagaaauccaugcugcuauugcuuauuucugauuccuauaauuaaaauuuaaaauguaaugaaacaguauuugaacaugguuugugaauuguaauauuccacacaaauauaauucuauauugcuuauauauugaaauaauauauuuuaucagcauuugaugaguaccaagaagccauuaaauuuuuucaaaaacaauuugaaaagcaccauuugaaaauuaaaguauucuuaaaaacagucuauuuaacuuaaaauaaucuguuuuaaguuacuguaaacgaaguucgcaucaucuucuagaaaaauugagaaauucagaaggaaauguagaaaguuggccuauauagguaaauuuuacuuggcauguuaagaaacagaaagagcuuucuuuuuaucuugagccuguaucuuaaaaauuucuuaaagguggccgggcaugguggcucaugccuguaaucccagcacuuugggaggccgaggcaggcggaucaugaggucaggagaucaagaucauccuggcuaacacggugaaacccugucucuauuaaaauucaaaaaaauuagccgggcgugguggcgggcgccuguagucccaguuacucgggaggcugaggcaggagaauggcgugaacccgggaggcagagcuuccagugagccgagaucgcaccacugcacuccagccugggcaacagagugagacucugucucaaauaaauaaauaaauaauaauuucuugaagguguaccagacuuucucuucacuuuauugccuccuaaaagaauauuaauuuaaaauuccuuauguuaaaaguaauguauucugcaccgucuugucccauuuuucuauuuauuuuaaaauguguagcuuuuuagcaaaaguaauacaucaacaugguuaaaaaauaugaauauuccagaaaaauauuuauuauaucuaauaguggguguguuuccccacucuggguucauuucucaaccgucuauacaaacuugaucauauuuuaucuacuuuuguaccuugaucuuuucucuuaauuagaucuuuacuuuccccaaagaguaugagugaaauguauugacagaccccuccauauuugauuggcauaugaggcaugcugccuuagugaaaaaauagcugagucugggugcaguggcucaugccugguaauccuagcacuuugggaggccaaggcaggcggaucauuugagccuaggacuugaagaccagccugagccacaaagcgagauuaaaaaaaaaaaaaaaaaaaauuggcugggcaugguggcacaugccuauagucccaguuauuugagaggcugaaaucggaggaucacuggagcucaugaguucagaguuacagugagccaugaucauggcacugcaccacagccugggcaacagagcaagauccuaucucaaaaaacagcaauagaauguuuaaaacguuuggcuuuucguaaagaguaccuuguacauauaaauaauguugaagguguuuuuaaugacuaccauuacguaccuauccauuguuuuuuuaaagggaauuuaccuuuaucaauucccauauauucuuaugaauuuuaaauagacuuaauuuucuacagaauaauauuuuaauauuuacuuaacaaauaaguauuagguacauucuagguacuuuauaauuagacauugacaaaacaaagaccccuguucucaugaaauuuacauucuauaucauguaaaccagucagcuuguauuaaguuagcuauuucugcuaucuacacaugauuugacuuaauuucauuauuucacuugaauauuaccuguauuuuacuacccacauuuucuauuuccacuugaagcccaauaaccugcaucaacuuuuucuuauuauuaaaaucacugguuacacugaugagauaaaaaguauaauaacaauauuaauuucagguauaaauuggaaccuuauuaacuaaaaaauuuuaaggcuuauaauugauuuuagagaaauuaaauuaguugaaugcuguuuauaaauaccacauuuuauaaauccugauagggcuuauaaaugaguccauuguuuuucuuuuacucacacucagugauuaaguaauuagcacccuguuauugucuuacgugagauauaguacauguuuuccccuagugacuccaucauuccuagguuuacuucuuucacaaguaagagaauccccuucaccguacaacccauucaccuaugauuugcuaauauauccuauggccagagacaaaugaaguccaccauucccugggguaaagccuaacugaaauuuguagggaaaaaaauuuuaagcuuaacuuacuaguuuuuacacaugaauaaacaaaucuauaggccucaaucacacagcugcuuauuaauaucaugauuuggcucaagcauucauuguaguuaaauguaauauauaauuguuaucauuuuuauuuuaguuccacuaaaauuauuuucuaaagcuggggcauuauggaaggauuauuaaccaaagaaauaaauaaaugaaauaaacauugguuaagaucaucuuauaugggaauaaagucuccagacucauucauucauugaaugauuuuugacuguauguuauuugucuagcacuguuuuugauguccucacauuugaguguagaaggcagguaaacaguuaauuauaguucaguguguuaagggaaauauaggaugguuacuauggaagcccauagcaagggcacuugggaaauucagagaagggcucuuagagaaauugccaugcaauuuaaguccugaaugaugaggagaggaguuacucaaaagcuaugugaagugaaagggccagaguauggugagagaugacacuagagagaugaggauggaucuguuuuggcagaauuuguuaaggaguuuggauuuuauuauuaaaaaccauaggaagcuaauauauccaauauggguccucuugauacaccagugcuaucuguaaaaauaucaugagagucuuguauggucauguggcuugcaccuggaaaacccuggagucuccuuaccuguaaacaaguacacaguguuuuuucauccuaccuacugaaauacagguccgucccugcuaacuggagucuuaaccacucauucauuuauucagcagauguucacagauuaccugcuguguaccauucucuuccuuaccacggagcagcuuuccuacguucuguagucucccccaaagaaaaauauuuuuuguagcuuugacauugaacuaaaauugagaacaaagaagacauugcugauggauugauaaccuguguugucucagaaagugacagaauuuauaaaguuuaaaaaaggaugcauaaaaaugccucaauaaaguuauacauaaauacagaauguuuaauguauuugaauugccuucaguucgaguguugaguuuuacuaugcauaaagcacuauggcaggcuuuauggaagguaaugaggauaaaaccauuucuauuauuaaagaguuuccaguguaguuggcaaggugaggcacauaugcaaucaacugucguacaagauagcguauaauagauuagugcucaguuagagauauaaaggcaaaggaaggaucacuuucaccuaggagguuuagggaaggcuuugggaagaagauacuauucaaagguaggucugaguugugauaaccaaaccuaagggguagagaccugggccuucugcguggaaagugccaggguaguuugagaaucaacuggucuuuaagcuuugugucaggaguuauaaccucaaaugucuacugggguucauccuagaggcaugcguacuuacauuguaugaacacugucuguggaauccauuuuuaaauauuuauacaggaacuccuguuguacagcauucucauugcauuccaugugaaaaugacccccuuagguuguguagcauggccuugcauugguagacucucaauucgcaacuccgcguucgcauguuuuaagggcuaguacuagggaauugguuauggcucauagaauaggagccugagacuucuguuuguuucccuaaaaccaauggcuuuaucaaaaguauuuuaacuuaauucuuaaauuauugaaugaaauaagcuuuggaauuuuauguauuuucaugcugaaguuuagcuuauuuugaaucuauaauauaaucugaauaucacuuugaaagcuaugauuuuuucagcuuaaaauugauaaggaccuucaaacaaaaacaaguucuggucauuauagccuggucuaaacuaauuucuuggucugguuuucugauucucuaguauuuaaauauuaaauauuauaguaaauauuauaguaaaguuuauuucauaaugccaaaaugacaaguuugacuucuuagaucuguucuauuauauauuacaaauuguuuuuuguuuuuuuguuuuuuuguuuuuuguuuuuuguuuuugagaugggcuggagugcaguggcauguucacaacucacucacucagugcagccucgaccucccugggcacaagcaauccucccaccucagccuucuuaguagcuaggacuacaggcaucugcaccacaccugcuaauuuuuuuguauuuuuuauagagacgaggucucgccauguugcccaggcuggucucgaucuccuggcaucaagugauccacccaccuuggcuuccuaaagugcuaggauuacaggcaugagcuauugugccuggccaacaaacuguauuuuaaaauaaaccauuuauuucuucaggggggcauuuuuuuuucaggggcaacccgugaaaaacccauuuucaccaaaggugaaaugucuaugguuuaacaguuuuagauccacaaacacuauacucaguagccauccucuggaaaaauucacugaauuuuuagcacuguguggcuaaacagagucuuucucuauuguauaaguccauuacaguucuaagcugguccaugaaauagucauuauuuccuuauuuuccaucaguccuaaugcugcaaggacucuuuuacaagaacauaauaauuuagaaaagauggcuggcaaggguguucauuuuuuugaguuuagaaaauuuaauaaguaggccauaagaauauucuuauaccagauucuagacccguugccaccuuaagcaaauguuccagacuugaugugauguuaaugaguuucauguuuuuaaauaagguaagucuggcauguugaucuuugaagaaauaccagcacaaauauuaacuuaguuuacuacuuaaaugcugaucagcuugcaguaguaauacauuuacaugagguuauauaguguuguuuaaacuagauuuccaggcuuacugaaaaaaauuuaaaagaaaccaaaaaaguagcuaguauuuacaucuaagacugcugaaucaugucugauagacucuaaaguguuagaaaagugucccacauuugaaagacacgucaaaauuuugugguccuuuauuuuauaaguuauuugauguuaggguaaugauaggauaauuaucuuuauuggcaauuguuuuuaucaaaaggguagcauccuaauuccuaauagguuauuaugugcaaguauacuaacacgaauuaacaauuguuaaagaaaagcacaguaaguacucccaauuuuuugucuucaaaauaauauacacacuuuucuugaucgauaaggugcuuauucccauauaaagaggucuuaacagacacaauuguuuauaccuaauucaaccuauuuucaucucacuuauuccuauacugcauauauucugucugaauaaaauugcauuuucuuuauaagugacaguuacacagucuuuucuccuuauacccaggugauacauguuguuccaagauacccacuggaugccugacaccacagauaauucuaaaaccuaauauacuguguauuuuccuacacauacaugccuaugauaaaguuuaauuuauaaauuaggcacaguaagagauuaacaauaguaacuaauaauaaaauagaacauuuguaacaauauacuguaaaaaaaaguuaugugaauguggucuuuuuuuuucucucucucucucucccucucccaaaauacuguaauaguuacggaccaugcuugacugccacuaacuaaaaccauggaaagagaaacuguggauaagagggcauuacuguauuguaaauuauaaauauuaaaguuuugaggucauaacaucauuuacauuuguuuuauauuuuguuuucaauaaagaauaagauaaacaguaaagaauuuaugcauguauuaauaagcauucaauuggagcucauacacaugaauuaauugguacuguuggcuuaguauuuuaauucucaguuuaugcggugguugguuuuuuuucuuuguguaccuuugaaaagauacauugcuuugguauuauuaacaaaaaaguaauagguuuuuaaaauauaaaaaguuauaugcuuauguuuuuugauuuauagaauauuauuuaaagacaaagaucggaauugggaugacauagaaagcaaauuaagagccgaaagugaagucccuauugugaaaaccucaagcaugguauaguaauuuuucuugaagauuaaaacauuuuaauagaguuuuauuuuaaggaaaagacccuuauuuuugagcuguucguugauuugcuuuuucaaaagaagauauaaaugcaaaauuuugggaaauuuuauuucuucuacugacucacagguuuaaaauguugauuguuucaaaguugcagaggguaugaaggaggagccuuuuguguuucuuacuaguauagauuguucuuguaauaauuaaacauuagaaacaugaaauuuuuaaagagaaccaaaucuaacaugaaaauauuaaguugacauaagucguuuccguuuacuuaauauaaugcuuaucuucuuuuuaaaagaauuuguacagauuuucauugcucagaauauaauuauaauauugagguugcaguuuauauguuuuuacaaagauaauuugaaggcauuuuuacauaguuauugcaagguugauuaauaagaauuuuaaaaaucuuugcggccggguacuguggcucacgccuauaaucccagcacuuugugaggccaaggagggcggaucacuugaggucaggaguugaagaccagccuggccaauauggcgaaacucugucuuuacuaaaaauacaaaaauuagccaggcauuguggcgggcgccuaucaucccaacuccuuugggggcugaggcaagagaauuacuugaaccugggaggaggagguuacagugagccaagauugcgccauugcacuccagucugggcgacagagugagacucggucucaaaaaaaaaaaaucuuugcuuaaauaguaguaaauguuaaacuuuucaucugcuacaaucaucucacugaaaaaguuauuguauuucauuuuaguuuaaauauuuuaauuugaaucuuguuugcuagauaucauaauuauuucauaucauguugcuauuaauguaguaaguaccauguagauaauauuaaguguuccaaauaaagugagagugaaauucauugcuuguaaagugauaacauuuagcuaaaaguaggcuaauuuuuguuauugcuuucccugcaggagauuucuucuaucuuacaggaacugaaaagaguagaaaagcagcugcaagguaaauuuacuacugaauuaaguauaaagagcuaauaauuuagaauaagugccuucugagugguauuucuuaaaauauuguuaggauguuauuugauuaaauguaaugacauacauaaaauacagaguucaaacauucacauuauucauaaaaaggaauuuuuuuaaacccaguauaaaaauuuaaaauguaauaaagauauauguugggcauauuuuaguucauagguuugacaguaggcuagaugucauaaacuaauugaaauuuuuuauguauuacauauaaauaauaugugaaaaauauauaauaaaguuguguuaauuagcauuauuugugugauuugacaguucuuaaauuauguuggugguguaaccugaaacaaacuuacauucuaauagaaauaauaguuguuugguugacaagaaaugaguacauauuggccauagagaccagaagagaaaggagagaagaaagugaaagaggcugcccucuaaacuugucagagcugggcugugcauuaaugccuauguaugucuugacccagaaguccccagugguacaacaggcagguuccauagucaacugcuaauucuacugagucuuuaucuaucgaauaaucauagguacuuauguggauccuaucaaaaugauuuuucaucuuuauuuagccccaacacaccuaaggguuaugguacaccccaugaguaaaaguggcuugcuaacacagugcuuguuagcugguagacuggggguauacuuuuaaaagucccuucuacaugauucuuacaucuauguuacuuccuucucccaacucccuacucugcccaaugccaaauugaaaaucaccgccugagaacuuuccaugucaacccaaagaucuuuuggacugaaagcugaccuuuaacugaccccuuccauauaggcagcaagucuguuuggcuuugcaagcugcccugugauauuagucuguaggcucugagggaaccccuguaucucagugguguauacagcugauaacccuagcacucuggccaggcuaaaugaccguauucuaugguagcauucaaaguaugcugauguucuucuggccucuccagccuugagguuacucugaacccugacuuagcagcuaauaccucaguuaucugagugauguggguuuagauguuuauuaaaaaucauauucaguauuuucucgguccucucacaauaaugaagacaaauuucaacaagauuuuucuugaauuccacaucuucaaauaccagacuuacaagucucugaaaugcccguaagugccacaucaaaggacccagagaaaguauucagggcugggugauuuacaguacagcuacagaauaacuaagaauggaguuuuaaauauaauauuggaagauuagccacauuuaagaucacauacgcacugauaguuuaaauauuauccaaaucaugaacaguguuuauaugugaauguaacugcaucuaaaauuauuuccuuuucccgcccuuuagcaaucaaugcuaugauugauccugauggaacuuuggaggcucugaacaacaugggauuucccagugcuauguugccaucuccaccgaaacagaaguccagcccugugaauaaccaccacagcccgggucagacaccaacacuuggccaaccagaagcuagggcucuucauccugcugcuguuucagccgcagcugaauuugagaaugcugaaucugaggcugauuucaguauacauuucaauagauucaaccccgauggggaagaggaagauguuacaguacaagaaugacuuucucuugauuguugaaaaaucauuaccuguggaauggcuaggaauauuggaagcagcauaguguugauguacgcaaaacaagacagcuuggucagcuacaaucuuggaaucccugucuucuuaauuuuauuuauuuauuuuugacguauaauguaguauaucaauccuuucaaacuauuuagauaaccacuugaugcacaaauaggaaaaagcagauuguggcagugucgccuuuugugguuuuaugauuuucaaauugaauuuaaugauuacacccuuucccuucauagaucuuuuuucuuuuuuuuaagccaugcugugaccuacaagcaaacuaaauagccaacauuucugaaccccuaagucuccugugccaagcugcucccugaaauggacuucuucaucuguacagauuuguuaaaccauucuauuugcuucuuaauaauaggauuuauauuaguacucauuaccauuggacacaaugacauaaguacucuccacaguaaagcagaccuuucacaacagucacucuguguccuaaaauuuuccaacauagaugugauuuauauaacuuuguugauacguaaauugucuugggguuuacggaaauuaacuauuauguuugcacuaagauuugcugggagugguagguggacauaucuauauaucaauaaggacuaaccgucuuuuuuguacauaggagauugauaauacuguauuuguuuuaagcccacaguguuuuacuccacuuucaaaaagaucaauuuggcacuuuuuuucauuuuuuuuaauggaaauaagauuuggucucucauuuuagguuaaaugauaacuagaaagauuaaacuagacagauaguuuagguggaguauauuuuuaaaacucagaacauguauauugguccuguguuaccaaguuuauaugugacaguugaaaaagaaauucccuugaaaugaucaugagguuaaaauuuucuucauuaggggacuuggagaaccaguagucguaagauuaguugauaguuucacucccaagcaaugaauugcuucuguguguuucccuguaggacucaauaguaaaugcugucugucuuacacauuuauaaggacccugcaagacgacgacaaaggccuuuggccugugcuacuaaacaagaagccuaugaaaaauuucuucuuuaaacuuguuuuuucucuuuccaguaaguucacauuuggauaauuuuaaaaagaaaaguaauuaccuuuguguuuccagaacacuauaauugggguguaucuuaauucaguuaaauauuauuaguagaccuggauuuucccccuugaccccaucagucuauaaagguuaaacugcaacuuuuaugaaauggucuuuaauauuuccacaauaauccugugcuauauuuguuuuaagaaacaaaguaacucuauacacuucaagacuuuacaggauuuuuuaaauccuguauuguuggaucaauuaauaaagaugcaaaaaaacuuuauagagauguaaaaacaaaacuauaauggaucuccuauuuuucuuuaaauacaaaaaaaaaaagguaaaugaacuauucuccuuguaaagcuaaauuccccauucugucuaauaaaggaagacugaaaaaagguuuuaaagaacauaaauggaaagauacaaaugcuuugaaggaauaaacgaaauguuaaaacagggucaauccauuugaagaaaaaguuggacaaaauaaucagcauugcucccucuuuuauuuaauauuuggguacugauuauauccacauggaaguagaagguaaggaguuuaggaaaauacuagaaucuacucugcuuacauucuuguuuaaguguuuacacaguuugguucaauuauaaacauuuggccuuuuacuauguuauuuuuauuuuguaugaauacauuauccuccuuauuuauuuuuguuacauuuauuacuuauguuauuuuguuaugcauuuacaacuccauuuuuaaauaaaguguuucuggaacuuuauacaaugauu

SEQ ID NO: 12982 - RNA, 6498 nt, Homo sapiens
cucuuuggucacacauguaucucaauggccucagcucugaauacaaagcacauaagcaaacaaauauaacagcaucaguuaaauucugguggaaaguaaguaguuuuuguaguuauuauauucaauuacaccuaauuacuagaguuaaaugauauaacagcacuuugugagauaaugcucauaaccaguuaaauuucuacagcccaguuuggccaauauacgcugagugauuccccaugaauccaucuucuuccacugaaauaaauuaagguuaguuuucaccugcuccaacuauaaacagauuuaacuuuaaaaaguauagguaaaguaugugagacauuucaaaauggguagggaaaaaaaagaaaacauugauuauuucauuuaacucugaaaggaguaauaaagcauauacugcuuuucuucaaguucuuaagggcuuugaauuaugugaggauauuuaaagguuaaacacaugcuuuuagaagcacaauguuaauuccuauacuuuaaaccagauacuuccagauaauuuaauuuugacacacacauccaaauauagcaccaacuggaaaauuaaaacuccuaaaucagcucaaugaauuccuaguuuugaaaucacuauuuugcgccaggacucuaauuggaaguauguauaacuucugauuuuccauuuacuaugcuaaauaaaacuguuuuauagaccccccaccgccgcugccccguauaucauaacuuuuguuuugaaugaguaucuugggaagacaacuagaaccuuacuuuuuuuuuuaaaaaaaaaaaggagcccccaaauauacaacaugcuaaugcuauuagaaaucuggauccaauuuaccugaagcagagccaugagcugaggucauacuuuugaccuuggagucugagagucgagagauacuguuagcucuaauucuaggagaaaauuuaucugaugguacuagucuggcuccacuucuaaugauggcuucugcgguccucgaagaggcacuacuucuagaaauuguugcuucagagucacuacgagcugacagugagccaagucguguucuacgaggcugagccaauaaaucaauccgagagauguuacgccuuccugugggagguuuugauguagaacuuguuguggauacuucagaagcaacagaugcuuugucagcaucagcaaguucacugucugaagcuucaccaagucgugcucugcgcaagagggaaguccugguaggucguggccuuggaagggugguugauuuacuagaugaaccagauaccaccggagaagucuuagauuucguuacuuuacuuccuuccaguuuggaauguacaugcucaucagcugagguaaguggaguccguccaugagguuuacaagaguaaguuucuugaucagaugacauaauaucagagauggcagaaugagguacacuagagguuuggucaucaucuguuaagucuacugagggcugucuuauucucccacuggacugaacaaauuuacgaccaucugcucuugaacccacaucuguggaacgacuuuuuguuuucuuuuccauuuuuucccuagcaccugaagaugaugauuuuguaacaucuuuggaaggagaaccuguggaacaccuaucuuuauagaggcuagugaaacucuuucgcuuuuggguugacuuucuuucaguuucuccaguaaccagacugauuguacuagcuguaucuacaucagauucuggugaaauagaauugucucuauuauaacugggaguaucugguccuucaucaguuuuauuaucuucacguaguuuagcuucuagaaaagccauuacugcuucugugucuuuuagaauaaggguuguguccauacuagaaucaggauccaaagacucacuucuuucucguauucuacuugcagauguuaaugcuaaagaagaaggaguagaggaagucuguuuauuuauauggggaauaaguucuauggguauguuugggcuggguuuuucuauagugaagcucccuugucgcacuaaugacuuggaggauuccuucuugucuccucccuuuggagucugacuuuucagaauuuccucagcuuuucuucucuugcucucacuuugugccacucugucuccuuugcuuguagaauguccugaauuuuuuucuggagguugugauucuuguuuaaaaguuuccucccuacauuuaucugucugaccugaaacauuuuuggaagacaauuuaguagguguccacugagccuccucccuuuguucuuguuguugaaguuuugcuaauguuugcuuuaccaaagaaguuuccuuaucaguuucacuuuucucuuuuccaggagcagagcugccuaagugaaguaggguuuuauuaucuccaccaguuuugagagucucuccauuuacugcccuguucauuuuacucaagggucugucagcaucuuguuuaucuuucugguauaccuguguagguguuucuuucuccugaaguucugugucuuguuuuucuccuaucucugaccucuguguuacaaccuuugcucuguggcucucaagagacuuuucuucauuuggaagcuggggaagaguucgucuccuucucucucccuggcuagccaaggaaguugcagagccaguacuucucacugucaugccagacucacugaucucugucucuaugaaauaaaaaccacaaagaaggaauugauuaagacaaauaaaauaaaaauaaaaggagcaucauacaguugucugucaguauccaugaagacugguuccaggccccuuauucccccaggauaccaaaucccaaggaugcuugaguaccuuauauaaagugguauaauauuuguauauaaccuacucacacccucccauauacuuuaaaucaugucuagauuacuuauaauaccuaauacaauguaaaagcuauguaaauaguuguuauacuguauugcuuagugaauaaguacaaaaaaauaaagacuacacacguucaguggggacgcaaucauuucuuuuuccccucucaaauauuuucaauccucaguugaauucacagaugcaaaacccacuaauacaaaaccuauggcuagagagggccagcuauauuacauuacauuuugagauguaaguuaaaaaugacuuaaguauacaaaacaaacgagccagcauugugacgaaguaguuuaaguacaauuucaagcugcacaaauaagcaauuccuagagaagucaggaaggccaauuguaugagaugaaaauuagagucaucugaucauuuuucuccuuucauauauuuaauuuucuauuuaugaauugacaaaaauuauauauauuugugguguauaacaugauguuuugauauauguauaccauuauggaauggcuaagucaagcuaauuaauauauccauuaccucacguacuuaucuuuuuuguggugagaacauuuaagaucuacuuucagcuauuucaaauacccaaggcauuguuauuaacuauagucauaaugguauaaaagggucaucugaucuuaaaccuaaauauauugcucuucuuuccucuuaauguguuuuauagaagggaaguucacuguguucauucucacuuuuguaacuuuccauccuugagguuugcucaaaaaaccagaaucuauuguagauuuauacagagaaugucaaauaaacauuguuuauuuucuauauuuucaacuacauaguagagaagaacaacauaacuaguuuuuaaaaaguauuaucuacuugaaagaaugauaauuuuggauuuccuaaguaaagugaaaaaugcagaacuuuuaacaacauuuuaaaaaaaucuauagccgauuaaaagaauuuuaaaaauuguaaguauguaacagcagacuuuucauaguuaggacauagcaaaauuuuauaaauugaggaauuuuuaaauuauagucuucugguuauuaaugccacauauggaaauacaaaaucccuuucuuuuuuuucaaguagaagccaaugagaaaauauauauuuugauuuuuccaccugagagaauuugagaauauuuaaggauuuuccugacuauuaaaaauggaauguauuucugagaaaagggaaacaucuuuucagggaaauauaaauuaacauauaaagcuuccuaaucuuuuagggauaaauggagaaaagauacuagauauagcuucugugggucuuuuuuuuccucuuuacaauccuaaaaguuuaguauuuaaauaucauaucaauacaauggaugugauggaggaaaauccauacugaacugauagauuuaacuuuagucauuaaucauguuauaucuuguuuuguuucuucuuucauauaucuuaucuccuuagugcuaacugaagcaucuagaauguaauggcuacuuuacccuuuuguauuuuuccaguauuucucauacugcccccuccucauauacauucaauaugcuuaacaaaaacguuuuauuauuuaaguagauuuaucagcuuauguaaauaaguucauuuaaauaugaugacauagaaaugagaucaugaaagcuaaguggucuauuauuuuuuauaacaaggguagaacuuugcuuuucacagauaauacuuaauaauuuuauaacggauucuuugguaaaguuaucuagccuucugucugguuucuuuguuuccuaaacacaguuuauacgaaccaaaugacucuguucccucaaaagaauuuuuggucauacuaucaauaacuucuagauucuaauauaaauaaaugacguagcuuuucuaguacacugcuauguagcuuccucaaauacuucuaauacuuacaaaauucuuaaaacagauuuuuggggugccacaagccugagacaaaacaaauuuccauuuucaaccggaaugaaauuaagaaaacagauaaaagccacauacaaaaucucauugagggucuuuuugcuuuuuaacuguaagugaguauuuauuuuucaacuuggauaaguuuuuuaauuguuuauuguaaguugacaauuuauauuuguauauguuuaugguguauaaaauguugaccauaaauacaaugugaaauaauuaaaucaagcuacuuagcauauucaucaccucaaagaguuaacacuuuuugugaugagaacaucuaaaauguacaauacuauauuauuaacuauauucaccaugcugugcagcagaccucaggaaaaaaaaaagcuucuuccaccugucuaagugagauuuuguaccuuuugaccaucaucuccucauccuccuuucagggucuuauuguuaauuagaaaacuaaugaacaaaaaguaauaaugaaauccuugaagguacacaacuucauuuuguuuaaaaagccuuuauauuucuguucacagaaauauaaaagguaauaaaagucauacuacauagauuuguaagauuauuaacuucuuuuucacuaaauguaccacaugaaguaggcacucaauaaauaucuguuguauuuaugaaugaaaucguuuggaccugucuucagcuuauuuuuaaauuuuaacuuauauauauauaauauauaugugcuucaucuuucuauguaauauauacacacaccuauauaugcuucaucuaaaaauuauuuccuuaucuucaguuaaguuuauacuugaauaauagcugcaucauuagucaaaaucauaucuuaagauaucagcauaucagaaagaguaggaagaauuuucauuuaaaaguaaagacaaaauuuaaaaaccauucuuauuuucaacagcagaaauuuacaacuaaaaugaaaagugccucggaaugaaauauuaaauccaagcuggugucuguccaccuguccuuaggaagucucaacuuacgaaguccacaaaauuucucaaaaaagaguuuuaucacuuugaauuuguccccugcuuaaaaucccucaaaauauacaauaucuaauaaaaaucagccuuuuacuuauaaaaugaauucauuuaucagcaugagaauaugugaauauguuuauuuagguuuaacuuacuucuuacuauauagauuuggcuuguuuuuuauaauaacaacugauauaugauucacaaaaaagcagagaagaguaagagaaagagagagaaauggagaaagagaagaaaaaagggauaaagaaugaaagagagaaagagaauaccauucucuaaaggaagaggugcagaaaauuccauuauccuuucuucuugaucaugccuuguaugauuggcagccaaacuagcccacugugaaacccaacguuugcuuccagaugaagaugugccuuccuaaaggagaaaaauaagaaaacaaaaucaugcagccuggucauaucugagucucaugaaagacaauuucauuuagucacauuaacuugccauacaaacccauaauuaaaccucaccuugcuauauuaucauugauuacaucuucucuuauauaaaauaaaaauucucuag

SEQ ID NO: 12983 - RNA, 6498 nt, Homo sapiens
cuagagaauuuuuauuuuauauaagagaagauguaaucaaugauaauauagcaaggugagguuuaauuauggguuuguauggcaaguuaaugugacuaaaugaaauugucuuucaugagacucagauaugaccaggcugcaugauuuuguuuucuuauuuuucuccuuuaggaaggcacaucuucaucuggaagcaaacguuggguuucacagugggcuaguuuggcugccaaucauacaaggcaugaucaagaagaaaggauaauggaauuuucugcaccucuuccuuuagagaaugguauucucuuucucucuuucauucuuuaucccuuuuuucuucucuuucuccauuucucucucuuucucuuacucuucucugcuuuuuugugaaucauauaucaguuguuauuauaaaaaacaagccaaaucuauauaguaagaaguaaguuaaaccuaaauaaacauauucacauauucucaugcugauaaaugaauucauuuuauaaguaaaaggcugauuuuuauuagauauuguauauuuugagggauuuuaagcaggggacaaauucaaagugauaaaacucuuuuuugagaaauuuuguggacuucguaaguugagacuuccuaaggacagguggacagacaccagcuuggauuuaauauuucauuccgaggcacuuuucauuuuaguuguaaauuucugcuguugaaaauaagaaugguuuuuaaauuuugucuuuacuuuuaaaugaaaauucuuccuacucuuucugauaugcugauaucuuaagauaugauuuugacuaaugaugcagcuauuauucaaguauaaacuuaacugaagauaaggaaauaauuuuuagaugaagcauauauagguguguguauauauuacauagaaagaugaagcacauauauauuauauauauauaaguuaaaauuuaaaaauaagcugaagacagguccaaacgauuucauucauaaauacaacagauauuuauugagugccuacuucaugugguacauuuagugaaaaagaaguuaauaaucuuacaaaucuauguaguaugacuuuuauuaccuuuuauauuucugugaacagaaauauaaaggcuuuuuaaacaaaaugaaguuguguaccuucaaggauuucauuauuacuuuuuguucauuaguuuucuaauuaacaauaagacccugaaaggaggaugaggagaugauggucaaaagguacaaaaucucacuuagacagguggaagaagcuuuuuuuuuuccugaggucugcugcacagcauggugaauauaguuaauaauauaguauuguacauuuuagauguucucaucacaaaaaguguuaacucuuugaggugaugaauaugcuaaguagcuugauuuaauuauuucacauuguauuuauggucaacauuuuauacaccauaaacauauacaaauauaaauugucaacuuacaauaaacaauuaaaaaacuuauccaaguugaaaaauaaauacucacuuacaguuaaaaagcaaaaagacccucaaugagauuuuguauguggcuuuuaucuguuuucuuaauuucauuccgguugaaaauggaaauuuguuuugucucaggcuuguggcaccccaaaaaucuguuuuaagaauuuuguaaguauuagaaguauuugaggaagcuacauagcaguguacuagaaaagcuacgucauuuauuuauauuagaaucuagaaguuauugauaguaugaccaaaaauucuuuugagggaacagagucauuugguucguauaaacuguguuuaggaaacaaagaaaccagacagaaggcuagauaacuuuaccaaagaauccguuauaaaauuauuaaguauuaucugugaaaagcaaaguucuacccuuguuauaaaaaauaauagaccacuuagcuuucaugaucucauuucuaugucaucauauuuaaaugaacuuauuuacauaagcugauaaaucuacuuaaauaauaaaacguuuuuguuaagcauauugaauguauaugaggagggggcaguaugagaaauacuggaaaaauacaaaaggguaaaguagccauuacauucuagaugcuucaguuagcacuaaggagauaagauauaugaaagaagaaacaaaacaagauauaacaugauuaaugacuaaaguuaaaucuaucaguucaguauggauuuuccuccaucacauccauuguauugauaugauauuuaaauacuaaacuuuuaggauuguaaagaggaaaaaaaagacccacagaagcuauaucuaguaucuuuucuccauuuaucccuaaaagauuaggaagcuuuauauguuaauuuauauuucccugaaaagauguuucccuuuucucagaaauacauuccauuuuuaauagucaggaaaauccuuaaauauucucaaauucucucagguggaaaaaucaaaauauauauuuucucauuggcuucuacuugaaaaaaaagaaagggauuuuguauuuccauauguggcauuaauaaccagaagacuauaauuuaaaaauuccucaauuuauaaaauuuugcuauguccuaacuaugaaaagucugcuguuacauacuuacaauuuuuaaaauucuuuuaaucggcuauagauuuuuuuaaaauguuguuaaaaguucugcauuuuucacuuuacuuaggaaauccaaaauuaucauucuuucaaguagauaauacuuuuuaaaaacuaguuauguuguucuucucuacuauguaguugaaaauauagaaaauaaacaauguuuauuugacauucucuguauaaaucuacaauagauucugguuuuuugagcaaaccucaaggauggaaaguuacaaaagugagaaugaacacagugaacuucccuucuauaaaacacauuaagaggaaagaagagcaauauauuuagguuuaagaucagaugacccuuuuauaccauuaugacuauaguuaauaacaaugccuuggguauuugaaauagcugaaaguagaucuuaaauguucucaccacaaaaaagauaaguacgugagguaauggauauauuaauuagcuugacuuagccauuccauaaugguauacauauaucaaaacaucauguuauacaccacaaauauauauaauuuuugucaauucauaaauagaaaauuaaauauaugaaaggagaaaaaugaucagaugacucuaauuuucaucucauacaauuggccuuccugacuucucuaggaauugcuuauuugugcagcuugaaauuguacuuaaacuacuucgucacaaugcuggcucguuuguuuuguauacuuaagucauuuuuaacuuacaucucaaaauguaauguaauauagcuggcccucucuagccauagguuuuguauuaguggguuuugcaucugugaauucaacugaggauugaaaauauuugagaggggaaaaagaaaugauugcguccccacugaacguguguagucuuuauuuuuuuguacuuauucacuaagcaauacaguauaacaacuauuuacauagcuuuuacauuguauuagguauuauaaguaaucuagacaugauuuaaaguauaugggagggugugaguagguuauauacaaauauuauaccacuuuauauaagguacucaagcauccuugggauuugguauccugggggaauaaggggccuggaaccagucuucauggauacugacagacaacuguaugaugcuccuuuuauuuuuauuuuauuugucuuaaucaauuccuucuuugugguuuuuauuucauagagacagagaucagugagucuggcaugacagugagaaguacuggcucugcaacuuccuuggcuagccagggagagagaaggagacgaacucuuccccagcuuccaaaugaagaaaagucucuugagagccacagagcaaagguuguaacacagaggucagagauaggagaaaaacaagacacagaacuucaggagaaagaaacaccuacacagguauaccagaaagauaaacaagaugcugacagacccuugaguaaaaugaacagggcaguaaauggagagacucucaaaacugguggagauaauaaaacccuacuucacuuaggcagcucugcuccuggaaaagagaaaagugaaacugauaaggaaacuucuuugguaaagcaaacauuagcaaaacuucaacaacaagaacaaagggaggaggcucaguggacaccuacuaaauugucuuccaaaaauguuucaggucagacagauaaauguagggaggaaacuuuuaaacaagaaucacaaccuccagaaaaaaauucaggacauucuacaagcaaaggagacagaguggcacaaagugagagcaagagaagaaaagcugaggaaauucugaaaagucagacuccaaagggaggagacaagaaggaauccuccaagucauuagugcgacaagggagcuucacuauagaaaaacccagcccaaacauacccauagaacuuauuccccauauaaauaaacagacuuccucuacuccuucuucuuuagcauuaacaucugcaaguagaauacgagaaagaagugagucuuuggauccugauucuaguauggacacaacccuuauucuaaaagacacagaagcaguaauggcuuuucuagaagcuaaacuacgugaagauaauaaaacugaugaaggaccagauacucccaguuauaauagagacaauucuauuucaccagaaucugauguagauacagcuaguacaaucagucugguuacuggagaaacugaaagaaagucaacccaaaagcgaaagaguuucacuagccucuauaaagauagguguuccacagguucuccuuccaaagauguuacaaaaucaucaucuucaggugcuagggaaaaaauggaaaagaaaacaaaaagucguuccacagauguggguucaagagcagauggucguaaauuuguucaguccagugggagaauaagacagcccucaguagacuuaacagaugaugaccaaaccucuaguguaccucauucugccaucucugauauuaugucaucugaucaagaaacuuacucuuguaaaccucauggacggacuccacuuaccucagcugaugagcauguacauuccaaacuggaaggaaguaaaguaacgaaaucuaagacuucuccggugguaucugguucaucuaguaaaucaaccacccuuccaaggccacgaccuaccaggacuucccucuugcgcagagcacgacuuggugaagcuucagacagugaacuugcugaugcugacaaagcaucuguugcuucugaaguauccacaacaaguucuacaucaaaaccucccacaggaaggcguaacaucucucggauugauuuauuggcucagccucguagaacacgacuuggcucacugucagcucguagugacucugaagcaacaauuucuagaaguagugccucuucgaggaccgcagaagccaucauuagaaguggagccagacuaguaccaucagauaaauuuucuccuagaauuagagcuaacaguaucucucgacucucagacuccaaggucaaaaguaugaccucagcucauggcucugcuucagguaaauuggauccagauuucuaauagcauuagcauguuguauauuugggggcuccuuuuuuuuuuuaaaaaaaaaaguaagguucuaguugucuucccaagauacucauucaaaacaaaaguuaugauauacggggcagcggcgguggggggucuauaaaacaguuuuauuuagcauaguaaauggaaaaucagaaguuauacauacuuccaauuagaguccuggcgcaaaauagugauuucaaaacuaggaauucauugagcugauuuaggaguuuuaauuuuccaguuggugcuauauuuggaugugugugucaaaauuaaauuaucuggaaguaucugguuuaaaguauaggaauuaacauugugcuucuaaaagcauguguuuaaccuuuaaauauccucacauaauucaaagcccuuaagaacuugaagaaaagcaguauaugcuuuauuacuccuuucagaguuaaaugaaauaaucaauguuuucuuuuuuuucccuacccauuuugaaaugucucacauacuuuaccuauacuuuuuaaaguuaaaucuguuuauaguuggagcaggugaaaacuaaccuuaauuuauuucaguggaagaagauggauucauggggaaucacucagcguauauuggccaaacugggcuguagaaauuuaacugguuaugagcauuaucucacaaagugcuguuauaucauuuaacucuaguaauuagguguaauugaauauaauaacuacaaaaacuacuuacuuuccaccagaauuuaacugaugcuguuauauuuguuugcuuaugugcuuuguauucagagcugaggccauugagauacaugugugaccaaagag
